US010975383B2

(12) United States Patent
Dangoor et al.

(10) Patent No.: US 10,975,383 B2
(45) Date of Patent: Apr. 13, 2021

(54) ISOLATED POLYNUCLEOTIDES, POLYPEPTIDES AND METHODS OF USING SAME FOR INCREASING ABIOTIC STRESS TOLERANCE, BIOMASS AND YIELD OF PLANTS

(71) Applicant: Evogene Ltd., Rehovot (IL)

(72) Inventors: Inbal Nurith Dangoor, Gedera (IL); Yifat Louba Ofir-Birin, Mazkeret Batia (IL); Yaacov Micha Brog, Chevel Lachish (IL); Basia Judith Vinocur, Rechovot (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 0 days.

(21) Appl. No.: 16/102,903

(22) Filed: Aug. 14, 2018

(65) Prior Publication Data
US 2018/0362996 A1    Dec. 20, 2018

Related U.S. Application Data

(63) Continuation of application No. 15/311,205, filed as application No. PCT/IL2015/050550 on May 27, 2015, now abandoned.

(60) Provisional application No. 62/075,940, filed on Nov. 6, 2014, provisional application No. 62/003,599, filed on May 28, 2014.

(51) Int. Cl.
C12N 15/82    (2006.01)
C07K 14/415   (2006.01)

(52) U.S. Cl.
CPC ........ C12N 15/8271 (2013.01); C07K 14/415 (2013.01); C12N 15/8247 (2013.01); C12N 15/8261 (2013.01); C12N 15/8273 (2013.01)

(58) Field of Classification Search
None
See application file for complete search history.

(56) References Cited

U.S. PATENT DOCUMENTS

| | | | |
|---|---|---|---|
| 6,084,153 A | 7/2000 | Good et al. | |
| 2002/0046419 A1 | 4/2002 | Choo et al. | |
| 2005/0108791 A1 | 5/2005 | Edgerton | |
| 2006/0150283 A1 | 7/2006 | Alexandrov et al. | |
| 2006/0179511 A1 | 8/2006 | Chomet et al. | |
| 2009/0265815 A1 | 10/2009 | Alexandrov et al. | |
| 2011/0214205 A1* | 9/2011 | Dietrich | C07K 14/415 800/281 |
| 2013/0333068 A1 | 12/2013 | Coffin | |
| 2017/0088852 A1 | 3/2017 | Dangoor et al. | |

FOREIGN PATENT DOCUMENTS

| | | |
|---|---|---|
| EP | 1220936 | 7/2002 |
| EP | 2090662 | 8/2009 |
| WO | WO 01/23594 | 4/2001 |
| WO | WO 2004/081173 | 9/2004 |
| WO | WO 2004/104162 | 12/2004 |
| WO | WO 2004/111183 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/078153 | 5/2013 |
| WO | WO 2013/080203 | 6/2013 |
| WO | WO 2013/098819 | 7/2013 |
| WO | WO 2013/128448 | 9/2013 |
| WO | WO 2013/179211 | 12/2013 |
| WO | WO 2014/033714 | 3/2014 |
| WO | WO 2014/102773 | 7/2014 |
| WO | WO 2014/102774 | 7/2014 |

(Continued)

OTHER PUBLICATIONS

Keskin et al., 2004, A new, structurally nonredundant, diverse data set of protein-protein interfaces and its implications, Protein Science 13: 1043-1055.*

Guo et al., 2004, Protein tolerance to random amino acid change, Proceedings of the National Academy of Sciences Usa 101: 9205-9210.*

Thornton et al., 2000, From structure to function: approaches and limitations, Nature Structural Biology, structural genomic supplement, Nov. 2000: 991-994.*

(Continued)

Primary Examiner — Bratislav Stankovic

(57) ABSTRACT

Provided are isolated polypeptides which are at least 80% homologous to SEQ ID NOs: 552-897 and 6029-10629, isolated polynucleotides which are at least 80% identical to SEQ ID NOs: 1-551 and 898-6028, nucleic acid constructs comprising same, transgenic cells expressing same, transgenic plants expressing same and method of using same for increasing yield, abiotic stress tolerance, growth rate, biomass, vigor, oil content, photosynthetic capacity, seed yield, fiber yield, fiber quality, fiber length, and/or nitrogen use efficiency of a plant.

17 Claims, 14 Drawing Sheets

Specification includes a Sequence Listing.

(56) References Cited

FOREIGN PATENT DOCUMENTS

| WO | WO 2014/188428 | 11/2014 |
|---|---|---|
| WO | WO 2015/029031 | 3/2015 |
| WO | WO 2015/181823 | 12/2015 |
| WO | WO 2016/030885 | 3/2016 |
| WO | WO 2017/115353 | 7/2017 |

OTHER PUBLICATIONS

Courtesy Letter dated Jan. 19, 2017 From the Canadian Intellectual Property Office Re. Application No. 2,948,591.
International Search Report and the Written Opinion dated Aug. 12, 2015 From the International Searching Authority Re. Application No. PCT/IL2015/050550.
Invitation to Pay Additional Fees dated Jun. 30, 2015 From the International Searching Authority Re. Application No. PCT/IL2015/050550.
Official Action dated May 15, 2018 From the US Patent and Trademark Office Re. U.S. Appl. No. 15/311,205. (30 Pages).
Restriction Official Action dated Jan. 25, 2018 From the US Patent and Trademark Office Re. U.S. Appl. No. 15/311,205. (14 Pages).
Guo et al. "Protein Tolerance to Random Amino Acid Change", Proceedings of the National Academy of Sciences, 101(25): 9205-9210, Jun. 22, 2004.
Keskin et al. "A New, Structurally Nonredundant, Diverse Data Set of Protein-Protein Interfaces and Its Implications", Protein Science, 13: 1043-1055, 2004.
Thornton et al. "From Structure to Function: Approaches and Limitations", Nature Structural Biology—Structural Genomic Supplement, 7(Suppl.): 991-994, Nov. 2000.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Zhang et al. "Genome Sequence of Foxtail Millet (*Setaria italica*) Provides Insights into Grass Evolution and Biofuel Potential", Nature Biotechnology, 30(6): 549-554, Jun. 2012.
Examination Report dated Jul. 9, 2019 From the Instituto Mexicano de la Propiedad Industrial, IMPI, Direccion Divisional de Patentes Re. Application No. MX/a/2016/015571 with an English Translation. (8 Pages).
Search Report dated Dec. 5, 2019 from the Brazilian Patent Office Re. Application No. BR 11 2016 027911 5 with an English Summary. (6 pages).
Examination Report dated Mar. 3, 2020 From the Instituto Mexicano de la Propiedad Industrial, IMPI Re. Application No. MX/a/2016/015571 and Its English Translation. (12 Pages).
Requisition by the Examiner dated Aug. 17, 2020 From the Canadian Intellectual Property Office Re. Application No. 2,948,591 (3 Pages).
Clarifications Prior to Substantive Examination dated Jun. 10, 2020 from Argentinean Industrial Property National Institute Re. Application No. P20150101662 and Its English Summary. (7 pages).
Examination Report dated Aug. 27, 2020 From the Mexican Institute of Industrial Property Re. Application No. MX/a/2016/015571 and Its English Translation. (12 Pages).

* cited by examiner

Normal conditions

Osmotic stress (15 % PEG)

Nitrogen limiting conditions pQNa_RP pQXNc

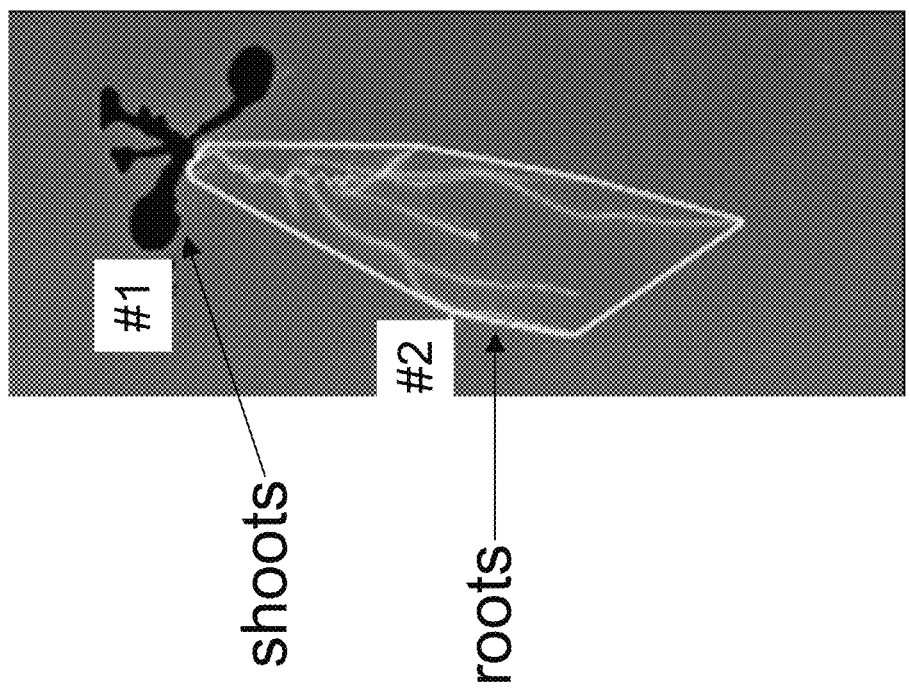

ISOLATED POLYNUCLEOTIDES, POLYPEPTIDES AND METHODS OF USING SAME FOR INCREASING ABIOTIC STRESS TOLERANCE, BIOMASS AND YIELD OF PLANTS

RELATED APPLICATIONS

This application is a continuation of U.S. patent application Ser. No. 15/311,205 filed on Nov. 15, 2016, which is a National Phase of PCT Patent Application No. PCT/IL2015/050550 having International Filing Date of May 27, 2015 which claims benefit of under 35 USC § 119(e) of U.S. Provisional Patent Application Nos. 62/075,940 filed on Nov. 6, 2014 and 62/003,599 filed on May 28, 2014.

The contents of the above applications are all incorporated by reference as if fully set forth herein in their entirety.

SEQUENCE LISTING STATEMENT

The ASCII file, entitled 75107SequenceListing.txt, created on Aug. 14, 2018, comprising 28,554,070 bytes, submitted concurrently with the filing of this application is incorporated herein by reference.

FIELD AND BACKGROUND OF THE INVENTION

The present invention, in some embodiments thereof, relates to isolated polypeptides and polynucleotides, nucleic acid constructs comprising same, transgenic cells comprising same, transgenic plants exogenously expressing same and more particularly, but not exclusively, to methods of using same for increasing yield (e.g., seed yield, oil yield), biomass, growth rate, vigor, oil content, fiber yield, fiber quality, fiber length, fiber length, photosynthetic capacity, fertilizer use efficiency (e.g., nitrogen use efficiency) and/or abiotic stress tolerance of a plant.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing consumption of plant oils as bio-fuel is the oil price, which is still higher than fossil fuel. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants. Genes known to be involved in increasing plant oil yields include those participating in fatty acid synthesis or sequestering such as desaturase [e.g., DELTA6, DELTA12 or acyl-ACP (Ssi2; *Arabidopsis* Information Resource (TAIR; arabidopsis (dot) org/), TAIR No. AT2G43710)], OleosinA (TAIR No. AT3G01570) or FAD3 (TAR No. AT2G29980), and various transcription factors and activators such as Led 1 [TAIR No. AT1G21970, Lotan et al. 1998. *Cell*. 26; 93(7):1195-205], Lec2 [TAIR No. AT1G28300, Santos Mendoza et al. 2005, FEBS Lett. 579 (20:4666-70], Fus3 (TAIR No. AT3G26790), ABI3 [TAIR No. AT3G24650, Lara et al. 2003. J Biol Chem. 278(23): 21003-11] and Wri1 [TAIR No. AT3G54320, Cernac and Benning, 2004. Plant J. 40(4): 575-85].

Genetic engineering efforts aiming at increasing oil content in plants (e.g., in seeds) include upregulating endoplasmic reticulum (FAD3) and plastidal (FAD7) fatty acid desaturases in potato (Zabrouskov V., et al., 2002; Physiol Plant. 116:172-185); over-expressing the GmDof4 and GmDof11 transcription factors (Wang H W et al., 2007; Plant J. 52:716-29); over-expressing a yeast glycerol-3-phosphate dehydrogenase under the control of a seed-specific promoter (Vigeolas H, et al. 2007, Plant Biotechnol J. 5:431-41; U.S. Pat. Appl. No. 20060168684); using *Arabidopsis* FAE1 and yeast SLC1-1 genes for improvements in erucic acid and oil content in rapeseed (Katavic V, et al., 2000, Biochem Soc Trans. 28:935-7).

Various patent applications disclose genes and proteins which can increase oil content in plants. These include for example, U.S. Pat. Appl. No. 20080076179 (lipid metabolism protein); U.S. Pat. Appl. No. 20060206961 (the Ypr140w polypeptide); U.S. Pat. Appl. No. 20060174373 [triacylglycerols synthesis enhancing protein (TEP)]; U.S. Pat. Appl. Nos. 20070169219, 20070006345, 20070006346 and 20060195943 (disclose transgenic plants with improved nitrogen use efficiency which can be used for the conversion into fuel or chemical feedstocks); WO2008/122980 (polynucleotides for increasing oil content, growth rate, biomass, yield and/or vigor of a plant).

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. For example, inorganic nitrogenous fertilizers such as ammonium nitrate, potassium nitrate, or urea, typically accounts for 40% of the costs associated with crops such as corn and wheat. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen is responsible for biosynthesis of amino and nucleic acids, prosthetic groups, plant hormones, plant chemical defenses, etc. and usually needs to be replenished every year, particularly for cereals, which comprise more than half of the cultivated areas worldwide. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. Publication No. 20020046419 (U.S. Pat. No. 7,262,055 to Choo, et al.); U.S. Pat. Appl. No. 20050108791 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

Abiotic stress (ABS; also referred to as "environmental stress") conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress and thus necessitate optimal growth conditions for commercial crop yields. Continuous exposure to stress causes major alterations in the plant metabolism which ultimately leads to cell death and consequently yield losses.

Drought is a gradual phenomenon, which involves periods of abnormally dry weather that persists long enough to produce serious hydrologic imbalances such as crop damage, water supply shortage and increased susceptibility to various diseases. In severe cases, drought can last many years and results in devastating effects on agriculture and water supplies. Furthermore, drought is associated with increase susceptibility to various diseases.

For most crop plants, the land regions of the world are too arid. In addition, overuse of available water results in increased loss of agriculturally-usable land (desertification), and increase of salt accumulation in soils adds to the loss of available water in soils.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Soil salinity is thus one of the more important variables that determine whether a plant may thrive. In many parts of the world, sizable land areas are uncultivable due to naturally high soil salinity. Thus, salination of soils that are used for agricultural production is a significant and increasing problem in regions that rely heavily on agriculture, and is worsen by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. On the other hand, germination normally takes place at a salt concentration which is higher than the mean salt level in the whole soil profile.

Salt and drought stress signal transduction consist of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The osmotic component of salt stress involves complex plant reactions that overlap with drought and/or cold stress responses.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Common aspects of drought, cold and salt stress response [Reviewed in Xiong and Zhu (2002) Plant Cell Environ. 25: 131-139] include: (a) transient changes in the cytoplasmic calcium levels early in the signaling event; (b) signal transduction via mitogen-activated and/or calcium dependent protein kinases (CDPKs) and protein phosphatases; (c) increases in abscisic acid levels in response to stress triggering a subset of responses; (d) inositol phosphates as signal molecules (at least for a subset of the stress responsive transcriptional changes; (e) activation of phospholipases which in turn generates a diverse array of second messenger molecules, some of which might regulate the activity of stress responsive kinases; (f) induction of late embryogenesis abundant (LEA) type genes including the CRT/DRE responsive COR/RD genes; (g) increased levels of antioxidants and compatible osmolytes such as proline and soluble sugars; and (h) accumulation of reactive oxygen species such as superoxide, hydrogen peroxide, and hydroxyl radicals. Abscisic acid biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Several genes which increase tolerance to cold or salt stress can also improve drought stress protection, these include for example, the transcription factor AtCBF/DREB1, OsCDPK7 (Saijo et al. 2000, Plant J. 23: 319-327) or AVP1 (a vacuolar pyrophosphatase-proton pump, Gaxiola et al. 2001, Proc. Natl. Acad. Sci. USA 98: 11444-11449).

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

Genetic engineering efforts, aimed at conferring abiotic stress tolerance to transgenic crops, have been described in various publications [Apse and Blumwald (Curr Opin Biotechnol. 13:146-150, 2002), Quesada et al. (Plant Physiol. 130:951-963, 2002), Holmström et al. (Nature 379: 683-684, 1996), Xu et al. (Plant Physiol 110: 249-257, 1996), Pilon-Smits and Ebskamp (Plant Physiol 107: 125-130, 1995) and Tarczynski et al. (Science 259: 508-510, 1993)].

Various patents and patent applications disclose genes and proteins which can be used for increasing tolerance of plants to abiotic stresses. These include for example, U.S. Pat. Nos. 5,296,462 and 5,356,816 (for increasing tolerance to cold stress); U.S. Pat. No. 6,670,528 (for increasing ABST); U.S. Pat. No. 6,720,477 (for increasing ABST); U.S. application Ser. Nos. 09/938,842 and 10/342,224 (for increasing ABST); U.S. application Ser. No. 10/231,035 (for increasing ABST); WO2004/104162 (for increasing ABST and biomass); WO2007/020638 (for increasing ABST, biomass, vigor and/or yield); WO2007/049275 (for increasing ABST, biomass, vigor and/or yield); WO2010/076756 (for increasing ABST, biomass and/or yield). WO2009/083958 (for increasing water use efficiency, fertilizer use efficiency, biotic/abiotic stress tolerance, yield and/or biomass); WO2010/020941 (for increasing nitrogen use efficiency, abiotic stress tolerance, yield and/or biomass); WO2009/141824 (for increasing plant utility); WO2010/049897 (for increasing plant yield).

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Cotton and cotton by-products provide raw materials that are used to produce a wealth of consumer-based products in addition to textiles including cotton foodstuffs, livestock feed, fertilizer and paper. The production, marketing, consumption and trade of cotton-based products generate an excess of $100 billion annually in the U.S. alone, making cotton the number one value-added crop.

Even though 90% of cotton's value as a crop resides in the fiber (lint), yield and fiber quality has declined due to general erosion in genetic diversity of cotton varieties, and an increased vulnerability of the crop to environmental conditions.

There are many varieties of cotton plant, from which cotton fibers with a range of characteristics can be obtained and used for various applications. Cotton fibers may be characterized according to a variety of properties, some of which are considered highly desirable within the textile industry for the production of increasingly high quality products and optimal exploitation of modem spinning technologies. Commercially desirable properties include length, length uniformity, fineness, maturity ratio, decreased fuzz fiber production, micronaire, bundle strength, and single fiber strength. Much effort has been put into the improvement of the characteristics of cotton fibers mainly focusing on fiber length and fiber fineness. In particular, there is a great demand for cotton fibers of specific lengths.

A cotton fiber is composed of a single cell that has differentiated from an epidermal cell of the seed coat, developing through four stages, i.e., initiation, elongation, secondary cell wall thickening and maturation stages. More specifically, the elongation of a cotton fiber commences in the epidermal cell of the ovule immediately following flowering, after which the cotton fiber rapidly elongates for approximately 21 days. Fiber elongation is then terminated, and a secondary cell wall is formed and grown through maturation to become a mature cotton fiber.

Several candidate genes which are associated with the elongation, formation, quality and yield of cotton fibers were disclosed in various patent applications such as U.S. Pat. No. 5,880,100 and U.S. patent application Ser. Nos. 08/580,545, 08/867,484 and 09/262,653 (describing genes involved in cotton fiber elongation stage); WO0245485 (improving fiber quality by modulating sucrose synthase); U.S. Pat. No. 6,472,588 and WO0117333 (increasing fiber quality by transformation with a DNA encoding sucrose phosphate synthase); WO9508914 (using a fiber-specific promoter and a coding sequence encoding cotton peroxidase); WO9626639 (using an ovary specific promoter sequence to express plant growth modifying hormones in cotton ovule tissue, for altering fiber quality characteristics such as fiber dimension and strength); U.S. Pat. Nos. 5,981,834, 5,597,718, 5,620,882, 5,521,708 and 5,495,070 (coding sequences to alter the fiber characteristics of transgenic fiber producing plants); U.S. patent applications U.S. 2002049999 and U.S. 2003074697 (expressing a gene coding for endoxyloglucan transferase, catalase or peroxidase for improving cotton fiber characteristics); WO 01/40250 (improving cotton fiber quality by modulating transcription factor gene expression); WO 96/40924 (a cotton fiber transcriptional initiation regulatory region associated which is expressed in cotton fiber); EP0834566 (a gene which controls the fiber formation mechanism in cotton plant); WO2005/121364 (improving cotton fiber quality by modulating gene expression); WO2008/075364 (improving fiber quality, yield/biomass/vigor and/or abiotic stress tolerance of plants).

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

WO2011/135527 publication discloses isolated polynucleotides and polypeptides for increasing plant yield and/or agricultural characteristics.

WO2012/028993 publication discloses isolated polynucleotides and polypeptides, and methods of using same for increasing nitrogen use efficiency, yield, growth rate, vigor, biomass, oil content, and/or abiotic stress tolerance.

WO2012/085862 publication discloses isolated polynucleotides and polypeptides, and methods of using same for improving plant properties.

WO2012/150598 publication discloses isolated polynucleotides and polypeptides and methods of using same for increasing plant yield, biomass, growth rate, vigor, oil content, abiotic stress tolerance of plants and nitrogen use efficiency.

WO2013/027223 publication discloses isolated polynucleotides and polypeptides, and methods of using same for increasing plant yield and/or agricultural characteristics.

WO2013/080203 publication discloses isolated polynucleotides and polypeptides, and methods of using same for increasing nitrogen use efficiency, yield, growth rate, vigor, biomass, oil content, and/or abiotic stress tolerance.

WO2013/098819 publication discloses isolated polynucleotides and polypeptides, and methods of using same for increasing yield of plants.

WO2013/128448 publication discloses isolated polynucleotides and polypeptides and methods of using same for increasing plant yield, biomass, growth rate, vigor, oil content, abiotic stress tolerance of plants and nitrogen use efficiency.

WO 2013/179211 publication discloses isolated polynucleotides and polypeptides and methods of using same for increasing plant yield and/or agricultural characteristics.

WO2014/033714 publication discloses isolated polynucleotides, polypeptides and methods of using same for increasing abiotic stress tolerance, biomass and yield of plants.

WO2014/102773 publication discloses isolated polynucleotides and polypeptides, and methods of using same for increasing nitrogen use efficiency of plants.

WO2014/102774 publication discloses isolated polynucleotides and polypeptides, construct and plants comprising same and methods of using same for increasing nitrogen use efficiency of plants.

WO2014/188428 publication discloses isolated polynucleotides and polypeptides, and methods of using same for increasing plant yield and/or agricultural characteristics.

WO2015/029031 publication discloses isolated polynucleotides and polypeptides, and methods of using same for increasing plant yield and/or agricultural characteristics.

SUMMARY OF THE INVENTION

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence encoding a polypeptide at least 80% identical to SEQ ID NO: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 or 10629, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence encoding a polypeptide selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of producing a crop comprising growing a crop plant transformed with an exogenous polynucleotide comprising a nucleic acid sequence encoding a polypeptide at least 80% homologous to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 or 10629, wherein the crop plant is derived from plants which have been transformed with the exogenous polynucleotide and which have been selected for increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance, thereby producing the crop.

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence at least 80% identical to SEQ ID NO: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising the nucleic acid sequence selected from the group consisting of SEQ ID NOs: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of producing a crop comprising growing a crop plant transformed with an exogenous polynucleotide which comprises a nucleic acid sequence which is at least 80% identical to the nucleic acid sequence selected from the group consisting of SEQ ID NOs: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028, wherein the crop plant is derived from plants which have been transformed with the exogenous polynucleotide and which have been selected for increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance, thereby producing the crop.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 or 10629, wherein the amino acid sequence is capable of increasing yield, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629.

According to an aspect of some embodiments of the present invention there is provided an isolated polynucleotide comprising a nucleic acid sequence at least 80% identical to SEQ ID NOs: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 or 6028, wherein the nucleic acid sequence is capable of increasing yield, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polynucleotide comprising the nucleic acid sequence selected from the group consisting of SEQ ID NOs: 1-551, 898-6027 and 6028.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 or 10629, wherein the amino acid sequence is capable of increasing yield, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polypeptide comprising the amino acid sequence selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to an aspect of some embodiments of the present invention there is provided a transgenic plant comprising the nucleic acid construct of some embodiments of the invention, or the plant cell of some embodiments of the invention.

According to an aspect of some embodiments of the present invention there is provided a method of growing a crop, the method comprising seeding seeds and/or planting plantlets of a plant transformed with the isolated polynucleotide of some embodiments of the invention, or with the nucleic acid construct of some embodiments of the invention, wherein the plant is derived from plants which have been transformed with the exogenous polynucleotide and which have been selected for at least one trait selected from the group consisting of: increased nitrogen use efficiency, increased abiotic stress tolerance, increased biomass, increased growth rate, increased vigor, increased yield, increased fiber yield, increased fiber quality, increased fiber length, increased photosynthetic capacity, and increased oil content as compared to a non-transformed plant, thereby growing the crop.

According to an aspect of some embodiments of the present invention there is provided a method of selecting a transformed plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least 80% homologous to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 or 10629, (b) selecting from the plants of step (a) a plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, thereby selecting the plant having the increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to an aspect of some embodiments of the present invention there is provided a method of selecting a transformed plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide at least 80% identical to the nucleic acid sequence selected from the group consisting of SEQ ID NOs: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028, (b) selecting from the plants of step (a) a plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, thereby selecting the plant having the increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to some embodiments of the invention, the nucleic acid sequence encodes an amino acid sequence selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629.

According to some embodiments of the invention, the nucleic acid sequence is selected from the group consisting of SEQ ID NOs: 1-551, 898-6027 and 6028.

According to some embodiments of the invention, the polynucleotide consists of the nucleic acid sequence selected from the group consisting of SEQ ID NOs: 1-551, 898-6027 and 6028.

According to some embodiments of the invention, the nucleic acid sequence encodes the amino acid sequence selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, osmotic stress, water deprivation, flood, etiolation, low temperature, high temperature, heavy metal toxicity, anaerobiosis, nutrient deficiency, nitrogen deficiency, nutrient excess, atmospheric pollution and UV irradiation.

According to some embodiments of the invention, the yield comprises seed yield or oil yield.

According to some embodiments of the invention, the method further comprising growing the plant expressing the exogenous polynucleotide under nitrogen-limiting conditions.

According to some embodiments of the invention, the promoter is heterologous to the isolated polynucleotide and/or to the host cell.

According to some embodiments of the invention, the non-transformed plant is a wild type plant of identical genetic background.

According to some embodiments of the invention, the non-transformed plant is a wild type plant of the same species.

According to some embodiments of the invention, the non-transformed plant is grown under identical growth conditions.

According to some embodiments of the invention, the method further comprising selecting a plant having an increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to some embodiments of the invention, selecting is performed under non-stress conditions.

According to some embodiments of the invention, selecting is performed under abiotic stress conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-3D) or nitrogen-limiting (FIGS. 3E-3F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

FIG. 10 depicts seedling analysis of an *Arabidopsis* plant having shoots (upper part, marked "#1") and roots (lower part, marked "#2"). Using an image analysis system the minimal convex area encompassed by the roots is determined. Such area corresponds to the root coverage of the plant.

DESCRIPTION OF SPECIFIC EMBODIMENTS OF THE INVENTION

Figure 1:
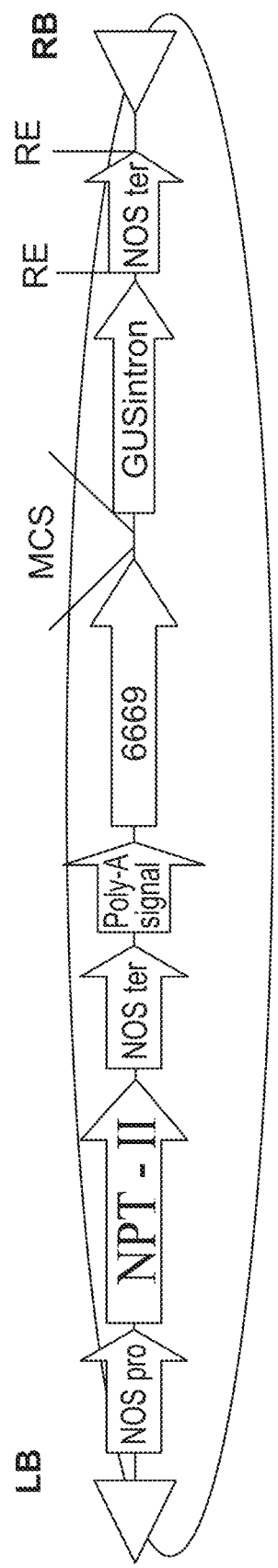
FIG. 1 is a schematic illustration of the modified pGI binary plasmid containing the new At6669 promoter (SEQ ID NO: 10654) and the GUSintron (pQYN 6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUS-intron reporter gene.
Figure 2:
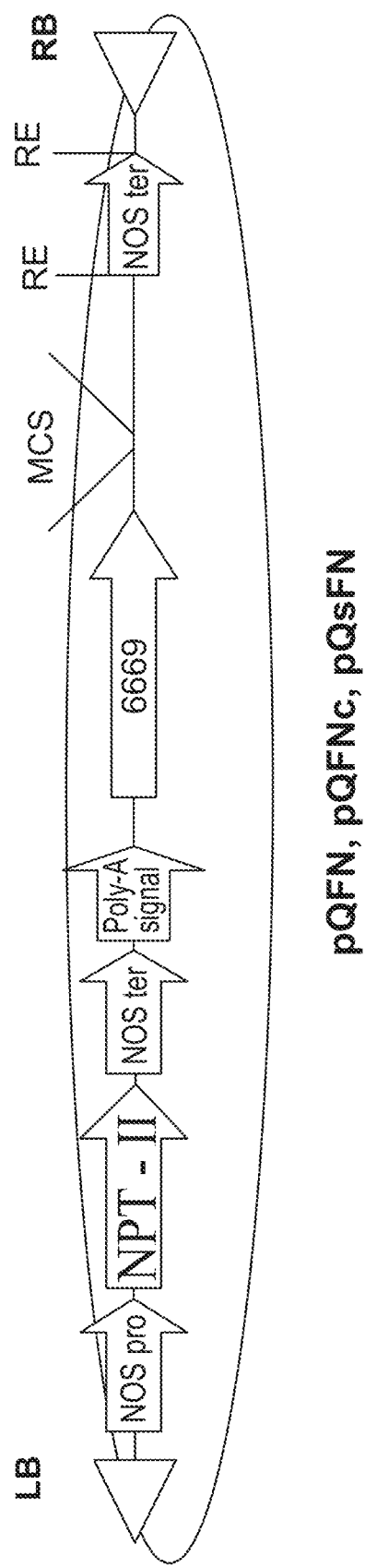
FIG. 2 is a schematic illustration of the modified pGI binary plasmid containing the new At6669 promoter (SEQ ID NO: 10654) (pQFN or pQFNc or pQsFN) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); The isolated polynucleotide sequences of the invention were cloned into the MCS of the vector.
Figure 3A:
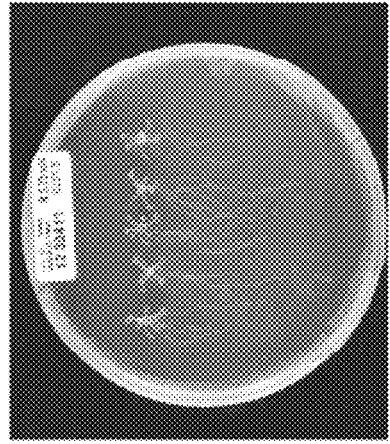
FIGS. 3A-3F are images depicting visualization of root development of transgenic plants exogenously expressing the polynucleotide of some embodiments of the invention when grown in transparent agar plates under normal (FIGS. 3A-3B), osmotic stress (15% PEG.
Figure 3C:
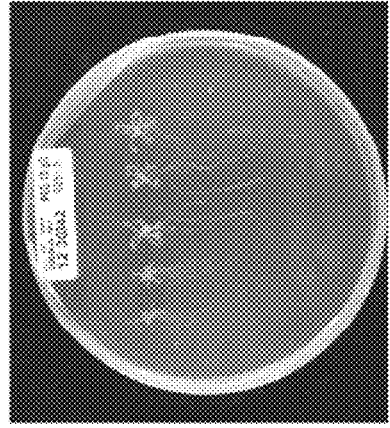
Figure 3E:
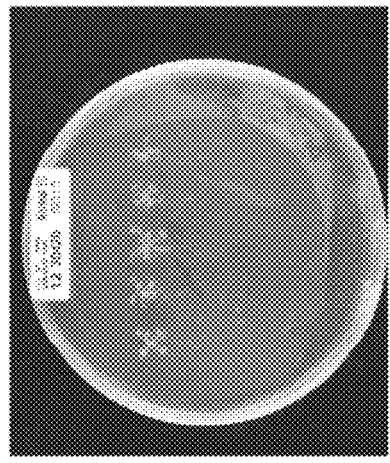
Figure 3B:
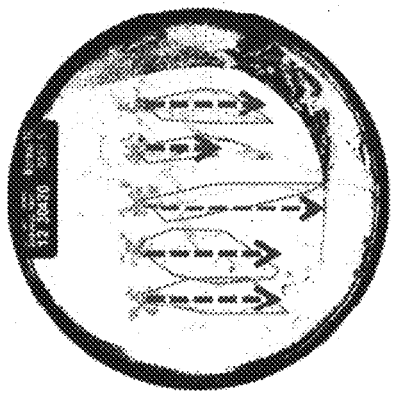
Figure 3D:
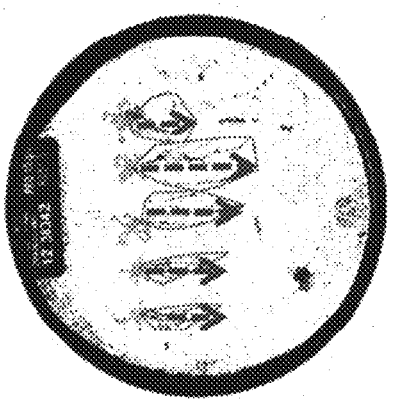
Figure 3F:
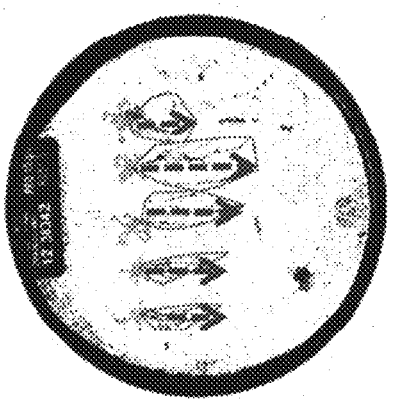
Figure 4:
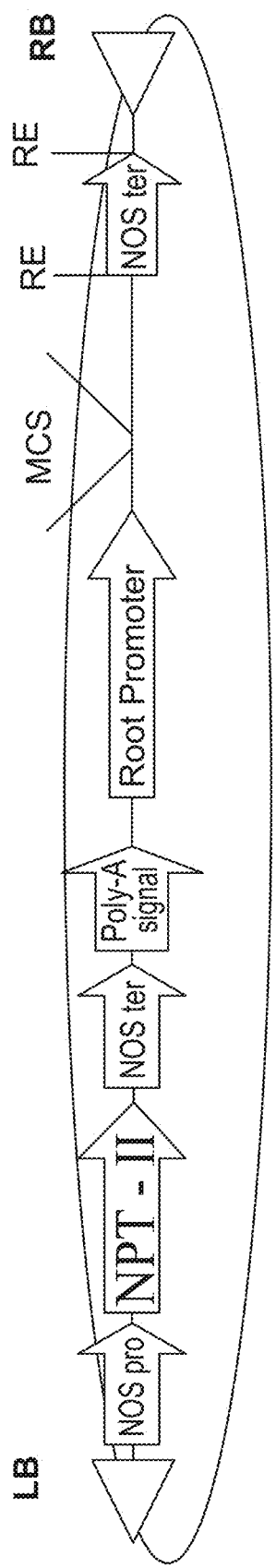
FIG. 4 is a schematic illustration of the modified pGI binary plasmid containing the Root Promoter (pQNa RP) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); The isolated polynucleotide sequences according to some embodiments of the invention were cloned into the MCS (Multiple cloning site) of the vector.
Figure 5:
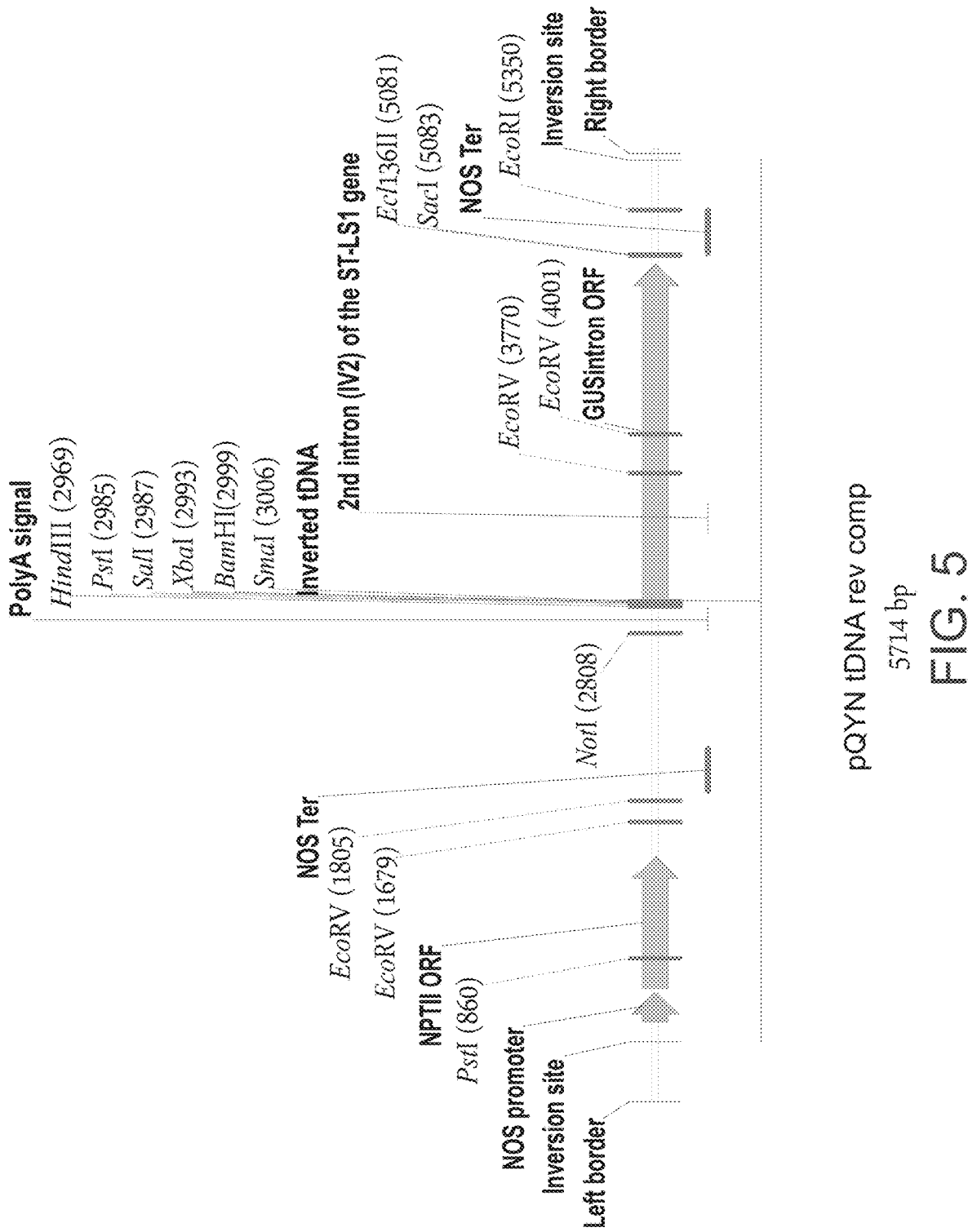
FIG. 5 is a schematic illustration of the pQYN plasmid.
Figure 6:
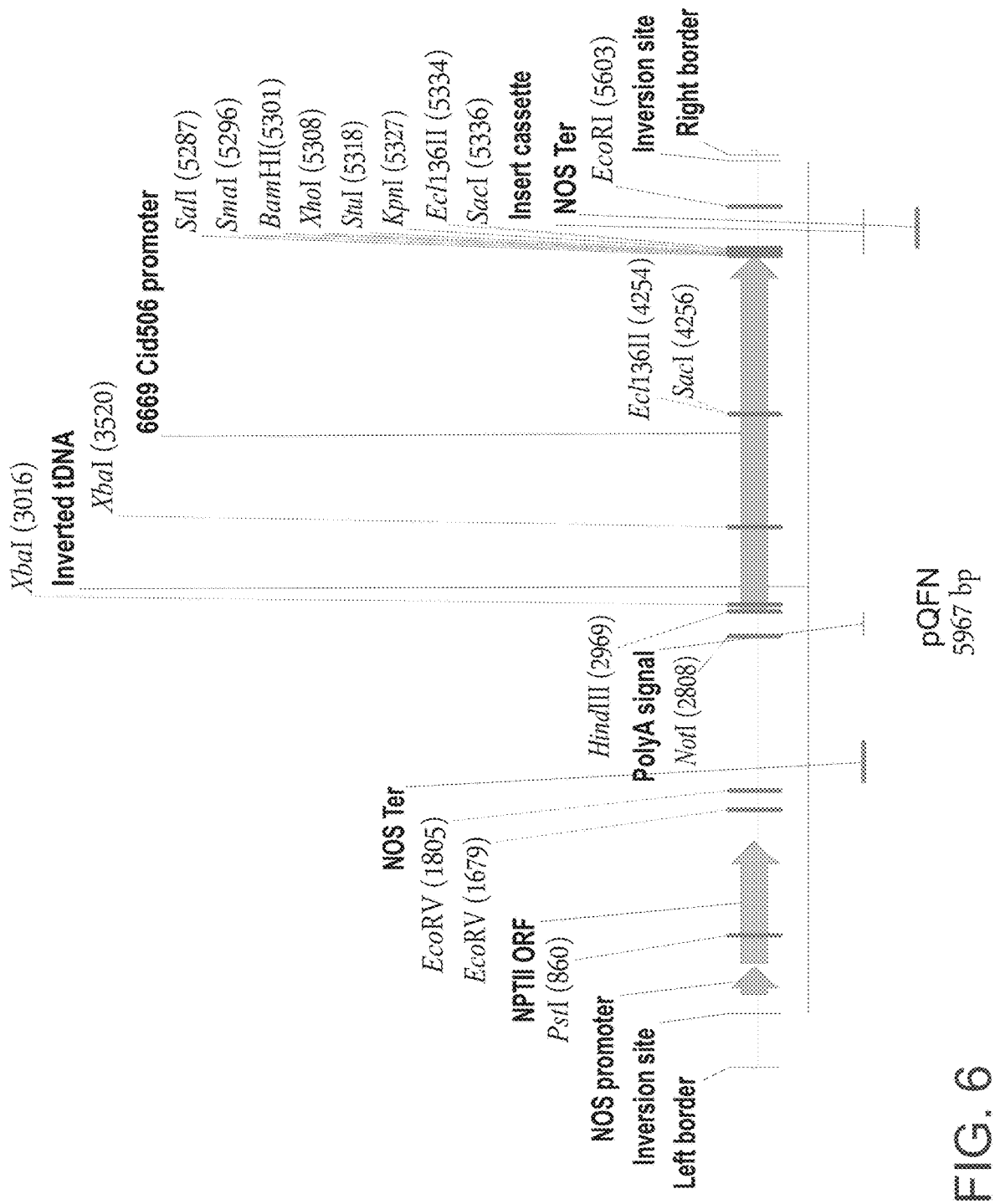
FIG. 6 is a schematic illustration of the pQFN plasmid.
Figure 7:
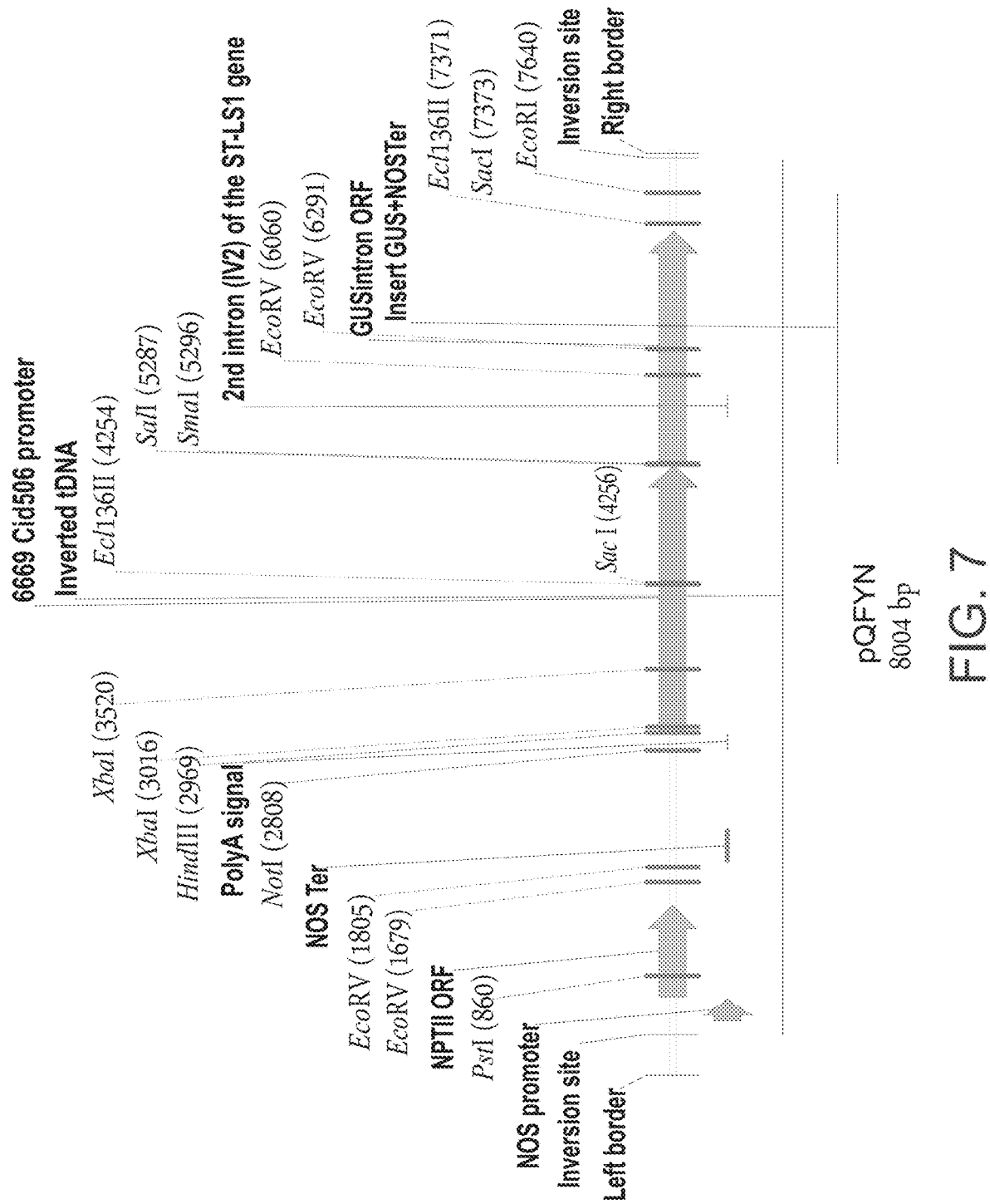
FIG. 7 is a schematic illustration of the pQFYN plasmid.
Figure 8:
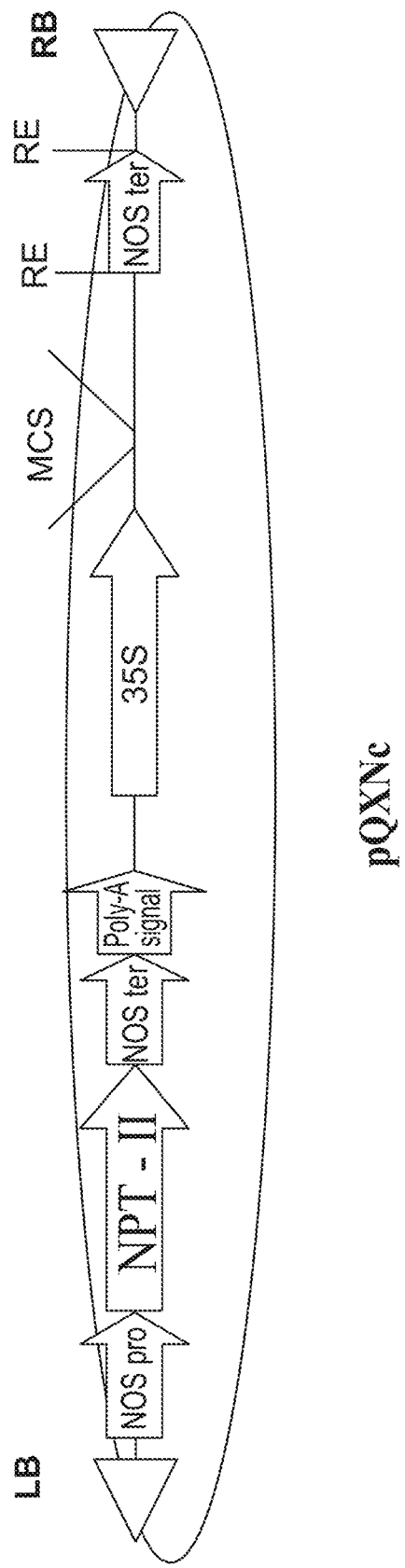
FIG. 8 is a schematic illustration of the modified pGI binary plasmid (pQXNc) used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S-the 35S promoter (pQXNc); SEQ ID NO: 10650). The isolated polynucleotide sequences of some embodiments of the invention were cloned into the MCS (Multiple cloning site) of the vector.

The present invention, in some embodiments thereof, relates to isolated polynucleotides and polypeptides, nucleic acid constructs, transgenic cells and transgenic plants comprising same and methods of generating and using same, and, more particularly, but not exclusively, to methods of increasing yield, biomass, growth rate, vigor, oil content, fiber yield, fiber quality abiotic stress tolerance, and/or fertilizer use efficiency (e.g., nitrogen use efficiency) of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to generate nucleic acid constructs, transgenic plants and to increase nitrogen use efficiency, fertilizer use efficiency, yield, growth rate, vigor, biomass, oil content, fiber yield, fiber quality, fiber length, photosynthetic capacity, abiotic stress tolerance and/or water use efficiency of a plant, such as a wheat plant.

Thus, as shown in the Examples section which follows, the present inventors have utilized bioinformatics tools to identify polynucleotides which enhance/increase fertilizer use efficiency (e.g., nitrogen use efficiency), yield (e.g., seed yield, oil yield, oil content), growth rate, biomass, vigor, fiber yield, fiber quality, fiber length, photosynthetic capacity, and/or abiotic stress tolerance of a plant. Genes which affect the trait-of-interest were identified [SEQ ID NOs: 552-897 (for polypeptides); and SEQ ID NOs: 1-551 (for polynucleotides)] based on expression profiles of genes of several *Arabidopsis*, Barley, Sorghum, Maize, *Brachypo-*

*dium*, soybean, cotton, Bean, wheat, tomato, and Foxtail millet ecotypes and accessions in various tissues and growth conditions, homology with genes known to affect the trait-of-interest and using digital expression profile in specific tissues and conditions (Tables 1-232, Examples 1, and 3-24 of the Examples section which follows). Homologous (e.g., orthologous) polypeptides and polynucleotides having the same function in increasing fertilizer use efficiency (e.g., nitrogen use efficiency), yield (e.g., seed yield, oil yield, oil content), growth rate, biomass, vigor, fiber yield, fiber quality, fiber length, photosynthetic capacity, and/or abiotic stress tolerance of a plant were also identified [SEQ ID NOs: 6029-10629 (for polypeptides), and SEQ ID NOs: 898-6028 (for polynucleotides); Table 2, Example 2 of the Examples section which follows]. The polynucleotides of some embodiments of the invention were cloned into binary vectors (Examples 25-26, Table 233), and were further transformed into *Arabidopsis* and *Brachypodium* plants (Examples 27-28). Transgenic plants over-expressing the identified polynucleotides were found to exhibit increased biomass, growth rate, vigor and yield under normal growth conditions, nitrogen limiting growth conditions or abiotic stress conditions (Tables 234-275; Examples 29-33) as compared to control plants grown under the same growth conditions. Altogether, these results suggest the use of the novel polynucleotides and polypeptides of the invention (e.g., SEQ ID NOs: 552-897 and 6029-10629; and SEQ ID NOs: 1-551 and 898-6028) for increasing nitrogen use efficiency, fertilizer use efficiency, yield (e.g., oil yield, seed yield and oil content), growth rate, biomass, vigor, fiber yield, fiber quality, fiber length, photosynthetic capacity, water use efficiency and/or abiotic stress tolerance of a plant.

Thus, according to an aspect of some embodiments of the invention, there is provided method of increasing oil content, yield, growth rate, biomass, vigor, fiber yield, fiber quality, fiber length, photosynthetic capacity, fertilizer use efficiency (e.g., nitrogen use efficiency) and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 552-897 and 6029-10629, e.g., using an exogenous polynucleotide which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the polynucleotide selected from the group consisting of SEQ ID NOs: 1-551 and 898-6028, thereby increasing the oil content, yield, growth rate, biomass, vigor, fiber yield, fiber quality, fiber length, photosynthetic capacity, fertilizer use efficiency (e.g., nitrogen use efficiency) and/or abiotic stress tolerance of the plant.

According to an aspect of some embodiments of the invention, there is provided method of increasing oil content, yield, growth rate, biomass, vigor, fiber yield, fiber quality, fiber length, photosynthetic capacity, fertilizer use efficiency (e.g., nitrogen use efficiency) and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629, thereby increasing the oil content, yield, growth rate, biomass, vigor, fiber yield, fiber quality, fiber length, photosynthetic capacity, fertilizer use efficiency (e.g., nitrogen use efficiency) and/or abiotic stress tolerance of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the term "root biomass" refers to the total weight of the plant's root(s). Root biomass can be determined directly by weighing the total root material (fresh and/or dry weight) of a plant.

Additional or alternatively, the root biomass can be indirectly determined by measuring root coverage, root density and/or root length of a plant.

It should be noted that plants having a larger root coverage exhibit higher fertilizer (e.g., nitrogen) use efficiency and/or higher water use efficiency as compared to plants with a smaller root coverage.

As used herein the phrase "root coverage" refers to the total area or volume of soil or of any plant-growing medium encompassed by the roots of a plant.

According to some embodiments of the invention, the root coverage is the minimal convex volume encompassed by the roots of the plant.

It should be noted that since each plant has a characteristic root system, e.g., some plants exhibit a shallow root system (e.g., only a few centimeters below ground level), while others have a deep in soil root system (e.g., a few tens of centimeters or a few meters deep in soil below ground level), measuring the root coverage of a plant can be performed in any depth of the soil or of the plant-growing medium, and comparison of root coverage between plants of the same species (e.g., a transgenic plant exogenously expressing the polynucleotide of some embodiments of the invention and a control plant) should be performed by measuring the root coverage in the same depth.

According to some embodiments of the invention, the root coverage is the minimal convex area encompassed by the roots of a plant in a specific depth.

A non-limiting example of measuring root coverage is shown in FIG. 10.

As used herein the term "root density" refers to the density of roots in a given area (e.g., area of soil or any plant growing medium). The root density can be determined by counting the root number per a predetermined area at a predetermined depth (in units of root number per area, e.g., $mm^2$, $cm^2$ or $m^2$).

As used herein the phrase "root length" refers to the total length of the longest root of a single plant.

As used herein the phrase "root length growth rate" refers to the change in total root length per plant per time unit (e.g., per day).

As used herein the phrase "growth rate" refers to the increase in plant organ/tissue size per time (can be measured in $cm^2$ per day or cm/day).

As used herein the phrase "photosynthetic capacity" (also known as "$A_{max}$") is a measure of the maximum rate at which leaves are able to fix carbon during photosynthesis. It is typically measured as the amount of carbon dioxide that is fixed per square meter per second, for example as μmol $m^{-2}$ $sec^{-1}$. Plants are able to increase their photosynthetic capacity by several modes of action, such as by increasing the total leaves area (e.g., by increase of leaves area, increase in the number of leaves, and increase in plant's vigor, e.g., the ability of the plant to grow new leaves along time course) as well as by increasing the ability of the plant to efficiently execute carbon fixation in the leaves. Hence, the increase in total leaves area can be used as a reliable measurement parameter for photosynthetic capacity increment.

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

It should be noted that a plant trait such as yield, growth rate, biomass, vigor, oil content, fiber yield, fiber quality, fiber length, photosynthetic capacity, fertilizer use efficiency (e.g., nitrogen use efficiency) can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

Following is a non-limiting description of non-stress (normal) growth conditions which can be used for growing the transgenic plants expressing the polynucleotides or polypeptides of some embodiments of the invention.

For example, normal conditions for growing sorghum include irrigation with about 452,000 liter water per dunam (1000 square meters) and fertilization with about 14 units nitrogen per dunam per growing season.

Normal conditions for growing cotton include irrigation with about 580,000 liter water per dunam (1000 square meters) and fertilization with about 24 units nitrogen per dunam per growing season.

Normal conditions for growing bean include irrigation with about 524,000 liter water per dunam (1000 square meters) and fertilization with about 16 units nitrogen per dunam per growing season.

Normal conditions for growing B. Juncea include irrigation with about 861,000 liter water per dunam (1000 square meters) and fertilization with about 12 units nitrogen per dunam per growing season.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, osmotic stress, water deprivation, drought, flooding, freezing, low or high temperature, heavy metal toxicity, anaerobiosis, nutrient deficiency (e.g., nitrogen deficiency or limited nitrogen), atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield. It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, *Ceiba pentandra*), desert willow, creosote bush, winterfat, balsa, kenaf, roselle, jute, sisal abaca, flax, corn, sugar cane, hemp, ramie, kapok, coir, bamboo, spanish moss and Agave spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As mentioned hereinabove, transgenic plants of the present invention can be used for improving myriad of commercially desired traits which are all interrelated as is discussed hereinbelow.

As used herein the term "trait" refers to a characteristic or quality of a plant which may overall (either directly or indirectly) improve the commercial value of the plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in the trait [e.g., yield, seed yield, oil yield, biomass, growth rate, vigor, oil content, fiber yield, fiber quality, fiber length, photosynthetic capacity, abiotic stress tolerance, and/or nitrogen use efficiency)] of a plant as compared to a native plant or a wild type plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant (e.g., a nucleic acid sequence from a different species) or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629.

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologs are evolutionary counterparts derived from a single ancestral gene in the last common ancestor of given two species (Koonin EV and Galperin MY (Sequence—Evolution—Function: Computational Approaches in Comparative Genomics. Boston: Kluwer Academic; 2003. Chapter 2, Evolutionary Concept in Genetics and Genomics. Available from: ncbi (dot) nlm (dot) nih (dot) gov/books/NBK20255) and therefore have great likelihood of having the same function.

One option to identify orthologues in monocot plant species is by performing a reciprocal Basic Local Alignment Search Tool BLAST® (The National Library of Medicine) search. This may be done by a first BLAST® involving BLAST®ing the sequence-of-interest against any sequence database, such as the publicly available NCBI database which may be found at: ncbi (dot) nlm (dot) nih (dot) gov. If orthologues in rice were sought, the sequence-of-interest would be BLAST®ed against, for example, the 28,469 full-length cDNA clones from *Oryza sativa* Nipponbare available at NCBI. The BLAST® results may be filtered. The full-length sequences of either the filtered results or the non-filtered results are then BLAST®ed back (second BLAST®) against the sequences of the organism from which the sequence-of-interest is derived. The results of the first and second BLAST®s are then compared. An orthologue is identified when the sequence resulting in the highest score (best hit) in the first BLAST® identifies in the second BLAST® the query sequence (the original sequence-of-interest) as the best hit. Using the same rational a paralogue (homolog to a gene in the same organism) is found. In case of large sequence families, the ClustalW program may be used [ebi (dot) ac (dot) uk/Tools/clustalw2/index (dot) html], followed by a neighbor-joining tree (wikipedia (dot) org/wiki/Neighbor-joining) which helps visualizing the clustering.

Homology (e.g., percent homology, sequence identity+ sequence similarity) can be determined using any homology comparison software computing a pairwise sequence alignment.

As used herein, "sequence identity" or "identity" in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. [Amino acid substitution matrices from protein blocks. Proc. Natl. Acad. Sci. U.S.A. 1992, 89(22): 10915-9].

Identity (e.g., percent homology) can be determined using any homology comparison software, including for example, the BLAST®N software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., an homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from biocceleration (dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from emboss (dot)sourceforge(dot)net/apps/cvs/emboss/apps/needle(dot) html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST® software with the BLAST®p and tBLAST®n algorithms as filters for the first stage, and the needle (EMBOSS package) or Frame+ algorithm alignment for the second stage. Local identity (BLAST® alignments) is defined with a very permissive cutoff—60% Identity on a span of 60% of the sequences lengths because it is used only as a filter for the global alignment stage. In this specific embodiment (when the local identity is used), the default filtering of the BLAST® package is not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the BLAST®p Filter):

EMBOSS-6.0.1 Needleman-Wunsch algorithm with the following modified parameters: gapopen=8 gapextend=2. The rest of the parameters are unchanged from the default options listed here:

Standard (Mandatory) qualifiers:
 [-asequence] sequence Sequence filename and optional format, or reference (input USA)
 [-bsequence] seqall Sequence(s) filename and optional format, or reference (input USA)
 -gapopen float [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)
 -gapextend float [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)
 [-outfile] align [*.needle] Output alignment file name
 Additional (Optional) Qualifiers:
 -datafile matrixf [EBLOSUM62 for protein, EDNAFULL for DNA]. This is the scoring matrix file used when comparing sequences. By default it is the file 'EBLOSUM62' (for proteins) or the file 'EDNAFULL' (for nucleic sequences). These files are found in the 'data' directory of the EMBOSS installation.
 Advanced (Unprompted) Qualifiers:
 -[no]brief boolean [Y] Brief identity and similarity
 Associated Qualifiers:
 "-asequence" associated qualifiers
 -sbegin1 integer Start of the sequence to be used
 -send1 integer End of the sequence to be used
 -sreverse1 boolean Reverse (if DNA)
 -sask1 boolean Ask for begin/end/reverse
 -snucleotide1 boolean Sequence is nucleotide
 -sprotein1 boolean Sequence is protein
 -slower1 boolean Make lower case
 -supper1 boolean Make upper case
 -sformat1 string Input sequence format
 -sdbname1 string Database name
 -sid1 string Entryname
 -ufo1 string UFO features
 -fformat1 string Features format
 -fopenfile1 string Features file name
 "-bsequence" associated qualifiers
 -sbegin2 integer Start of each sequence to be used
 -send2 integer End of each sequence to be used
 -sreverse2 boolean Reverse (if DNA)
 -sask2 boolean Ask for begin/end/reverse
 -snucleotide2 boolean Sequence is nucleotide
 -sprotein2 boolean Sequence is protein
 -slower2 boolean Make lower case
 -supper2 boolean Make upper case
 -sformat2 string Input sequence format
 -sdbname2 string Database name
 -sid2 string Entryname
 -ufo2 string UFO features
 -fformat2 string Features format
 -fopenfile2 string Features file name
 "-outfile" associated qualifiers
 -aformat3 string Alignment format
 -aextension3 string File name extension
 -adirectory3 string Output directory
 -aname3 string Base file name
 -awidth3 integer Alignment width
 -aaccshow3 boolean Show accession number in the header
 -adesshow3 boolean Show description in the header
 -ausashow3 boolean Show the full USA in the alignment
 -aglobal3 boolean Show the full sequence in alignment
 General Qualifiers:
 -auto boolean Turn off prompts
 -stdout boolean Write first file to standard output
 -filter boolean Read first file from standard input, write first file to standard output
 -options boolean Prompt for standard and additional values
 -debug boolean Write debug output to program.dbg
 -verbose boolean Report some/full command line options
 -help boolean Report command line options. More information on associated and general qualifiers can be found with -help -verbose
 -warning boolean Report warnings
 -error boolean Report errors
 -fatal boolean Report fatal errors
 -die boolean Report dying program messages 2. Between a protein sequence and a nucleotide sequence (following the tBLAST®n filter): GenCore 6.0 OneModel application utilizing the Frame+ algorithm with the following parameters: model=frame+_p2n.model mode=qglobal -q=protein.sequence -db= nucleotide.sequence. The rest of the parameters are unchanged from the default options:

Usage:
om -model=<model_fname>[-q=]query [-db=]database [options]
-model=<model_fname> Specifies the model that you want to run. All models supplied by Compugen are located in the directory $CGNROOT/models/.

Valid command line parameters:
- -dev=<dev_name> Selects the device to be used by the application.
  Valid devices are:
  bic—Bioccelerator (valid for SW, XSW, FRAME_N2P, and FRAME_P2N models).
  xlg—BioXL/G (valid for all models except XSW).
  xlp—BioXL/P (valid for SW, FRAME+_N2P, and FRAME_P2N models).
  xlh—BioXL/H (valid for SW, FRAME+_N2P, and FRAME_P2N models).
  soft—Software device (for all models).
- -q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.
- -db=<database name> Chooses the database set. The database set can be a sequence file or a database reference. The database format is detected automatically. However, you may specify a format using -dfmt parameter.
- -qacc Add this parameter to the command line if you specify query using accession numbers.
- -dacc Add this parameter to the command line if you specify a database using accession numbers.
- -dfmt/-qfmt=<format_type> Chooses the database/query format type. Possible formats are:
  fasta—fasta with seq type auto-detected.
  fastap—fasta protein seq.
  fastan—fasta nucleic seq.
  gcg—gcg format, type is auto-detected.
  gcg9seq—gcg9 format, type is auto-detected.
  gcg9seqp—gcg9 format protein seq.
  gcg9seqn—gcg9 format nucleic seq.
  nbrf—nbrf seq, type is auto-detected.
  nbrfp—nbrf protein seq.
  nbrfn—nbrf nucleic seq.
  embl—embl and swissprot format.
  genbank—genbank format (nucleic).
  BLAST®—BLAST® format.
  nbrf_gcg—nbrf-gcg seq, type is auto-detected.
  nbrf_gcgp—nbrf-gcg protein seq.
  nbrf_gcgn—nbrf-gcg nucleic seq.
  raw—raw ascii sequence, type is auto-detected.
  rawp—raw ascii protein sequence.
  rawn—raw ascii nucleic sequence.
  pir—pir codata format, type is auto-detected.
  profile—gcg profile (valid only for -qfmt in SW, XSW, FRAME_P2N, and FRAME+_P2N).
- -out=<out_fname> The name of the output file.
- -suffix=<name> The output file name suffix.
- -gapop=<n> Gap open penalty. This parameter is not valid for FRAME+. For FrameSearch the default is 12.0. For other searches the default is 10.0.
- -gapext=<n> Gap extend penalty. This parameter is not valid for FRAME+. For FrameSearch the default is 4.0. For other models: the default for protein searches is 0.05, and the default for nucleic searches is 1.0.
- -qgapop=<n> The penalty for opening a gap in the query sequence. The default is 10.0. Valid for XSW.
- -qgapext=<n> The penalty for extending a gap in the query sequence. The default is 0.05. Valid for XSW.
- -start=<n> The position in the query sequence to begin the search.
- -end=<n> The position in the query sequence to stop the search.
- -qtrans Performs a translated search, relevant for a nucleic query against a protein database. The nucleic query is translated to six reading frames and a result is given for each frame.
  Valid for SW and XSW.
- -dtrans Performs a translated search, relevant for a protein query against a DNA database. Each database entry is translated to six reading frames and a result is given for each frame.
  Valid for SW and XSW.
  Note: "-qtrans" and "-dtrans" options are mutually exclusive.
- -matrix=<matrix_file> Specifies the comparison matrix to be used in the search. The matrix must be in the BLAST® format. If the matrix file is not located in $CGNROOT/tables/matrix, specify the full path as the value of the -matrix parameter.
- -trans=<transtab_name> Translation table. The default location for the table is $CGNROOT/tables/trans.
- -onestrand Restricts the search to just the top strand of the query/database nucleic sequence.
- -list=<n> The maximum size of the output hit list. The default is 50.
- -docalign=<n> The number of documentation lines preceding each alignment. The default is 10.
- -thr_score=<score_name> The score that places limits on the display of results. Scores that are smaller than -thr_min value or larger than -thr_max value are not shown. Valid options are: quality.
  zscore.
  escore.
- -thr_max=<n> The score upper threshold. Results that are larger than -thr_max value are not shown.
- -thr_min=<n> The score lower threshold. Results that are lower than -thr_min value are not shown.
- -align=<n> The number of alignments reported in the output file.
- -noalign Do not display alignment.
  Note: "-align" and "-noalign" parameters are mutually exclusive.
- -outfmt=<format_name> Specifies the output format type. The default format is PFS.
  Possible values are:
  PFS—PFS text format
  FASTA—FASTA text format
  BLAST®—BLAST® text format
- -nonorm Do not perform score normalization.
- -norm=<norm_name> Specifies the normalization method.
  Valid options are:
  log—logarithm normalization.
  std—standard normalization.
  stat—Pearson statistical method.
  Note: "-nonorm" and "-norm" parameters cannot be used together.
  Note: Parameters -xgapop, -xgapext, -fgapop, -fgapext, -ygapop, -ygapext, -delop, and -delext apply only to FRAME+.
- -xgapop=<n> The penalty for opening a gap when inserting a codon (triplet). The default is 12.0.
- -xgapext=<n> The penalty for extending a gap when inserting a codon (triplet). The default is 4.0.
- -ygapop=<n> The penalty for opening a gap when deleting an amino acid. The default is 12.0.
- -ygapext=<n> The penalty for extending a gap when deleting an amino acid. The default is 4.0.

-fgapop=<n> The penalty for opening a gap when inserting a DNA base. The default is 6.0.
-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host_name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job. Note:"-batch" and "-wait" parameters are mutually exclusive.
-version Prints the software version number.
-help Displays this help message. To get more specific help type:
"om -model=<model_fname>-help".

According to some embodiments the homology is a local homology or a local identity.

Local alignments tools include, but are not limited to the BLAST®P, BLAST® N, BLASTX® or TBLASTN® software of the National Center of Biotechnology Information (NCBI), FASTA, and the Smith-Waterman algorithm.

A tBLASN® search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST® databases est and htgs, respectively.

Default parameters for BLASTP® include: Max target sequences: 100; Expected threshold: $e^{-5}$; Word size: 3; Max matches in a query range: 0; Scoring parameters: Matrix—BLOSUM62; filters and masking: Filter—low complexity regions.

Local alignments tools, which can be used include, but are not limited to, the tBLASTX® algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629.

According to some embodiments of the invention, the exogenous polynucleotide of the invention encodes a polypeptide having the amino acid sequence selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629.

According to some embodiments of the invention, the method of increasing yield, biomass, growth rate, vigor, oil content, fiber yield, fiber quality, fiber length, photosynthetic capacity, abiotic stress tolerance, and/or nitrogen use efficiency of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629, thereby increasing the yield, biomass, growth rate, vigor, oil content, fiber yield, fiber quality, fiber length, photosynthetic capacity, abiotic stress tolerance, and/or nitrogen use efficiency of the plant.

According to some embodiments of the invention, the exogenous polynucleotide encodes a polypeptide consisting of the amino acid sequence set forth by SEQ ID NO: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 or 10629.

According to an aspect of some embodiments of the invention, the method of increasing yield, biomass, growth rate, vigor, oil content, fiber yield, fiber quality, fiber length, photosynthetic capacity, abiotic stress tolerance, and/or nitrogen use efficiency of a plant, is effected by expressing within the plant an exogenous polynucleotide comprising a nucleic acid sequence encoding a polypeptide comprising an amino acid sequence selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629, thereby increasing the yield, biomass, growth rate, vigor, oil content, fiber yield, fiber quality, fiber length, photosynthetic capacity, abiotic stress tolerance, and/or nitrogen use efficiency of the plant.

According to an aspect of some embodiments of the invention, there is provided a method of increasing yield, biomass, growth rate, vigor, oil content, fiber yield, fiber quality, fiber length, photosynthetic capacity, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629, thereby increasing the yield, biomass, growth rate, vigor, oil content, fiber yield, fiber quality, fiber length, photosynthetic capacity, abiotic stress tolerance, and/or nitrogen use efficiency of the plant.

According to some embodiments of the invention, the exogenous polynucleotide encodes a polypeptide consisting of the amino acid sequence set forth by SEQ ID NO: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 or 10629.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028.

According to an aspect of some embodiments of the invention, there is provided a method of increasing yield, biomass, growth rate, vigor, oil content, fiber yield, fiber quality, fiber length, photosynthetic capacity, abiotic stress tolerance, and/or nitrogen use efficiency of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028, thereby increasing the yield, biomass, growth rate, vigor, oil content, fiber yield, fiber quality, fiber length, photosynthetic capacity, abiotic stress tolerance, and/or nitrogen use efficiency of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028.

According to some embodiments of the invention the exogenous polynucleotide is set forth by SEQ ID NO: 1-551, 898-6027 or 6028.

According to some embodiments of the invention the exogenous polynucleotide is set forth by the nucleic acid sequence selected from the group consisting of SEQ ID NOs: 1-551, 898-6027 and 6028.

According to some embodiments of the invention the method of increasing yield, growth rate, biomass, vigor, oil content, seed yield, fiber yield, fiber quality, fiber length, photosynthetic capacity, nitrogen use efficiency, and/or abiotic stress tolerance of a plant further comprising selecting a plant having an increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

It should be noted that selecting a transformed plant having an increased trait as compared to a native (or non-transformed) plant grown under the same growth conditions can be performed by selecting for the trait, e.g., validating the ability of the transformed plant to exhibit the increased trait using well known assays (e.g., seedling analyses, greenhouse assays, filed experiments) as is further described herein below.

According to some embodiments of the invention selecting is performed under non-stress conditions.

According to some embodiments of the invention selecting is performed under abiotic stress conditions.

According to some embodiments of the invention selecting is performed under nitrogen limiting (e.g., nitrogen deficient) conditions.

According to an aspect of some embodiments of the invention, there is provided a method of selecting a transformed plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (e.g., having sequence similarity or sequence identity) to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629, (b) selecting from the plants of step (a) a plant having increased yield, growth rate, biomass, vigor, oil content, seed yield, fiber yield, fiber quality, fiber length, photosynthetic capacity, nitrogen use efficiency, and/or abiotic stress tolerance (e.g., by selecting the plants for the increased trait), thereby selecting the plant having increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to an aspect of some embodiments of the invention, there is provided a method of selecting a transformed plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028, (b) selecting from the plants of step (a) a plant having increased yield, growth rate, biomass, vigor, oil content, seed yield, fiber yield, fiber quality, fiber length, photosynthetic capacity, nitrogen use efficiency, and/or abiotic stress tolerance, thereby selecting the plant having increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn] 2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 251-261, 305-310, 547-551, 2495, 3836, 4999, and 5255.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

According to some embodiments of the invention, the exogenous polynucleotide encodes a polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629.

According to some embodiments of the invention, the polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028.

According to some embodiments of the invention the nucleic acid sequence is capable of increasing nitrogen use efficiency, fertilizer use efficiency, yield (e.g., seed yield, oil yield), growth rate, vigor, biomass, oil content, fiber yield, fiber quality, fiber length, photosynthetic capacity, abiotic stress tolerance and/or water use efficiency of a plant.

According to some embodiments of the invention the isolated polynucleotide comprising the nucleic acid sequence selected from the group consisting of SEQ ID NOs: 1-551, 898-6027 and 6028.

According to some embodiments of the invention the isolated polynucleotide is set forth by SEQ ID NO: 1-551, 898-6027 or 6028.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629.

According to some embodiments of the invention the amino acid sequence is capable of increasing nitrogen use efficiency, fertilizer use efficiency, yield, seed yield, growth rate, vigor, biomass, oil content, fiber yield, fiber quality, fiber length, photosynthetic capacity, abiotic stress tolerance and/or water use efficiency of a plant.

The invention provides an isolated polynucleotide comprising a nucleic acid sequence encoding a polypeptide which comprises the amino acid sequence selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629.

According to some embodiments of the invention, the polypeptide comprising an amino acid sequence selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629.

According to some embodiments of the invention, the polypeptide is set forth by SEQ ID NO: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 or 10629.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses a whole plant, a grafted plant, ancestor(s) and progeny of the plants and plant parts, including seeds, shoots, stems, roots (including tubers), rootstock, scion, and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorycnium rectum, Echinochloa pyramidalis, Ehraffia* spp., *Eleusine coracana, Eragrestis* spp., *Erythrina* spp., *Eucalypfus* spp., *Euclea schimperi, Eulalia vi/losa, Pagopyrum* spp., *Feijoa sellowlana, Fragaria* spp., *Flemingia* spp, *Freycinetia banksli, Geranium thunbergii, GinAgo biloba, Glycine javanica, Gliricidia* spp, *Gossypium hirsutum, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus otara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, *eucalyptus*, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, *lupinus*, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of some embodiments of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

According to some embodiments of the invention, the isolated polynucleotide is heterologous to the plant cell (e.g., the polynucleotide is derived from a different plant species when compared to the plant cell, thus the isolated polynucleotide and the plant cell are not from the same plant species).

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable promoters for expression in wheat include, but are not limited to, Wheat SPA promoter (SEQ ID NO: 10630; Albanietal, Plant Cell, 9: 171-184, 1997, which is fully incorporated herein by reference), wheat LMW (SEQ ID NO: 10631 (longer LMW promoter), and SEQ ID NO: 10632 (LMW promoter) and HMW glutenin-1 (SEQ ID NO: 10633 (Wheat HMW glutenin-1 longer promoter); and SEQ ID NO: 10634 (Wheat HMW glutenin-1 Promoter); Thomas and Flavell, The Plant Cell 2:1171-1180; Furtado et al., 2009 Plant Biotechnology Journal 7:240-253, each of which is fully incorporated herein by reference), wheat alpha, beta and gamma gliadins [e.g., SEQ ID NO: 10635 (wheat alpha gliadin, B genome, promoter); SEQ ID NO: 10636 (wheat gamma gliadin promoter); EMBO 3:1409-15, 1984, which is fully incorporated herein by reference], wheat TdPR60 [SEQ ID NO: 10637 (wheat TdPR60 longer promoter) or SEQ ID NO: 10638 (wheat TdPR60 promoter); Kovalchuk et al., Plant Mol Biol 71:81-98, 2009, which is fully incorporated herein by reference], maize Ub1 Promoter [cultivar Nongda 105 (SEQ ID NO: 10639); GenBank: DQ141598.1; Taylor et al., Plant Cell Rep 1993 12: 491-495, which is fully incorporated herein by reference; and cultivar B73 (SEQ ID NO: 10640); Christensen, A H, et al. Plant Mol. Biol. 18 (4), 675-689 (1992), which is fully incorporated herein by reference]; rice actin 1 (SEQ ID NO: 10641; Mc Elroy et al. 1990, The Plant Cell, Vol. 2, 163-171, which is fully incorporated herein by reference), rice GOS2 [SEQ ID NO: 10642 (rice GOS2 longer promoter) and SEQ ID NO: 10643 (rice GOS2 Promoter); De Pater et al. Plant J. 1992; 2: 837-44, which is fully incorporated herein by reference], *arabidopsis* Pho1 [SEQ ID NO: 10644 (*arabidopsis* Pho1 Promoter); Hamburger et al., Plant Cell. 2002; 14: 889-902, which is fully incorporated herein by reference], Expansin B promoters, e.g., rice ExpB5 [SEQ ID NO: 10645 (rice ExpB5 longer promoter) and SEQ ID NO: 10646 (rice ExpB5 promoter)] and Barley ExpB1 [SEQ ID NO: 10647 (barley ExpB1 Promoter), Won et al. Mol Cells. 2010; 30:369-76, which is fully incorporated herein by reference], barley SS2 (sucrose synthase 2) [(SEQ ID NO: 10648), Guerin and Carbonero, Plant Physiology May 1997 vol. 114 no. 1 55-62, which is fully incorporated herein by reference], and rice PG5a [SEQ ID NO: 10649, U.S. Pat. No. 7,700,835, Nakase et al., Plant Mol Biol. 32:621-30, 1996, each of which is fully incorporated herein by reference].

Suitable constitutive promoters include, for example, CaMV 35S promoter [SEQ ID NO: 10650 (CaMV 35S (pQXNc) Promoter); SEQ ID NO: 10651 (PJJ 35S from *Brachypodium*); SEQ ID NO: 10652 (CaMV 35S (OLD) Promoter) (Odell et al., Nature 313:810-812, 1985)], *Arabidopsis* At6669 promoter (SEQ ID NO: 10653 (*Arabidopsis* At6669 (OLD) Promoter); see PCT Publication No. WO04081173A2 or the new At6669 promoter (SEQ ID NO: 10654 (*Arabidopsis* At6669 (NEW) Promoter)); maize Ub1 Promoter [cultivar Nongda 105 (SEQ ID NO: 10639); GenBank: DQ141598.1; Taylor et al., Plant Cell Rep 1993 12: 491-495, which is fully incorporated herein by reference; and cultivar B73 (SEQ ID NO: 10640); Christensen, A H, et al. Plant Mol. Biol. 18 (4), 675-689 (1992), which is fully incorporated herein by reference]; rice actin 1 (SEQ ID NO: 10641, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); rice GOS2 [SEQ ID NO: 10642 (rice GOS2 longer Promoter) and SEQ ID NO: 10643 (rice GOS2 Promoter), de Pater et al, Plant J November; 2(6):837-44, 1992]; RBCS promoter (SEQ ID NO: 10655); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5.608,144; 5,604,121; 5,569,597: 5,466,785; 5,399,680; 5,268,463; and 5,608,142.

Suitable tissue-specific promoters include, but not limited to, leaf-specific promoters [e.g., AT5G06690 (Thioredoxin) (high expression, SEQ ID NO: 10656), AT5G61520 (At-STP3) (low expression, SEQ ID NO: 10657) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO: 10658 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (SEQ ID NO: 10649; U.S. Pat. No. 7,700,835), early seed development *Arabidopsis* BAN (AT1G61720) (SEQ ID NO: 10659, US 2009/0031450 A1), late seed development *Arabidopsis* ABI3 (AT3G24650)

(SEQ ID NO: 10660 (*Arabidopsis* ABI3 (AT3G24650) longer Promoter) or 10661 (*Arabidopsis* ABI3 (AT3G24650) Promoter)) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143:323-32 1990), napA (Stalberg, et al, Planta 199: 515-519, 1996), Wheat SPA (SEQ ID NO: 10630; Albanietal, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 10631 (Wheat LMW Longer Promoter), and SEQ ID NO: 10632 (Wheat LMW Promoter) and HMW glutenin-1 [(SEQ ID NO: 10633 (Wheat HMW glutenin-1 longer Promoter)); and SEQ ID NO: 10634 (Wheat HMW glutenin-1 Promoter), Thomas and Flavell, The Plant Cell 2:1171-1180, 1990; Mol Gen Genet 216:81-90, 1989; NAR 17:461-2), wheat alpha, beta and gamma gliadins (SEQ ID NO: 10635 (wheat alpha gliadin (B genome) promoter); SEQ ID NO: 10636 (wheat gamma gliadin promoter); EMBO 3:1409-15, 1984), Barley ltr1 promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (SEQ ID NO: 10648 (Barley SS2 Promoter); Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice -globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217: 240-245; 1989), *Arabidopsis apetala*—3 (Tilly et al., Development. 125:1647-57, 1998), *Arabidopsis APETALA* 1 (AT1G69120, AP1) (SEQ ID NO: 10662 (*Arabidopsis* (AT1G69120) *APETALA* 1)) (Hempel et al., Development 124:3845-3853, 1997)], and root promoters [e.g., the ROOTP promoter [SEQ ID NO: 10663]; rice ExpB5 (SEQ ID NO: 10646 (rice ExpB5 Promoter); or SEQ ID NO: 10645 (rice ExpB5 longer Promoter)) and barley ExpB1 promoter (SEQ ID NO: 10647) (Won et al. Mol. Cells 30: 369-376, 2010); *arabidopsis* ATTPS-CIN (AT3G25820) promoter (SEQ ID NO: 10664; Chen et al., Plant Phys 135:1956-66, 2004); *arabidopsis* Pho1 promoter (SEQ ID NO: 10644, Hamburger et al., Plant Cell. 14: 889-902, 2002), which is also slightly induced by stress].

Suitable abiotic stress-inducible promoters include, but not limited to, salt-inducible promoters such as RD29A (Yamaguchi-Shinozalei et al., Mol. Gen. Genet. 236:331-340, 1993), drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

According to some embodiments, there is provided a method of improving nitrogen use efficiency, yield, growth rate, biomass, vigor, oil content, oil yield, seed yield, fiber yield, fiber quality, fiber length, photosynthetic capacity, and/or abiotic stress tolerance of a grafted plant, the method comprising providing a scion that does not transgenically express a polynucleotide encoding a polypeptide at least 80% homologous to the amino acid sequence selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629 and a plant rootstock that transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629 (e.g., in a constitutive, tissue specific or inducible, e.g., in an abiotic stress responsive manner), thereby improving the nitrogen use efficiency, yield, growth rate, biomass, vigor, oil content, seed yield, fiber yield, fiber quality, fiber length, photosynthetic capacity, and/or abiotic stress tolerance of the grafted plant.

In some embodiments, the plant scion is non-transgenic.

Several embodiments relate to a grafted plant exhibiting improved nitrogen use efficiency, yield, growth rate, biomass, vigor, oil content, seed yield, fiber yield, fiber quality, fiber length, photosynthetic capacity, and/or abiotic stress tolerance, comprising a scion that does not transgenically express a polynucleotide encoding a polypeptide at least 80% homologous to the amino acid sequence selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629 and a plant rootstock that transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629 in a stress responsive manner.

In some embodiments, the plant root stock transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629.

According to some embodiments of the invention, the plant root stock transgenically expresses a polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028.

According to some embodiments of the invention, the plant root stock transgenically expresses a polynucleotide selected from the group consisting of SEQ ID NOs: 1-551, 898-6027 and 6028.

Since processes which increase nitrogen use efficiency, fertilizer use efficiency, oil content, yield, seed yield, fiber yield, fiber quality, fiber length, photosynthetic capacity, growth rate, biomass, vigor and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on nitrogen use efficiency, fertilizer use efficiency, oil content, yield, seed yield, fiber yield, fiber quality, fiber length, photosynthetic capacity, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, osmotic stress, drought, water deprivation, excess of water (e.g., flood, waterlogging), etiolation, low temperature (e.g., cold stress), high temperature, heavy metal toxicity, anaerobiosis, nutrient deficiency (e.g., nitrogen deficiency or nitrogen limitation), nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions), wherein the normal or optimal conditions include about 6-15 mM Nitrogen, e.g., 6-10 mM Nitrogen).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immunoassays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins);

selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention; and (b) evaluating a trait of a plant as compared to a wild type plant of the same type (e.g., a plant not transformed with the claimed biomolecules); thereby evaluating the trait of the plant.

According to an aspect of some embodiments of the invention there is provided a method of producing a crop comprising growing a crop of a plant expressing an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629, wherein the plant is derived from a plant (parent plant) that has been transformed to express the exogenous polynucleotide and that has been selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide encoding a polypeptide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629, wherein the crop plant is derived from plants which have been transformed with the exogenous polynucleotide and which have been selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency), thereby producing the crop.

According to some embodiments of the invention the polypeptide is selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629.

According to an aspect of some embodiments of the invention there is provided a method of producing a crop comprising growing a crop of a plant expressing an exogenous polynucleotide which comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028, wherein the plant is derived from a plant selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the nucleic acid sequence selected from the group consisting of SEQ ID NOs: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028, wherein the crop plant is derived from plants which have been transformed with the exogenous polynucleotide and which have been selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency), thereby producing the crop.

According to some embodiments of the invention the exogenous polynucleotide is selected from the group consisting of SEQ ID NOs: 1-551, 898-6027 and 6028.

According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant.

According to some embodiments of the invention the method of growing a crop comprising seeding seeds and/or planting plantlets of a plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 or 10629, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the polypeptide is selected from the group consisting of SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629.

According to some embodiments of the invention the method of growing a crop comprising seeding seeds and/or planting plantlets of a plant transformed with an exogenous polynucleotide comprising the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 1-82, 84-174, 176-222, 224-229, 231-235, 238-302, 304-387, 389-473, 475-519, 521-526, 528-532, 535-551, 898-2468, 2485, 2492-2493, 2495, 2507-2508, 2510-2512, 2523-2524, 2526, 2528, 2533, 2537, 2541, 2545-2546, 2551-2553, 2557, 2564, 2567, 2573-2574, 2576-2577, 2583, 2594, 2599, 2602, 2611, 2613-2614, 2616-2617, 2619, 2635-2638, 2640-2642, 2648, 2652, 2655, 2660, 2662, 2666, 2668, 2673-2674, 2677, 2679, 2681, 2683-2688, 2691, 2693, 2695-2698, 2700, 2707-2708, 2713-2714, 2716-2717, 2719-2720, 2724-2726, 2728, 2730-2731, 2736-2742, 2744-2746, 2751-2753, 2757, 2759-2762, 2764-2766, 2769-2776, 2780-2783, 2785-2788, 2791, 2793-2795, 2798, 2805, 2807-2808, 2812, 2814-2815, 2818-2820, 2823, 2829, 2834-2838, 2840-2842, 2844-2846, 2848, 2852-2858, 2860-2872, 2874, 2876-3244, 3246, 3248-4015, 4017-4426, 4449-5012, 5015-5071, 5073-5090, 5101, 5255, 5267-5304, 5306-5307, 5309-5539, 5541, 5543-5976, 5994-5999, 6003-6027 and 6028, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the exogenous polynucleotide is selected from the group consisting of SEQ ID NOs: 1-551, 898-6027 and 6028.

According to an aspect of some embodiments of the present invention there is provided a method of growing a crop comprising:

(a) selecting a parent plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polypeptide selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress tolerance as compared to a non-transformed plant of the same species which is grown under the same growth conditions, and (b) growing a progeny crop plant of the parent plant, wherein the progeny crop plant which comprises the exogenous polynucleotide has the increased yield, the increased growth rate, the increased biomass, the increased vigor, the increased oil content, the increased seed yield, the increased fiber yield, the increased fiber quality, the increased fiber length, the increased photosynthetic capacity, the increased nitrogen use efficiency, and/or the increased abiotic stress, thereby growing the crop.

According to an aspect of some embodiments of the present invention there is provided a method of producing seeds of a crop comprising:

(a) selecting parent plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polypeptide selected from the group consisting of SEQ ID NOs: 552-633, 635-725, 727-773, 775-780, 782-786, 789-885, 887-889, 891-897, 6029-7467, 7481, 7487, 7498-7499, 7501-7503, 7512-7513, 7515, 7517, 7522, 7525, 7529, 7533-7534, 7539-7541, 7545, 7549, 7552, 7555-7556, 7558, 7563, 7576, 7579, 7588, 7590, 7592-7593, 7595, 7609-7612, 7614-7615, 7620, 7624, 7627, 7631, 7633, 7637, 7639, 7643-7644, 7647, 7649, 7651, 7653-7658, 7660, 7662, 7664, 7666, 7672-7673, 7677-7678, 7680-7681, 7683-7684, 7688-7690, 7692, 7694, 7699-7703, 7705-7706, 7709-7711, 7716-7719, 7721-7723, 7726-7732, 7736-7738, 7740-7742, 7745, 7747-7748, 7751, 7758, 7760-7762, 7765-7766, 7769, 7773, 7777-7781, 7783-7785, 7787-7789, 7791, 7795-7800, 7802-7811, 7813, 7815-8160, 8162, 8164-8853, 8855-9215, 9238-9749, 9751-9803, 9805-9818, 9828, 9935-9968, 9970-9971, 9973-10187, 10189, 10191-10585, 10600-10605, 10609-10628 and 10629 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress as compared to a non-transformed plant of the same species which is grown under the same growth conditions, (b) growing a seed producing plant from the parent plant resultant of step (a), wherein the seed producing plant which comprises the exogenous polynucleotide having the increased yield, the increased growth rate, the increased biomass, the increased vigor, the increased oil content, the increased seed yield, the increased fiber yield, the increased fiber quality, the increased fiber length, the increased photosynthetic capacity, the increased nitrogen use efficiency, and/or the increased abiotic stress, and (c) producing seeds from the seed producing plant resultant of step (b), thereby producing seeds of the crop.

According to some embodiments of the invention, the seeds produced from the seed producing plant comprise the exogenous polynucleotide.

According to an aspect of some embodiments of the present invention there is provided a method of growing a crop comprising:

(a) selecting a parent plant transformed with an exogenous polynucleotide comprising a nucleic acid sequence encoding the polypeptide selected from the group consisting of set forth in SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629, for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress tolerance as compared to a non-transformed plant of the same species which is grown under the same growth conditions, and (b) growing progeny crop plant of the parent plant, wherein the progeny crop plant which comprises the exogenous polynucleotide has the increased yield, the increased growth rate, the increased biomass, the increased vigor, the increased oil content, the increased seed yield, the increased fiber yield, the increased fiber quality, the increased fiber length, the increased photosynthetic capacity, the increased nitrogen use efficiency, and/or the increased abiotic stress,
thereby growing the crop.

According to an aspect of some embodiments of the present invention there is provided a method of producing seeds of a crop comprising:

(a) selecting parent plant transformed with an exogenous polynucleotide comprising a nucleic acid sequence encoding the polypeptide selected from the group consisting of set forth in SEQ ID NOs: 552-773, 775-780, 782-786, 789-885, 887-897, 6029-7781, 7783-9818, 9820-9823, 9827-9828, 9840-9841, 9849, 9852-9854, 9856, 9858-9859, 9867, 9870, 9872, 9874-9875, 9881, 9883-9885, 9887, 9891, 9893, 9896, 9898-9902, 9904, 9906-9908, 9911, 9915, 9917, 9919, 9921-9922, 9924-9926, 9929, 9933-10585, 10589, 10593, 10599-10605, 10607-10628 and 10629 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress as compared to a non-transformed plant of the same species which is grown under the same growth conditions, (b) growing a seed producing plant from the parent plant resultant of step (a), wherein the seed producing plant which comprises the exogenous polynucleotide having the increased yield, the increased growth rate, the increased biomass, the increased vigor, the increased oil content, the increased seed yield, the increased fiber yield, the increased fiber quality, the increased fiber length, the increased photosynthetic capacity, the increased nitrogen use efficiency, and/or the increased abiotic stress, and (c) producing seeds from the seed producing plant resultant of step (b),
thereby producing seeds of the crop.

According to some embodiments of the invention the exogenous polynucleotide is selected from the group consisting of SEQ ID NOs: 1-551, 898-6027 and 6028.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency (e.g., nitrogen deficiency or limiting nitrogen conditions), nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering. Additional drought assays are described in the Examples section which follows (e.g., Examples 29 and 30 below).

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \qquad \text{Formula I}$$

Fertilizer use efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen limiting conditions and Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" Proc. Natl. Acad. Sci. USA 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control. Additional assays for measuring tolerance to nitrogen limiting (deficient) conditions are described in Examples 29-32 in the Examples section which follows).

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

It should be noted that an increase in rosette parameters such as rosette area, rosette diameter and/or rosette growth rate in a plant model such as *Arabidopsis* predicts an increase in canopy coverage and/or plot coverage in a target plant such as *Brassica* sp., soy, corn, wheat, Barley, oat, cotton, rice, tomato, sugar beet, and vegetables such as lettuce.

Evaluation of growth rate can be done by measuring plant biomass produced, rosette area, leaf size or root length per time (can be measured in cm² per day of leaf area).

Relative growth area can be calculated using Formula II.

Relative growth rate area=Regression coefficient of area along time course   Formula II:

Thus, the relative growth area rate is in units of area units (e.g., mm²/day or cm²/day) and the relative length growth rate is in units of length units (e.g., cm/day or mm/day).

For example, RGR can be determined for plant height (Formula III), SPAD (Formula IV), Number of tillers (Formula V), root length (Formula VI), vegetative growth (Formula VII), leaf number (Formula VIII), rosette area (Formula IX), rosette diameter (Formula X), plot coverage (Formula XI), leaf blade area (Formula XII), and leaf area (Formula XIII)

Relative growth rate of Plant height=Regression coefficient of Plant height along time course (measured in cm/day).   Formula III:

Relative growth rate of SPAD=Regression coefficient of SPAD measurements along time course.   Formula IV:

Relative growth rate of Number of tillers=Regression coefficient of Number of tillers along time course (measured in units of "number of tillers/day").   Formula V:

Relative growth rate of root length=Regression coefficient of root length along time course (measured in cm per day).   Formula VI:

Vegetative growth rate analysis—was calculated according to Formula VII below.

Relative growth rate of vegetative growth=Regression coefficient of vegetative dry weight along time course (measured in grams per day).   Formula VII:

Relative growth rate of leaf number=Regression coefficient of leaf number along time course (measured in number per day).   Formula VIII:

Relative growth rate of rosette area=Regression coefficient of rosette area along time course (measured in cm² per day).   Formula IX:

Relative growth rate of rosette diameter=Regression coefficient of rosette diameter along time course (measured in cm per day).   Formula X:

Relative growth rate of plot coverage=Regression coefficient of plot (measured in cm² per day).   Formula XI:

Relative growth rate of leaf blade area=Regression coefficient of leaf area along time course (measured in cm² per day).   Formula XII:

Relative growth rate of leaf area=Regression coefficient of leaf area along time course (measured in cm² per day).   Formula XIII:

1000 Seed Weight=number of seed in sample/sample weight×1000   Formula XIV:

The Harvest Index can be calculated using Formulas XV, XVI, XVII, XVIII and LXV below.

Harvest Index (seed)=Average seed yield per plant/Average dry weight.   Formula XV:

Harvest Index (Sorghum)=Average grain dry weight per Head/(Average vegetative dry weight per Head+Average Head dry weight)   Formula XVI:

Harvest Index (Maize)=Average grain weight per plant/(Average vegetative dry weight per plant plus Average grain weight per plant)   Formula XVII:

Harvest Index (for barley)—The harvest index is calculated using Formula XVIII.

Harvest Index (for barley and wheat)=Average spike dry weight per plant/(Average vegetative dry weight per plant+Average spike dry weight per plant)   Formula XVIII:

Following is a non-limited list of additional parameters which can be detected in order to show the effect of the transgene on the desired plant's traits:

Grain circularity=4×3.14 (grain area/perimeter²)   Formula XIX:

Internode volume=3.14×$(d/2)^2$×1   Formula XX:

Total dry matter (kg)=Normalized head weight per plant+vegetative dry weight.   Formula XXI:

Root/Shoot Ratio=total weight of the root at harvest/total weight of the vegetative portion above ground at harvest. (=RBiH/BiH)   Formula XXII:

Ratio of the number of pods per node on main stem at pod set=Total number of pods on main stem/Total number of nodes on main stem.   Formula XXIII:

Ratio of total number of seeds in main stem to number of seeds on lateral branches=Total number of seeds on main stem at pod set/Total number of seeds on lateral branches at pod set.   Formula XXIV:

Petiole Relative Area=(Petiole area)/Rosette area (measured in %).   Formula XXV:

percentage of reproductive tiller=Number of Reproductive tillers/number of tillers)×100.   Formula XXVI:

Spikes Index=Average Spikes weight per plant/(Average vegetative dry weight per plant plus Average Spikes weight per plant).   Formula XXVII:

Relative growth rate of root coverage=Regression coefficient of root coverage along time course.   Formula XXVIII:

Seed Oil yield=Seed yield per plant (gr.)*Oil % in seed.   Formula XXIX:

shoot/root Ratio=total weight of the vegetative portion above ground at harvest/total weight of the root at harvest.   Formula XXX:

Spikelets Index=Average Spikelets weight per plant/(Average vegetative dry weight per plant plus Average Spikelets weight per plant).   Formula XXXI:

% Canopy coverage=(1-(PAR_DOWN/PAR_UP))×100 measured using AccuPAR Ceptometer Model LP-80.   Formula XXXII:

leaf mass fraction=Leaf area/shoot FW.   Formula XXXIII:

Relative growth rate based on dry weight=Regression coefficient of dry weight along time course.  Formula XXXIV:

Dry matter partitioning (ratio)—At the end of the growing period 6 plants heads as well as the rest of the plot heads were collected, threshed and grains were weighted to obtain grains yield per plot. Dry matter partitioning was calculated by dividing grains yield per plot to vegetative dry weight per plot.  Formula XXXV:

1000 grain weight filling rate (gr/day)—The rate of grain filling was calculated by dividing 1000 grain weight by grain fill duration.  Formula XXXVI:

Specific leaf area (cm$^2$/gr)—Leaves were scanned to obtain leaf area per plant, and then were dried in an oven to obtain the leaves dry weight. Specific leaf area was calculated by dividing the leaf area by leaf dry weight.  Formula XXXVII:

Vegetative dry weight per plant at flowering/water until flowering (gr/lit)—Calculated by dividing vegetative dry weight (excluding roots and reproductive organs) per plant at flowering by the water used for irrigation up to flowering  Formula XXXVIII:

Yield filling rate (gr/day)—The rate of grain filling was calculated by dividing grains Yield by grain fill duration.  Formula XXXIX:

Yield per dunam/water until tan (kg/lit)—Calculated by dividing Grains yield per dunam by water used for irrigation until tan.  Formula XXXX:

Yield per plant/water until tan (gr/lit)—Calculated by dividing Grains yield per plant by water used for irrigation until tan  Formula XXXXI:

Yield per dunam/water until maturity (gr/lit)—Calculated by dividing grains yield per dunam by the water used for irrigation up to maturity. "Lit"=Liter.  Formula XXXXII:

Vegetative dry weight per plant/water until maturity (gr/lit): Calculated by dividing vegetative dry weight per plant (excluding roots and reproductive organs) at harvest by the water used for irrigation up to maturity.  Formula XXXXIII:

Total dry matter per plant/water until maturity (gr/lit): Calculated by dividing total dry matter at harvest (vegetative and reproductive, excluding roots) per plant by the water used for irrigation up to maturity.  Formula XXXXIV:

Total dry matter per plant/water until flowering (gr/lit): Calculated by dividing total dry matter at flowering (vegetative and reproductive, excluding roots) per plant by the water used for irrigation up to flowering.  Formula XXXXV:

Heads index (ratio): Average heads weight/(Average vegetative dry weight per plant plus Average heads weight per plant).  Formula XXXXVI:

Yield/SPAD (kg/SPAD units)—Calculated by dividing grains yield by average SPAD measurements per plot.  Formula XXXXVII:

Stem water content (percentage)—stems were collected and fresh weight (FW) was weighted. Then the stems were oven dry and dry weight (DW) was recorded. Stems dry weight was divided by stems fresh weight, subtracted from 1 and multiplied by 100.  Formula XXXXVIII:

Leaf water content (percentage)—Leaves were collected and fresh weight (FW) was weighted. Then the leaves were oven dry and dry weight (DW) was recorded. Leaves dry weight was divided by leaves fresh weight, subtracted from 1 and multiplied by 100.  Formula XXXXIX:

stem volume (cm$^3$)—The average stem volume was calculated by multiplying the average stem length by (3.14*((mean lower and upper stem width)/2)^2).  Formula L:

NUE—is the ratio between total grain yield per total nitrogen (applied+content) in soil.  Formula LI:

NUpE—Is the ratio between total plant $N$ content per total $N$ (applied+content) in soil.  Formula LII:

Total NUtE—Is the ratio between total dry matter per $N$ content of total dry matter.  Formula LIII:

Stem density—is the ratio between internode dry weight and internode volume.  Formula LIV:

Grain NUtE—Is the ratio between grain yield per $N$ content of total dry matter  Formula LV:

$N$ harvest index (Ratio)—Is the ratio between nitrogen content in grain per plant and the nitrogen of whole plant at harvest.  Formula LVI:

Biomass production efficiency—is the ratio between plant biomass and total shoot $N$.  Formula LVII:

Harvest index (plot) (ratio)—Average seed yield per plot/Average dry weight per plot.  Formula LVIII:

Relative growth rate of petiole relative area—Regression coefficient of petiole relative area along time course (measured in cm$^2$ per day).  Formula LIX:

Yield per spike filling rate (gr/day)—spike filling rate was calculated by dividing grains yield per spike to grain fill duration.  Formula LX:

Yield per micro plots filling rate (gr/day)—micro plots filling rate was calculated by dividing grains yield per micro plots to grain fill duration.  Formula LXI:

Grains yield per hectare [ton/ha]—all spikes per plot were harvested threshed and grains were weighted after sun dry. The resulting value was divided by the number of square meters and multiplied by 10,000 (10,000 square meters=1 hectare).  Formula LXII:

Total dry matter (for Maize)=Normalized ear weight per plant+vegetative dry weight.  Formula LXIII:

Formula LXIV::

$$\text{Agronomical } NUE = \frac{\text{Yield per plant (Kg.)}^{X\ Nitrogen\ Fertilization} - \text{Yield per plant (Kg.)}^{0\%\ Nitrogen\ Fertilization}}{\text{Fertilizer}^X}$$

Harvest Index (brachypodium)=Average grain weight/average dry (vegetative+spikelet) weight per plant.  Formula LXV:

Harvest Index for Sorghum* (* when the plants were not dried)=FW (fresh weight) Heads/(FW Heads+FW Plants)  Formula LXVI:

Grain protein concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (cottoninc (dot) com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway TF. and Earle FR., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods. According to some embodiments of the invention, the oil comprises a seed oil.

According to some embodiments of the invention, the oil comprises a vegetative portion oil (oil of the vegetative portion of the plant).

According to some embodiments of the invention, the plant cell forms a part of a plant.

According to another embodiment of the present invention, there is provided a food or feed comprising the plants or a portion thereof of the present invention.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [invitrogen (dot) com/content (dot)cfm?pageid=469]. Approximately 30-50 mg of tissue was taken from samples. The weighed tissues were ground using pestle and mortar in liquid nitrogen and resuspended in 500 μl of TRIzol Reagent. To the homogenized lysate, 100 μl of chloroform was added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol (QIAGEN Inc, CA USA). For convenience, each micro-array expression information tissue type has received an expression Set ID.

Correlation analysis—was performed for selected genes according to some embodiments of the invention, in which the characterized parameters (measured parameters according to the correlation IDs) were used as "X axis" for correlation with the tissue transcriptome, which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) and the phenotypic characteristic (e.g., improved yield, growth rate, nitrogen use efficiency, abiotic stress tolerance and the like).

Example 1

Identifying Genes which Improve Yield and Agronomical Important Traits in Plants The present inventors have identified polynucleotides which expression thereof in plants can increase yield, seed yield, fiber yield, fiber quality, growth rate, vigor, biomass, growth rate, oil content, abiotic stress tolerance (ABST), fertilizer use efficiency (FUE) such as nitrogen use efficiency (NUE), and water use efficiency (WUE) of a plant, as follows.

All nucleotide sequence datasets used here were originated from publicly available databases or from performing sequencing using the Solexa technology (e.g. Barley and Sorghum). Sequence data from 100 different plant species was introduced into a single, comprehensive database. Other information on gene expression, protein annotation, enzymes and pathways were also incorporated.

Major databases used include:
Genomes
*Arabidopsis* genome [TAIR genome version 6 (*arabidopsis* (dot) org/)];
Rice genome [IRGSP build 4.0 (rgp (dot) dna (dot) affrc (dot) go (dot) jp/IRGSP/)];
Poplar [*Populus trichocarpa* release 1.1 from JGI (assembly release v1.0) (genome (dot) jgi-psf (dot) org/)];
Brachypodium [JGI 4× assembly, brachpodium (dot) org)];
Soybean [DOE-JGI SCP, version Glyma0 (phytozome (dot) net/)];
Grape [French-Italian Public Consortium for Grapevine Genome Characterization grapevine genome (genoscope (dot) cns (dot) fr/)];
Castobean [TIGR/J Craig Venter Institute 4× assembly [msc (dot) jcvi (dot) org/r communis];
Sorghum [DOE-JGI SCP, version Sbi1 [phytozome (dot) net/)];
Partially assembled genome of Maize [maizesequence (dot) org/];

Expressed EST and mRNA Sequences were Extracted from the Following Databases:
GenBank ncbi (dot) nlm (dot) nih (dot) gov/dbEST;
RefSeq (ncbi (dot) nlm (dot) nih (dot) gov/RefSeq/);
TAIR (*arabidopsis* (dot) org/);
Protein and Pathway Databases
Uniprot [uniprot (dot) org/];
AraCyc [*arabidopsis* (dot) org/biocyc/index (dot) jsp];
ENZYME [expasy (dot) org/enzyme/];
Microarray Datasets were Downloaded from:
GEO (ncbi (dot) nlm (dot) nih (dot) gov/geo/);
TAIR (*Arabidopsis* (dot) org/);
Proprietary microarray data (WO2008/122980);
QTL and SNPs Information
Gramene [gramene (dot) org/qtl/];
Panzea [panzea (dot) org/index (dot) html];
Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (*arabidopsis*, rice, castorbean, grape, *brachypodium*, poplar, soybean, sorghum) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows: BLAST® search [BLAST® (dot) ncbi (dot) nlm (dot) nih (dot) gov/BLAST® (dot) cgi] against all plant UniProt [uniprot (dot) org/] sequences was performed. Open reading frames of each putative transcript were analyzed and longest ORF with higher number of homologues was selected as predicted protein of the transcript. The predicted proteins were analyzed by InterPro [ebi (dot) ac (dot) uk/interproa BLAST® against proteins from AraCyc and ENZYME databases was used to map the predicted transcripts to AraCyc pathways.

Predicted proteins from different species were compared using BLAST® algorithm [ncbi (dot) nlm (dot) nih (dot) gov/BLAST® (dot) cgi] to validate the accuracy of the predicted protein sequence, and for efficient detection of orthologs.

Gene expression profiling—Several data sources were exploited for gene expression profiling, namely microarray data and digital expression profile (see below).

According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc.). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomeic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [icugi (dot) org/] confirmed the accuracy of the sequencing and assembly. Expression patterns of selected genes fitted well their qRT-PCR data.

The genes listed in Table 1 below were identified to have a major impact on plant yield, seed yield, fiber yield, fiber quality, growth rate, photosynthetic capacity, vigor, biomass, growth rate, oil content, abiotic stress tolerance, nitrogen use efficiency, water use efficiency and/or fertilizer use efficiency when expression thereof is increased in plants. The identified genes, their curated polynucleotide and polypeptide sequences, their updated sequences according to Genbank database and the sequences of the cloned genes and proteins are summarized in Table 1, hereinbelow.

TABLE I

Identified genes for increasing yield, seed yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant Provided are the identified genes, their annotation, organism and polynucleotide and polypeptide sequence identifiers.

| Gene Name | Cluster Name | Organism | Polyn. SEQ ID NO: | Polyp. SEQ ID NO: |
|---|---|---|---|---|
| LBY16 | arabidopsis\|13v2\|AT1G22970 | arabidopsis | 1 | 552 |
| LBY17 | arabidopsis\|13v2\|AT2G33210 | arabidopsis | 2 | 553 |
| LBY18 | barley\|12v1\|AJ461405 | barley | 3 | 554 |
| LBY19 | barley\|12v1\|AJ480517 | barley | 4 | 555 |
| LBY20 | barley\|12v1\|AV833663 | barley | 5 | 556 |
| LBY21 | barley\|12v1\|BE602565 | barley | 6 | 557 |
| LBY22 | barley\|12v1\|BE603141 | barley | 7 | 558 |
| LBY23 | barley\|12v1\|BF260749 | barley | 8 | 559 |
| LBY24 | barley\|12v1\|BF623324 | barley | 9 | 560 |
| LBY25 | barley\|12v1\|BF628509 | barley | 10 | 561 |
| LBY26 | barley\|12v1\|BG309426 | barley | 11 | 562 |
| LBY27 | barley\|12v1\|BG414966 | barley | 12 | 563 |
| LBY28 | barley\|12v1\|BI947919 | barley | 13 | 564 |
| LBY29 | barley\|12v1\|BI950637 | barley | 14 | 565 |
| LBY30 | barley\|12v1\|BI957144 | barley | 15 | 566 |
| LBY31 | barley\|12v1\|BM370880 | barley | 16 | 567 |
| LBY32 | barley\|12v1\|BU981749 | barley | 17 | 568 |
| LBY33 | bean\|13v1\|CA912900 | bean | 18 | 569 |
| LBY34 | bean\|13v1\|HO799852 | bean | 19 | 570 |
| LBY35 | bean\|13v1\|SRR001335X308983 | bean | 20 | 571 |
| LBY36 | bean\|13v1\|SRR001335X369026 | bean | 21 | 572 |
| LBY37 | brachypodium\|13v2\|BRADI1G10360 | brachypodium | 22 | 573 |
| LBY39 | chlamydomonas\|13v1\|AF016902 | chlamydomonas | 23 | 574 |
| LBY40 | chlamydomonas\|13v1\|AV389131 | chlamydomonas | 24 | 575 |
| LBY41 | chlamydomonas\|13v1\|BE024238 | chlamydomonas | 25 | 576 |
| LBY42 | chlamydomonas\|13v1\|BE056699 | chlamydomonas | 26 | 577 |
| LBY43 | chlamydomonas\|13v1\|BE238232 | chlamydomonas | 27 | 578 |
| LBY44 | chlamydomonas\|13v1\|BG859395 | chlamydomonas | 28 | 579 |
| LBY45 | cotton\|11v1\|AI728213 | cotton | 29 | 580 |
| LBY46 | cotton\|11v1\|AW187962 | cotton | 30 | 581 |
| LBY47 | cotton\|11v1\|BE054714 | cotton | 31 | 582 |
| LBY48 | cotton\|11v1\|CA992719 | cotton | 32 | 583 |
| LBY49 | cotton\|11v1\|CD485858 | cotton | 33 | 584 |
| LBY50 | cotton\|11v1\|CO094458 | cotton | 34 | 585 |
| LBY51 | cotton\|11v1\|CO097155XX2 | cotton | 35 | 586 |
| LBY52 | cotton\|11v1\|DT048759XX2 | cotton | 36 | 587 |
| LBY53 | cotton\|11v1\|DT551860 | cotton | 37 | 588 |
| LBY54 | cotton\|11v1\|DT569254 | cotton | 38 | 589 |
| LBY55 | foxtail_millet\|13v2\|EC612531 | foxtail_millet | 39 | 590 |
| LBY56 | foxtail_millet\|13v2\|PHY7SI011949M | foxtail_millet | 40 | 591 |
| LBY57 | foxtail_millet\|13v2\|PHY7SI024118M | foxtail_millet | 41 | 592 |
| LBY58 | foxtail_millet\|13v2\|PHY7SI031876M | foxtail_millet | 42 | 593 |
| LBY59 | foxtail_millet\|13v2\|PHY7SI032418M | foxtail_millet | 43 | 594 |
| LBY61 | foxtail_millet\|13v2\|SRR350548X103005 | foxtail_millet | 44 | 595 |
| LBY62 | foxtail_millet\|13v2\|SRR350548X10518 | foxtail_millet | 45 | 596 |
| LBY63 | foxtail_millet\|13v2\|SRR350548X107681 | foxtail_millet | 46 | 597 |
| LBY64 | foxtail_millet\|13v2\|SRR350548X10799 | foxtail_millet | 47 | 598 |

TABLE I-continued

Identified genes for increasing yield, seed yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant Provided are the identified genes, their annotation, organism and polynucleotide and polypeptide sequence identifiers.

| Gene Name | Cluster Name | Organism | Polyn. SEQ ID NO: | Polyp. SEQ ID NO: |
|---|---|---|---|---|
| LBY65 | foxtail_millet|13v2|SRR350548X10909 | foxtail_millet | 48 | 599 |
| LBY66 | foxtail_millet|13v2|SRR350548X113858 | foxtail_millet | 49 | 600 |
| LBY67 | foxtail_millet|13v2|SRR350548X115271 | foxtail_millet | 50 | 601 |
| LBY68 | foxtail_millet|13v2|SRR350548X117047 | foxtail_millet | 51 | 602 |
| LBY69 | foxtail_millet|13v2|SRR350548X122695 | foxtail_millet | 52 | 603 |
| LBY70 | foxtail_millet|13v2|SRR350548X123794 | foxtail_millet | 53 | 604 |
| LBY71 | foxtail_millet|13v2|SRR350548X12932 | foxtail_millet | 54 | 605 |
| LBY72 | foxtail_millet|13v2|SRR350548X130312 | foxtail_millet | 55 | 606 |
| LBY73 | foxtail_millet|13v2|SRR350548X132820 | foxtail_millet | 56 | 607 |
| LBY74 | foxtail_millet|13v2|SRR350548X135074 | foxtail_millet | 57 | 608 |
| LBY75 | foxtail_millet|13v2|SRR350548X141269 | foxtail_millet | 58 | 609 |
| LBY76 | foxtail_millet|13v2|SRR350548X15437 | foxtail_millet | 59 | 610 |
| LBY77 | foxtail_millet|13v2|SRR350548X157828 | foxtail_millet | 60 | 611 |
| LBY78 | foxtail_millet|13v2|SRR350548X17296 | foxtail_millet | 61 | 612 |
| LBY79 | foxtail_millet|13v2|SRR350548X177567 | foxtail_millet | 62 | 613 |
| LBY80 | foxtail_millet|13v2|SRR350548X191757 | foxtail_millet | 63 | 614 |
| LBY81 | foxtail_millet|13v2|SRR350548X196210 | foxtail_millet | 64 | 615 |
| LBY82 | foxtail_millet|13v2|SRR350548X196859 | foxtail_millet | 65 | 616 |
| LBY83 | foxtail_millet|13v2|SRR350548X218671 | foxtail_millet | 66 | 617 |
| LBY84 | foxtail_millet|13v2|SRR350548X306788 | foxtail_millet | 67 | 618 |
| LBY85 | foxtail_millet|13v2|SRR350548X349819 | foxtail_millet | 68 | 619 |
| LBY86 | foxtail_millet|13v2|SRR350548X406093 | foxtail_millet | 69 | 620 |
| LBY87 | foxtail_millet|13v2|SRR350548X410798 | foxtail_millet | 70 | 621 |
| LBY88 | foxtail_millet|13v2|SRR350548X59197 | foxtail_millet | 71 | 622 |
| LBY89 | foxtail_millet|13v2|SRR350548X77704 | foxtail_millet | 72 | 623 |
| LBY90 | foxtail_millet|13v2|SRR350549X116153 | foxtail_millet | 73 | 624 |
| LBY91 | foxtail_millet|13v2|SRR350549X131202 | foxtail_millet | 74 | 625 |
| LBY92 | foxtail_millet|13v2|SRR350549X154401 | foxtail_millet | 75 | 626 |
| LBY93 | gossypium_raimondii|13v1|AI055109 | gossypium_raimondii | 76 | 627 |
| LBY94 | gossypium_raimondii|13v1|AW187415 | gossypium_raimondii | 77 | 628 |
| LBY95 | gossypium_raimondii|13v1|BG440368 | gossypium_raimondii | 78 | 629 |
| LBY96 | gossypium_raimondii|13v1|CA993797 | gossypium_raimondii | 79 | 630 |
| LBY97 | gossypium_raimondii|13v1|DW518098 | gossypium_raimondii | 80 | 631 |
| LBY98 | grape|13v1|GSVIVT01008767001 | grape | 81 | 632 |
| LBY99 | grape|13v1|GSVIVT01022545001 | grape | 82 | 633 |
| LBY100 | grape|13v1|GSVIVT01027185001 | grape | 83 | 634 |
| LBY102 | grape|13v1|GSVIVT01033774001 | grape | 84 | 635 |
| LBY103 | maize|13v2|AI391771 | maize | 85 | 636 |
| LBY104 | maize|13v2|AI391832 | maize | 86 | 637 |
| LBY105 | maize|13v2|AI629879 | maize | 87 | 638 |
| LBY106 | maize|13v2|AI629976 | maize | 88 | 639 |
| LBY107 | maize|13v2|AI649422 | maize | 89 | 640 |
| LBY108 | maize|13v2|AI665281 | maize | 90 | 641 |
| LBY109 | maize|13v2|AI714974 | maize | 91 | 642 |
| LBY110 | maize|13v2|AI783421 | maize | 92 | 643 |
| LBY111 | maize|13v2|AI857222 | maize | 93 | 644 |
| LBY112 | maize|13v2|AW066591 | maize | 94 | 645 |
| LBY113 | maize|13v2|BE511523 | maize | 95 | 646 |
| LBY114 | maize|13v2|BG320464 | maize | 96 | 647 |
| LBY115 | maize|13v2|BG836613 | maize | 97 | 648 |
| LBY116 | maize|13v2|BM416753 | maize | 98 | 649 |
| LBY117 | maize|13v2|BM895232 | maize | 99 | 650 |
| LBY118 | maize|13v2|CF648041 | maize | 100 | 651 |
| LBY119 | maize|13v2|DW918922 | maize | 101 | 652 |
| LBY120 | maize|13v2|W21655 | maize | 102 | 653 |
| LBY121 | maize|13v2|W21748 | maize | 103 | 654 |
| LBY122 | maize|13v2|W49461 | maize | 104 | 655 |
| LBY123 | maize|13v2|X81831 | maize | 105 | 656 |
| LBY125 | *medicago*|13v1|AW696074 | *medicago* | 106 | 657 |
| LBY126 | *medicago*|13v1|BG457785 | *medicago* | 107 | 658 |
| LBY127 | *medicago*|13v1|BQ147900 | *medicago* | 108 | 659 |
| LBY128 | peanut|13v1|EE125510 | peanut | 109 | 660 |
| LBY129 | peanut|13v1|ES722517 | peanut | 110 | 661 |
| LBY131 | *physcomitrella*|13v1|AW738860 | *physcomitrella* | 111 | 662 |
| LBY132 | pine|10v2|BM492830 | pine | 112 | 663 |
| LBY133 | *plantago*|11v2|SRR066373X397343 | *plantago* | 113 | 664 |
| LBY134 | poplar|13v1|AI164180 | poplar | 114 | 665 |
| LBY135 | potato|10v1|BE919981 | potato | 115 | 666 |
| LBY136 | potato|10v1|BF460221 | potato | 116 | 667 |
| LBY137 | potato|10v1|BG595100 | potato | 117 | 668 |
| LBY138 | rice|11v1|AU069467 | rice | 118 | 669 |
| LBY139 | rice|13v2|AA750185 | rice | 119 | 670 |

TABLE I-continued

Identified genes for increasing yield, seed yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant Provided are the identified genes, their annotation, organism and polynucleotide and polypeptide sequence identifiers.

| Gene Name | Cluster Name | Organism | Polyn. SEQ ID NO: | Polyp. SEQ ID NO: |
|---|---|---|---|---|
| LBY140 | rice|13v2|AA750741 | rice | 120 | 671 |
| LBY141 | rice|13v2|AU077650 | rice | 121 | 672 |
| LBY142 | rice|13v2|AU173280 | rice | 122 | 673 |
| LBY143 | rice|13v2|BI796376 | rice | 123 | 674 |
| LBY144 | rice|13v2|BQ907720 | rice | 124 | 675 |
| LBY145 | rice|13v2|C28519 | rice | 125 | 676 |
| LBY146 | rice|13v2|GFXAC018727X13 | rice | 126 | 677 |
| LBY147 | rice|13v2|GFXAC090120X15 | rice | 127 | 678 |
| LBY148 | sorghum|12v1|SB03G032710 | sorghum | 128 | 679 |
| LBY149 | sorghum|13v2|AI723863 | sorghum | 129 | 680 |
| LBY150 | sorghum|13v2|AI723986 | sorghum | 130 | 681 |
| LBY151 | sorghum|13v2|AI724085 | sorghum | 131 | 682 |
| LBY152 | sorghum|13v2|AI724262 | sorghum | 132 | 683 |
| LBY153 | sorghum|13v2|AW283496 | sorghum | 133 | 684 |
| LBY154 | sorghum|13v2|AW285663 | sorghum | 134 | 685 |
| LBY155 | sorghum|13v2|AW564408 | sorghum | 135 | 686 |
| LBY156 | sorghum|13v2|AW565627 | sorghum | 136 | 687 |
| LBY157 | sorghum|13v2|AW671774 | sorghum | 137 | 688 |
| LBY158 | sorghum|13v2|AW676719 | sorghum | 138 | 689 |
| LBY159 | sorghum|13v2|AW679798 | sorghum | 139 | 690 |
| LBY160 | sorghum|13v2|AW746324 | sorghum | 140 | 691 |
| LBY161 | sorghum|13v2|AW747557 | sorghum | 141 | 692 |
| LBY162 | sorghum|13v2|BE126058 | sorghum | 142 | 693 |
| LBY163 | sorghum|13v2|BE355844 | sorghum | 143 | 694 |
| LBY164 | sorghum|13v2|BE356001 | sorghum | 144 | 695 |
| LBY165 | sorghum|13v2|BE357267 | sorghum | 145 | 696 |
| LBY166 | sorghum|13v2|BE358756 | sorghum | 146 | 697 |
| LBY167 | sorghum|13v2|BE360790 | sorghum | 147 | 698 |
| LBY168 | sorghum|13v2|BE364917 | sorghum | 148 | 699 |
| LBY170 | sorghum|13v2|BE594760 | sorghum | 149 | 700 |
| LBY171 | sorghum|13v2|BE597213 | sorghum | 150 | 701 |
| LBY173 | sorghum|13v2|BF421040 | sorghum | 151 | 702 |
| LBY174 | sorghum|13v2|BF585682 | sorghum | 152 | 703 |
| LBY175 | sorghum|13v2|BF586554 | sorghum | 153 | 704 |
| LBY176 | sorghum|13v2|BG049624 | sorghum | 154 | 705 |
| LBY177 | sorghum|13v2|BG050660 | sorghum | 155 | 706 |
| LBY178 | sorghum|13v2|BG053630 | sorghum | 156 | 707 |
| LBY179 | sorghum|13v2|BG411492 | sorghum | 157 | 708 |
| LBY180 | sorghum|13v2|BG488154 | sorghum | 158 | 709 |
| LBY181 | sorghum|13v2|BM322245 | sorghum | 159 | 710 |
| LBY182 | sorghum|13v2|CD222102 | sorghum | 160 | 711 |
| LBY183 | sorghum|13v2|CD223986 | sorghum | 161 | 712 |
| LBY184 | sorghum|13v2|CD224850 | sorghum | 162 | 713 |
| LBY185 | sorghum|13v2|CD226020 | sorghum | 163 | 714 |
| LBY186 | sorghum|13v2|CD227545 | sorghum | 164 | 715 |
| LBY187 | sorghum|13v2|CD431650 | sorghum | 165 | 716 |
| LBY188 | sorghum|13v2|CF757269 | sorghum | 166 | 717 |
| LBY189 | sorghum|13v2|CF760555 | sorghum | 167 | 718 |
| LBY190 | sorghum|13v2|CF761959 | sorghum | 168 | 719 |
| LBY191 | sorghum|13v2|XM_002441241 | sorghum | 169 | 720 |
| LBY192 | sorghum|13v2|XM_002457915 | sorghum | 170 | 721 |
| LBY193 | soybean|13v2|GLYMAO5G343 | soybean | 171 | 722 |
| LBY194 | soybean|13v2|GLYMA15G306 | soybean | 172 | 723 |
| LBY195 | soybean|13v2|GLYMA19G40920T2 | soybean | 173 | 724 |
| LBY196 | spruce|11v1|ES252179 | spruce | 174 | 725 |
| LBY197 | sunflower|12v1|AJ829034 | sunflower | 175 | 726 |
| LBY199 | sunflower|12v1|BU021733 | sunflower | 176 | 727 |
| LBY200 | sunflower|12v1|CD847948 | sunflower | 177 | 728 |
| LBY201 | sunflower|12v1|CD852615 | sunflower | 178 | 729 |
| LBY202 | sunflower|12v1|CD853598 | sunflower | 179 | 730 |
| LBY203 | sunflower|12v1|CX948055 | sunflower | 180 | 731 |
| LBY204 | sunflower|12v1|DY904031 | sunflower | 181 | 732 |
| LBY205 | sunflower|12v1|DY904769 | sunflower | 182 | 733 |
| LBY206 | sunflower|12v1|DY914980 | sunflower | 183 | 734 |
| LBY207 | sunflower|12v1|DY918107 | sunflower | 184 | 735 |
| LBY208 | sunflower|12v1|DY928062 | sunflower | 185 | 736 |
| LBY209 | sunflower|12v1|EE609275 | sunflower | 186 | 737 |
| LBY210 | sunflower|12v1|EE613413 | sunflower | 187 | 738 |
| LBY211 | sunflower|12v1|EE625930 | sunflower | 188 | 739 |
| LBY212 | tomato|13v1|BG123297 | tomato | 189 | 740 |
| LBY213 | tomato|13v1|BG129885 | tomato | 190 | 741 |
| LBY214 | wheat|12v3|AL820463 | wheat | 191 | 742 |

TABLE I-continued

Identified genes for increasing yield, seed yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant Provided are the identified genes, their annotation, organism and polynucleotide and polypeptide sequence identifiers.

| Gene Name | Cluster Name | Organism | Polyn. SEQ ID NO: | Polyp. SEQ ID NO: |
|---|---|---|---|---|
| LBY215 | wheat\|12v3\|AL821230 | wheat | 192 | 743 |
| LBY216 | wheat\|12v3\|BE402170 | wheat | 193 | 744 |
| LBY217 | wheat\|12v3\|BE402302 | wheat | 194 | 745 |
| LBY218 | wheat\|12v3\|BE413931 | wheat | 195 | 746 |
| LBY219 | wheat\|12v3\|BE415435 | wheat | 196 | 747 |
| LBY220 | wheat\|12v3\|BE419175 | wheat | 197 | 748 |
| LBY221 | wheat\|12v3\|BE419414 | wheat | 198 | 749 |
| LBY222 | wheat\|12v3\|BE422621 | wheat | 199 | 750 |
| LBY224 | wheat\|12v3\|BE442666 | wheat | 200 | 751 |
| LBY225 | wheat\|12v3\|BE446154 | wheat | 201 | 752 |
| LBY227 | wheat\|12v3\|BE515516 | wheat | 202 | 753 |
| LBY228 | wheat\|12v3\|BE516296 | wheat | 203 | 754 |
| LBY230 | wheat\|12v3\|CA608701 | wheat | 204 | 755 |
| LBY231 | wheat\|12v3\|CA662849 | wheat | 205 | 756 |
| LBY232 | wheat\|12v3\|CA706141 | wheat | 206 | 757 |
| LBY233 | maize\|13v2\|AI939887 | maize | 207 | 758 |
| LBY106_H3 | maize\|13v2\|BG320823 | maize | 208 | 759 |
| LBY119_H1 | sorghum\|13v2\|XM_002458388 | sorghum | 209 | 760 |
| LBY219_H9 | rice\|13v2\|BM422078 | rice | 210 | 761 |
| LBY27_H4 | maize\|13v2\|BE050333 | maize | 211 | 762 |
| LBY34_H2 | soybean\|13v2\|GLYMA09G42190 | soybean | 212 | 763 |
| LGN1 | wheat\|12v3\|BE405890 | wheat | 213 | 764 |
| LGN2 | soybean\|12v1\|GLYMA16G27050 | soybean | 214 | 765 |
| LGN3 | sorghum\|13v2\|CN131173 | sorghum | 215 | 766 |
| LGN4 | sorghum\|13v2\|BF587229 | sorghum | 216 | 767 |
| LGN5 | sorghum\|13v2\|BI643690 | sorghum | 217 | 768 |
| LGN6 | sorghum\|13v2\|BE598356 | sorghum | 218 | 769 |
| LGN7 | sorghum\|13v2\|BE363875 | sorghum | 219 | 770 |
| LGN9 | rice\|gb170\|OS02G48000 | rice | 220 | 771 |
| LGN13 | rice\|11v1\|CV722121 | rice | 221 | 772 |
| LGN14 | rice\|11v1\|CB663201 | rice | 222 | 773 |
| LGN17 | maize\|13v2\|CF647382 | maize | 223 | 774 |
| LGN18 | maize\|13v2\|AW562670 | maize | 224 | 775 |
| LGN20 | maize\|13v2\|AI920382 | maize | 225 | 776 |
| LGN23 | maize\|10v1\|CF011727 | maize | 226 | 777 |
| LGN24 | maize\|10v1\|CD943107 | maize | 227 | 778 |
| LGN26 | maize\|10v1\|BE051266 | maize | 228 | 779 |
| LGN33 | maize\|10v1\|AI857219 | maize | 229 | 780 |
| LGN34 | maize\|10v1\|AI691183 | maize | 230 | 781 |
| LGN35 | maize\|10v1\|AI668189 | maize | 231 | 782 |
| LGN36 | maize\|10v1\|AI666136 | maize | 232 | 783 |
| LGN39 | maize\|10v1\|AA979848 | maize | 233 | 784 |
| LGN40 | cotton\|11v1\|BG446873 | cotton | 234 | 785 |
| LGN41 | brachypodium\|12v1\|BRADI1G64560 | brachypodium | 235 | 786 |
| LGN42 | barley\|12v1\|BI951707 | barley | 236 | 787 |
| LGN43 | barley\|12v1\|BI946826 | barley | 237 | 788 |
| LGN44 | barley\|12v1\|BF626012 | barley | 238 | 789 |
| LGN45 | barley\|12v1\|BF624588 | barley | 239 | 790 |
| LGN46 | barley\|12v1\|BF619715 | barley | 240 | 791 |
| LGN47 | barley\|10v2\|BI948139 | barley | 241 | 792 |
| LGN48 | barley\|10v2\|AV833757 | barley | 242 | 793 |
| LGN49 | maize\|10v1\|AI901839 | maize | 243 | 794 |
| LGN52 | foxtail_millet\|11v3\|SOLX00022696 | foxtail_millet | 244 | 795 |
| LGN54 | sorghum\|12v1\|SB01G028500 | sorghum | 245 | 796 |
| LGN57 | sorghum\|13v2\|BE596729 | sorghum | 246 | 797 |
| LGN60 | foxtail_millet\|13v2\|SRR350548X10009 | foxtail_millet | 247 | 798 |
| LGN61 | maize\|13v2\|AI941989 | maize | 248 | 799 |
| LGN62 | maize\|13v2\|CF626471 | maize | 249 | 800 |
| LGN62_H2 | foxtail_millet\|13v2\|SRR350548X213481 | foxtail_millet | 250 | 801 |
| LBY1 | barley\|12v1\|BU976513 | barley | 251 | — |
| LBY2 | cotton\|11v1\|DW509834XX1 | cotton | 252 | — |
| LBY3 | foxtail_millet\|11v3\|PHY7SI024106M | foxtail_millet | 253 | — |
| LBY4 | gossypium_raimondii\|13v1\|GR13V1PRD019042 | gossypium_raimondii | 254 | — |
| LBY5 | maize\|13v2\|AI001271 | maize | 255 | — |
| LBY6 | maize\|13v2\|BQ528930 | maize | 256 | — |
| LBY10 | maize\|13v2\|EXP1208S11302X009072496D1 | maize | 257 | — |
| LBY12 | maize\|13v2\|SRR014549X246688 | maize | 258 | — |
| LBY13 | maize\|13v2\|SRR014549X57533 | maize | 259 | — |
| LBY14 | sorghum\|13v2\|BE359338 | sorghum | 260 | — |
| LBY15 | maize\|13v2\|ZM13V1RFAM401 | maize | 261 | — |

TABLE I-continued

Identified genes for increasing yield, seed yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant Provided are the identified genes, their annotation, organism and polynucleotide and polypeptide sequence identifiers.

| Gene Name | Cluster Name | Organism | Polyn. SEQ ID NO: | Polyp. SEQ ID NO: |
|---|---|---|---|---|
| LBY216 | wheat\|12v3\|BE402170 | wheat | 193 | 813 |
| LBY20 | barley\|12v1\|AV833663 | barley | 262 | 556 |
| LBY33 | bean\|13v1\|CA912900 | bean | 263 | 802 |
| LBY36 | bean\|13v1\|SRR001335X369026 | bean | 264 | 803 |
| LBY43 | chlamydomonas\|13v1\|BE238232 | chlamydomonas | 265 | 804 |
| LBY52 | cotton\|11v1\|DT048759XX2 | cotton | 266 | 805 |
| LBY61 | foxtail_millet\|13v2\|SRR350548X103005 | foxtail_millet | 267 | 595 |
| LBY68 | foxtail_millet\|13v2\|SRR350548X117047 | foxtail_millet | 268 | 602 |
| LBY69 | foxtail_millet\|13v2\|SRR350548X122695 | foxtail_millet | 269 | 806 |
| LBY70 | foxtail_millet\|13v2\|SRR350548X123794 | foxtail_millet | 270 | 604 |
| LBY72 | foxtail_millet\|13v2\|SRR350548X130312 | foxtail_millet | 271 | 606 |
| LBY73 | foxtail_millet\|13v2\|SRR350548X132820 | foxtail_millet | 272 | 807 |
| LBY74 | foxtail_millet\|13v2\|SRR350548X135074 | foxtail_millet | 273 | 608 |
| LBY80 | foxtail_millet\|13v2\|SRR350548X191757 | foxtail_millet | 274 | 808 |
| LBY84 | foxtail_millet\|13v2\|SRR350548X306788 | foxtail_millet | 275 | 618 |
| LBY86 | foxtail_millet\|13v2\|SRR350548X406093 | foxtail_millet | 276 | 620 |
| LBY92 | foxtail_millet\|13v2\|SRR350549X154401 | foxtail_millet | 277 | 809 |
| LBY93 | gossypium_raimondii\|13v1\|AI055109 | gossypium_raimondii | 278 | 627 |
| LBY95 | gossypium_raimondii\|13v1\|BG440368 | gossypium_raimondii | 279 | 629 |
| LBY106 | maize\|13v2\|A1629976 | maize | 280 | 639 |
| LBY135 | potato\|10v1\|BE919981 | potato | 281 | 666 |
| LBY140 | rice\|13v2\|AA750741 | rice | 282 | 671 |
| LBY145 | rice\|13v1\|C28519 | rice | 283 | 676 |
| LBY151 | sorghum\|13v2\|AI724085 | sorghum | 284 | 682 |
| LBY156 | sorghum\|13v2\|AW565627 | sorghum | 285 | 687 |
| LBY157 | sorghum\|13v2\|AW671774 | sorghum | 286 | 688 |
| LBY159 | sorghum\|13v2\|AW679798 | sorghum | 287 | 810 |
| LBY165 | sorghum\|13v2\|BE357267 | sorghum | 288 | 696 |
| LBY178 | sorghum\|13v2\|BG053630 | sorghum | 289 | 707 |
| LBY201 | sunflower\|12v1\|CD852615 | sunflower | 290 | 729 |
| LBY204 | sunflower\|12v1\|DY904031 | sunflower | 291 | 811 |
| LBY206 | sunflower\|12v1\|DY914980 | sunflower | 292 | 734 |
| LBY208 | sunflower\|12v1\|DY928062 | sunflower | 293 | 812 |
| LBY215 | wheat\|12v3\|AL821230 | wheat | 294 | 743 |
| LBY106_H3 | maize\|13v2\|BG320823 | maize | 295 | 759 |
| LBY119_H1 | sorghum\|13v2\|XM_002458388 | sorghum | 296 | 814 |
| LBY219_H9 | rice\|13v2\|BM422078 | rice | 297 | 761 |
| LBY27_H4 | maize\|13v2\|BE050333 | maize | 298 | 815 |
| LBY34_H2 | soybean\|13v2\|GLYMA09G42190 | soybean | 299 | 763 |
| LGN1 | wheat\|12v3\|BE405890 | wheat | 300 | 764 |
| LGN18 | maize\|13v2\|AW562670 | maize | 301 | 816 |
| LGN23 | maize\|10v1\|CF011727 | maize | 302 | 777 |
| LGN42 | barley\|12v1\|BI951707 | barley | 303 | 787 |
| LGN62_H2 | foxtail_millet\|13v2\|SRR350548X213481 | foxtail_millet | 304 | 801 |
| LBY2 | cotton\|11v1\|DW509834XX1 | cotton | 305 | — |
| LBY3 | foxtail_millet\|11v3\|PHY7SI024106M | foxtail_millet | 306 | — |
| LBY4 | gossypium_raimondii\|13v1\|GR13V1PRD019042 | gossypium_raimondii | 307 | — |
| LBY5 | maize\|13v2\|AI001271 | maize | 308 | — |
| LBY6 | maize\|13v2\|BQ528930 | maize | 309 | — |
| LBY14 | sorghum\|13v2\|BE359338 | sorghum | 310 | — |
| LBY15 | maize\|13v2\|ZM13V1RFAM401 | maize | 261 | — |
| LBY16 | arabidopsis\|13v2\|AT1G22970 | arabidopsis | 311 | 552 |
| LBY17 | arabidopsis\|13v2\|AT2G33210 | arabidopsis | 312 | 553 |
| LBY18 | barley\|12v1\|AJ461405 | barley | 313 | 554 |
| LBY20 | barley\|12v1\|AV833663 | barley | 314 | 817 |
| LBY21 | barley\|12v1\|BE602565 | barley | 315 | 557 |
| LBY22 | barley\|12v1\|BE603141 | barley | 316 | 558 |
| LBY23 | barley\|12v1\|BF260749 | barley | 317 | 559 |
| LBY24 | barley\|12v1\|BF623324 | barley | 318 | 818 |
| LBY25 | barley\|12v1\|BF628509 | barley | 319 | 561 |
| LBY26 | barley\|12v1\|BG309426 | barley | 320 | 562 |
| LBY28 | barley\|12v1\|BI947919 | barley | 321 | 819 |
| LBY29 | barley\|12v1\|BI950637 | barley | 322 | 565 |
| LBY30 | barley\|12v1\|BI957144 | barley | 323 | 566 |
| LBY31 | barley\|12v1\|BM370880 | barley | 324 | 820 |
| LBY32 | barley\|12v1\|BU981749 | barley | 325 | 568 |
| LBY33 | bean\|13v1\|CA912900 | bean | 326 | 821 |
| LBY35 | bean\|13v1\|SRR001335X308983 | bean | 327 | 822 |
| LBY36 | bean\|13v1\|SRR001335X369026 | bean | 328 | 823 |
| LBY37 | brachypodium\|13v2\|BRADI1G10360 | brachypodium | 329 | 573 |
| LBY39 | chlamydomonas\|13v1\|AF016902 | chlamydomonas | 330 | 574 |

TABLE I-continued

Identified genes for increasing yield, seed yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant Provided are the identified genes, their annotation, organism and polynucleotide and polypeptide sequence identifiers.

| Gene Name | Cluster Name | Organism | Polyn. SEQ ID NO: | Polyp. SEQ ID NO: |
|---|---|---|---|---|
| LBY40 | chlamydomonas|13v1|AV389131 | chlamydomonas | 331 | 575 |
| LBY41 | chlamydomonas|13v1|BE024238 | chlamydomonas | 332 | 576 |
| LBY43 | chlamydomonas|13v1|BE238232 | chlamydomonas | 333 | 578 |
| LBY44 | chlamydomonas|13v1|BG859395 | chlamydomonas | 334 | 579 |
| LBY45 | cotton|11v1|AI728213 | cotton | 335 | 580 |
| LBY46 | cotton|11v1|AW187962 | cotton | 336 | 824 |
| LBY47 | cotton|11v1|BE054714 | cotton | 337 | 825 |
| LBY48 | cotton|11v1|CA992719 | cotton | 338 | 826 |
| LBY49 | cotton|11v1|CD485858 | cotton | 339 | 827 |
| LBY50 | cotton|11v1|CO094458 | cotton | 340 | 828 |
| LBY51 | cotton|11v1|CO097155XX2 | cotton | 341 | 586 |
| LBY52 | cotton|11v1|DT048759XX2 | cotton | 342 | 829 |
| LBY53 | cotton|11v1|DT551860 | cotton | 343 | 830 |
| LBY54 | cotton|11v1|DT569254 | cotton | 344 | 589 |
| LBY55 | foxtail_millet|13v2|EC612531 | foxtail_millet | 345 | 590 |
| LBY56 | foxtail_millet|13v2|PHY7SI011949M | foxtail_millet | 346 | 591 |
| LBY57 | foxtail_millet|13v2|PHY7SI024118M | foxtail_millet | 347 | 592 |
| LBY58 | foxtail_millet|13v2|PHY7SI031876M | foxtail_millet | 348 | 593 |
| LBY59 | foxtail_millet|13v2|PHY7SI032418M | foxtail_millet | 349 | 594 |
| LBY61 | foxtail_millet|13v2|SRR350548X103005 | foxtail_millet | 350 | 595 |
| LBY62 | foxtail_millet|13v2|SRR350548X10518 | foxtail_millet | 351 | 596 |
| LBY63 | foxtail_millet|13v2|SRR350548X107681 | foxtail_millet | 352 | 597 |
| LBY64 | foxtail_millet|13v2|SRR350548X10799 | foxtail_millet | 353 | 598 |
| LBY65 | foxtail_millet|13v2|SRR350548X10909 | foxtail_millet | 354 | 599 |
| LBY66 | foxtail_millet|13v2|SRR350548X113858 | foxtail_millet | 355 | 600 |
| LBY68 | foxtail_millet|13v2|SRR350548X117047 | foxtail_millet | 356 | 602 |
| LBY69 | foxtail_millet|13v2|SRR350548X122695 | foxtail_millet | 357 | 831 |
| LBY70 | foxtail_millet|13v2|SRR350548X123794 | foxtail_millet | 358 | 604 |
| LBY71 | foxtail_millet|13v2|SRR350548X12932 | foxtail_millet | 359 | 605 |
| LBY72 | foxtail_millet|13v2|SRR350548X130312 | foxtail_millet | 360 | 832 |
| LBY73 | foxtail_millet|13v2|SRR350548X132820 | foxtail_millet | 361 | 607 |
| LBY74 | foxtail_millet|13v2|SRR350548X135074 | foxtail_millet | 362 | 833 |
| LBY75 | foxtail_millet|13v2|SRR350548X141269 | foxtail_millet | 363 | 609 |
| LBY76 | foxtail_millet|13v2|SRR350548X15437 | foxtail_millet | 364 | 610 |
| LBY77 | foxtail_millet|13v2|SRR350548X157828 | foxtail_millet | 365 | 611 |
| LBY78 | foxtail_millet|13v2|SRR350548X17296 | foxtail_millet | 366 | 612 |
| LBY79 | foxtail_millet|13v2|SRR350548X177567 | foxtail_millet | 367 | 613 |
| LBY80 | foxtail_millet|13v2|SRR350548X191757 | foxtail_millet | 368 | 614 |
| LBY81 | foxtail_millet|13v2|SRR350548X196210 | foxtail_millet | 369 | 615 |
| LBY82 | foxtail_millet|13v2|SRR350548X196859 | foxtail_millet | 370 | 616 |
| LBY83 | foxtail_millet|13v2|SRR350548X218671 | foxtail_millet | 371 | 617 |
| LBY84 | foxtail_millet|13v2|SRR350548X306788 | foxtail_millet | 372 | 618 |
| LBY85 | foxtail_millet|13v2|SRR350548X349819 | foxtail_millet | 373 | 619 |
| LBY86 | foxtail_millet|13v2|SRR350548X406093 | foxtail_millet | 374 | 620 |
| LBY87 | foxtail_millet|13v2|SRR350548X410798 | foxtail_millet | 375 | 621 |
| LBY88 | foxtail_millet|13v2|SRR350548X59197 | foxtail_millet | 376 | 622 |
| LBY89 | foxtail_millet|13v2|SRR350548X77704 | foxtail_millet | 377 | 623 |
| LBY90 | foxtail_millet|13v2|SRR350549X116153 | foxtail_millet | 378 | 624 |
| LBY91 | foxtail_millet|13v2|SRR350549X131202 | foxtail_millet | 379 | 625 |
| LBY92 | foxtail_millet|13v2|SRR350549X154401 | foxtail_millet | 380 | 626 |
| LBY93 | gossypium_raimondii|13v1|AI055109 | gossypium_raimondii | 381 | 834 |
| LBY94 | gossypium_raimondii|13v1|AW187415 | gossypium_raimondii | 382 | 835 |
| LBY95 | gossypium_raimondii|13v1|BG440368 | gossypium_raimondii | 383 | 836 |
| LBY96 | gossypium_raimondii|13v1|CA993797 | gossypium_raimondii | 384 | 630 |
| LBY97 | gossypium_raimondii|13v1|DW518098 | gossypium_raimondii | 385 | 837 |
| LBY98 | grape|13v1|GSVIVT01008767001 | grape | 386 | 632 |
| LBY99 | grape|13v1|GSVIVT01022545001 | grape | 387 | 633 |
| LBY100 | grape|13v1|GSVIVT01027185001 | grape | 388 | 634 |
| LBY102 | grape|13v1|GSVIVT01033774001 | grape | 389 | 635 |
| LBY103 | maize|13v2|AI391771 | maize | 390 | 636 |
| LBY104 | maize|13v2|AI391832 | maize | 391 | 637 |
| LBY105 | maize|13v2|AI629879 | maize | 392 | 638 |
| LBY107 | maize|13v2|AI649422 | maize | 393 | 640 |
| LBY108 | maize|13v2|AI665281 | maize | 394 | 838 |
| LBY109 | maize|13v2|AI714974 | maize | 395 | 642 |
| LBY110 | maize|13v2|AI783421 | maize | 396 | 643 |
| LBY111 | maize|13v2|AI857222 | maize | 397 | 644 |

TABLE I-continued

Identified genes for increasing yield, seed yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant Provided are the identified genes, their annotation, organism and polynucleotide and polypeptide sequence identifiers.

| Gene Name | Cluster Name | Organism | Polyn. SEQ ID NO: | Polyp. SEQ ID NO: |
|---|---|---|---|---|
| LBY112 | maize\|13v2\|AW066591 | maize | 398 | 645 |
| LBY113 | maize\|13v2\|BE511523 | maize | 399 | 646 |
| LBY114 | maize\|13v2\|BG320464 | maize | 400 | 647 |
| LBY115 | maize\|13v2\|BG836613 | maize | 401 | 648 |
| LBY116 | maize\|13v2\|BM416753 | maize | 402 | 839 |
| LBY117 | maize\|13v2\|BM895232 | maize | 403 | 650 |
| LBY118 | maize\|13v2\|CF648041 | maize | 404 | 651 |
| LBY120 | maize\|13v2\|W21655 | maize | 405 | 840 |
| LBY121 | maize\|13v2\|W21748 | maize | 406 | 841 |
| LBY122 | maize\|13v2\|W49461 | maize | 407 | 842 |
| LBY123 | maize\|13v2\|X81831 | maize | 408 | 656 |
| LBY125 | medicago\|13v1\|AW696074 | medicago | 409 | 657 |
| LBY126 | medicago\|13v1\|BG457785 | medicago | 410 | 658 |
| LBY127 | medicago\|13v1\|BQ147900 | medicago | 411 | 843 |
| LBY128 | peanut\|13v1\|EE125510 | peanut | 412 | 660 |
| LBY129 | peanut\|13v1\|ES722517 | peanut | 413 | 661 |
| LBY132 | pine\|10v2\|BM492830 | pine | 414 | 663 |
| LBY133 | plantago\|11v2\|SRR066373X397343 | plantago | 415 | 664 |
| LBY134 | poplar\|13v1\|AI164180 | poplar | 416 | 665 |
| LBY135 | potato\|10v1\|BE919981 | potato | 417 | 666 |
| LBY136 | potato\|10v1\|BF460221 | potato | 418 | 844 |
| LBY137 | potato\|10v1\|BG595100 | potato | 419 | 845 |
| LBY138 | rice\|11v1\|AU069467 | rice | 420 | 669 |
| LBY139 | rice\|13v2\|AA750185 | rice | 421 | 846 |
| LBY140 | rice\|13v2\|AA750741 | rice | 422 | 671 |
| LBY141 | rice\|13v2\|AU077650 | rice | 423 | 672 |
| LBY142 | rice\|13v2\|AU173280 | rice | 424 | 673 |
| LBY143 | rice\|13v2\|BI796376 | rice | 425 | 674 |
| LBY144 | rice\|13v2\|BQ907720 | rice | 426 | 847 |
| LBY145 | rice\|13v2\|C28519 | rice | 427 | 676 |
| LBY146 | rice\|13v2\|GFXAC018727X13 | rice | 428 | 848 |
| LBY148 | sorghum\|12v1\|SB03G032710 | sorghum | 429 | 679 |
| LBY149 | sorghum\|13v2\|AI723863 | sorghum | 430 | 680 |
| LBY150 | sorghum\|13v2\|AI723986 | sorghum | 431 | 681 |
| LBY151 | sorghum\|13v2\|AI724085 | sorghum | 432 | 682 |
| LBY152 | sorghum\|13v2\|AI724262 | sorghum | 433 | 683 |
| LBY153 | sorghum\|13v2\|AW283496 | sorghum | 434 | 684 |
| LBY154 | sorghum\|13v2\|AW285663 | sorghum | 435 | 685 |
| LBY155 | sorghum\|13v2\|AW564408 | sorghum | 436 | 849 |
| LBY156 | sorghum\|13v2\|AW565627 | sorghum | 437 | 850 |
| LBY157 | sorghum\|13v2\|AW671774 | sorghum | 438 | 688 |
| LBY158 | sorghum\|13v2\|AW676719 | sorghum | 439 | 851 |
| LBY159 | sorghum\|13v2\|AW679798 | sorghum | 440 | 690 |
| LBY160 | sorghum\|13v2\|AW746324 | sorghum | 441 | 691 |
| LBY161 | sorghum\|13v2\|AW747557 | sorghum | 442 | 692 |
| LBY162 | sorghum\|13v2\|BE126058 | sorghum | 443 | 693 |
| LBY163 | sorghum\|13v2\|BE355844 | sorghum | 444 | 694 |
| LBY164 | sorghum\|13v2\|BE356001 | sorghum | 445 | 852 |
| LBY165 | sorghum\|13v2\|BE357267 | sorghum | 446 | 853 |
| LBY166 | sorghum\|13v2\|BE358756 | sorghum | 447 | 697 |
| LBY167 | sorghum\|13v2\|BE360790 | sorghum | 448 | 698 |
| LBY170 | sorghum\|13v2\|BE594760 | sorghum | 449 | 700 |
| LBY171 | sorghum\|13v2\|BE597213 | sorghum | 450 | 701 |
| LBY173 | sorghum\|13v2\|BF421040 | sorghum | 451 | 702 |
| LBY174 | sorghum\|13v2\|BF585682 | sorghum | 452 | 703 |
| LBY175 | sorghum\|13v2\|BF586554 | sorghum | 453 | 704 |
| LBY176 | sorghum\|13v2\|BG049624 | sorghum | 454 | 705 |
| LBY177 | sorghum\|13v2\|BG050660 | sorghum | 455 | 706 |
| LBY178 | sorghum\|13v2\|BG053630 | sorghum | 456 | 707 |
| LBY179 | sorghum\|13v2\|BG411492 | sorghum | 457 | 708 |
| LBY180 | sorghum\|13v2\|BG488154 | sorghum | 458 | 854 |
| LBY181 | sorghum\|13v2\|BM322245 | sorghum | 459 | 855 |
| LBY182 | sorghum\|13v2\|CD222102 | sorghum | 460 | 856 |
| LBY183 | sorghum\|13v2\|CD223986 | sorghum | 461 | 712 |
| LBY184 | sorghum\|13v2\|CD224850 | sorghum | 462 | 713 |
| LBY185 | sorghum\|13v2\|CD226020 | sorghum | 463 | 857 |
| LBY186 | sorghum\|13v2\|CD227545 | sorghum | 464 | 715 |
| LBY187 | sorghum\|13v2\|CD431650 | sorghum | 465 | 858 |
| LBY188 | sorghum\|13v2\|CF757269 | sorghum | 466 | 717 |
| LBY190 | sorghum\|13v2\|CF761959 | sorghum | 467 | 719 |
| LBY191 | sorghum\|13v2\|XM_002441241 | sorghum | 468 | 720 |
| LBY192 | sorghum\|13v2\|XM_002457915 | sorghum | 469 | 859 |

TABLE I-continued

Identified genes for increasing yield, seed yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant Provided are the identified genes, their annotation, organism and polynucleotide and polypeptide sequence identifiers.

| Gene Name | Cluster Name | Organism | Polyn. SEQ ID NO: | Polyp. SEQ ID NO: |
|---|---|---|---|---|
| LBY193 | soybean\|13v2\|GLYMA05G34360 | soybean | 470 | 860 |
| LBY194 | soybean\|13v2\|GLYMA15G30610 | soybean | 471 | 723 |
| LBY195 | soybean\|13v2\|GLYMA19G40920T2 | soybean | 472 | 861 |
| LBY196 | spruce\|11v1\|ES252179 | spruce | 473 | 725 |
| LBY197 | sunflower\|12v1\|AJ829034 | sunflower | 474 | 726 |
| LBY199 | sunflower\|12v1\|BU021733 | sunflower | 475 | 862 |
| LBY200 | sunflower\|12v1\|CD847948 | sunflower | 476 | 863 |
| LBY201 | sunflower\|12v1\|CD852615 | sunflower | 477 | 864 |
| LBY202 | sunflower\|12v1\|CD853598 | sunflower | 478 | 865 |
| LBY203 | sunflower\|12v1\|CX948055 | sunflower | 479 | 866 |
| LBY204 | sunflower\|12v1\|DY904031 | sunflower | 480 | 732 |
| LBY205 | sunflower\|12v1\|DY904769 | sunflower | 481 | 867 |
| LBY206 | sunflower\|12v1\|DY914980 | sunflower | 482 | 868 |
| LBY207 | sunflower\|12v1\|DY918107 | sunflower | 483 | 869 |
| LBY208 | sunflower\|12v1\|DY928062 | sunflower | 484 | 736 |
| LBY209 | sunflower\|12v1\|EE609275 | sunflower | 485 | 870 |
| LBY210 | sunflower\|12v1\|EE613413 | sunflower | 486 | 871 |
| LBY211 | sunflower\|12v1\|EE625930 | sunflower | 487 | 872 |
| LBY212 | tomato\|13v1\|BG123297 | tomato | 488 | 873 |
| LBY213 | tomato\|13v1\|BG129885 | tomato | 489 | 874 |
| LBY214 | wheat\|12v3\|AL820463 | wheat | 490 | 742 |
| LBY216 | wheat\|12v3\|BE402170 | wheat | 491 | 875 |
| LBY217 | wheat\|12v3\|BE402302 | wheat | 492 | 876 |
| LBY218 | wheat\|12v3\|BE413931 | wheat | 493 | 877 |
| LBY220 | wheat\|12v3\|BE419175 | wheat | 494 | 748 |
| LBY221 | wheat\|12v3\|BE419414 | wheat | 495 | 749 |
| LBY222 | wheat\|12v3\|BE422621 | wheat | 496 | 878 |
| LBY224 | wheat\|12v3\|BE442666 | wheat | 497 | 751 |
| LBY225 | wheat\|12v3\|BE446154 | wheat | 498 | 879 |
| LBY227 | wheat\|12v3\|BE515516 | wheat | 499 | 753 |
| LBY228 | wheat\|12v3\|BE516296 | wheat | 500 | 880 |
| LBY230 | wheat\|12v3\|CA608701 | wheat | 501 | 881 |
| LBY231 | wheat\|12v3\|CA662849 | wheat | 502 | 882 |
| LBY232 | wheat\|12v3\|CA706141 | wheat | 503 | 883 |
| LBY233 | maize\|13v2\|AI939887 | maize | 504 | 758 |
| LBY106_H3 | maize\|13v2\|BG320823 | maize | 505 | 884 |
| LBY119_H1 | *sorghum*\|13v2\|XM_002458388 | *sorghum* | 506 | 885 |
| LBY219_H9 | rice\|13v2\|BM422078 | rice | 507 | 761 |
| LBY27_H4 | maize\|13v2\|BE050333 | maize | 508 | 762 |
| LBY34_H2 | soybean\|13v2\|GLYMA09G42190 | soybean | 509 | 763 |
| LGN1 | wheat\|12v3\|BE405890 | wheat | 510 | 764 |
| LGN2 | soybean\|12v1\|GLYMA16G27050 | soybean | 511 | 765 |
| LGN3 | *sorghum*\|13v2\|CN131173 | *sorghum* | 512 | 766 |
| LGN4 | *sorghum*\|13v2\|BF587229 | *sorghum* | 513 | 767 |
| LGN5 | *sorghum*\|13v2\|BI643690 | *sorghum* | 514 | 768 |
| LGN6 | *sorghum*\|13v2\|BE598356 | *sorghum* | 515 | 769 |
| LGN7 | *sorghum*\|13v2\|BE363875 | *sorghum* | 516 | 770 |
| LGN9 | rice\|gb170\|OS02G48000 | rice | 517 | 771 |
| LGN13 | rice\|11v1\|CV722121 | rice | 518 | 772 |
| LGN14 | rice\|11v1\|CB663201 | rice | 519 | 773 |
| LGN17 | maize\|13v2\|CF647382 | maize | 520 | 886 |
| LGN18 | maize\|13v2\|AW562670 | maize | 521 | 887 |
| LGN20 | maize\|13v2\|AI920382 | maize | 522 | 888 |
| LGN23 | maize\|10v1\|CF011727 | maize | 523 | 777 |
| LGN24 | maize\|10v1\|CD943107 | maize | 524 | 889 |
| LGN26 | maize\|10v1\|BE051266 | maize | 525 | 779 |
| LGN33 | maize\|10v1\|AI857219 | maize | 526 | 780 |
| LGN34 | maize\|10v1\|AI691183 | maize | 527 | 890 |
| LGN35 | maize\|10v1\|AI668189 | maize | 528 | 782 |
| LGN36 | maize\|10v1\|AI666136 | maize | 529 | 783 |
| LGN39 | maize\|10v1\|AA979848 | maize | 530 | 891 |
| LGN40 | cotton\|11v1\|BG446873 | cotton | 531 | 785 |
| LGN41 | *brachypodium*\|12v1\|BRADI1G64560 | *brachypodium* | 532 | 786 |
| LGN42 | barley\|12v1\|BI951707 | barley | 533 | 787 |
| LGN43 | barley\|12v1\|BI946826 | barley | 534 | 788 |
| LGN44 | barley\|12v1\|BF626012 | barley | 535 | 789 |
| LGN45 | barley\|12v1\|BF624588 | barley | 536 | 892 |
| LGN46 | barley\|12v1\|BF619715 | barley | 537 | 791 |
| LGN47 | barley\|10v2\|BI948139 | barley | 538 | 893 |
| LGN48 | barley\|10v2\|AV833757 | barley | 539 | 793 |
| LGN49 | maize\|10v1\|AI901839 | maize | 540 | 894 |
| LGN52 | foxtail_millet\|11v3\|SOLX00022696 | foxtail_millet | 541 | 795 |

TABLE I-continued

Identified genes for increasing yield, seed yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant Provided are the identified genes, their annotation, organism and polynucleotide and polypeptide sequence identifiers.

| Gene Name | Cluster Name | Organism | Polyn. SEQ ID NO: | Polyp. SEQ ID NO: |
|---|---|---|---|---|
| LGN54 | sorghum\|12v1\|SB01G028500 | sorghum | 542 | 796 |
| LGN57 | sorghum\|13v2\|BE596729 | sorghum | 543 | 895 |
| LGN60 | foxtail_millet\|13v2\|SRR350548X10009 | foxtail_millet | 544 | 798 |
| LGN61 | maize\|13v2\|AI941989 | maize | 545 | 896 |
| LGN62_H2 | foxtail_millet\|13v2\|SRR350548X213481 | foxtail_millet | 546 | 897 |
| LBY3 | foxtail_millet\|11v3\|PHY7SI024106M | foxtail_millet | 547 | — |
| LBY4 | gossypium_raimondii\|13v1\|GR13V1PRD019042 | gossypium_raimondii | 548 | — |
| LBY5 | maize\|13v2\|AI001271 | maize | 549 | — |
| LBY6 | maize\|13v2\|BQ528930 | maize | 550 | — |
| LBY14 | sorghum\|13v2\|BE359338 | sorghum | 551 | — |

"polyn." = polynucleotide; "polyp." = polypeptide.

Example 2

Identification of Homologous (e.g., Orthologous) Sequences that Increase Yield, Seed Yield, Fiber Yield, Fiber Quality, Growth Rate, Biomass, Oil Content, Vigor, ABST, and/or NUE of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter is related by duplication events. It is assumed that paralogs arising from ancient duplication events are likely to have diverged in function while true orthologs are more likely to retain identical function over evolutionary time.

To further investigate and identify putative orthologs of the genes affecting plant yield, seed yield, fiber yield, fiber quality, oil yield, oil content, seed yield, growth rate, vigor, biomass, abiotic stress tolerance, and fertilizer use efficiency (FUE) and/or nitrogen use efficiency of a plant, all sequences were aligned using the BLAST® (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level -identical amino acids in the protein domains and similarity in expression profiles.

The search and identification of homologous genes involves the screening of sequence information available, for example, in public databases such as the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST® programs. There are five implementations of BLAST®, three designed for nucleotide sequence queries (BLASTN®, BLASTX®, and TBLASTX®) and two designed for protein sequence queries (BLASTP® and TBLASTN®) (Coulson, Trends in Biotechnology: 76-80, 1994; Birren et al., Genome Analysis, I: 543, 1997). Such methods involve alignment and comparison of sequences. The BLAST® algorithm calculates percent sequence identity and performs a statistical analysis of the similarity between the two sequences. The software for performing BLAST® analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), *Arabidopsis* (*Arabidopsis thaliana*), maize (*Zea mays*), cotton (*Gossy-* pium), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (biochem (dot) ucl (dot) ac (dot) uk/bsm/dbbrowser/protocol/prodomqry (dot) html), PR (pir (dot) Georgetown (dot) edu/) or Pfam (sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 1 (Example 1 above) were identified from the databases using BLAST® software with the BLASTP® and tBLASTN® algorithms as filters for the first stage, and the needle (EMBOSS package) or Frame+ algorithm alignment for the second stage. Local identity (BLAST® alignments) was defined with a very permissive cutoff—60% Identity on a span of 60% of the sequences lengths because it is used only as a filter for the global alignment stage. The default filtering of the BLAST® package was not utilized (by setting the parameter "-F F").

In the second stage, homologs were defined based on a global identity of at least 80% to the core gene polypeptide sequence. Two distinct forms for finding the optimal global alignment for protein or nucleotide sequences were used in this application:

1. Between two proteins (following the BLASTP® filter): EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the tBLASTN® filter): GenCore 6.0 OneModel application utilizing the Frame+ algorithm with the following parameters: model=frame+_p2n.model mode=qglobal -q=protein. sequence -db=nucleotide.sequence. The rest of the parameters are unchanged from the default options described hereinabove.

The query polypeptide sequences were SEQ ID NOs: 552-897 and the query polynucleotides were SEQ ID NOs: 1-551 and the identified orthologous and homologous sequences having at least 80% global sequence identity are provided in Table 2, below. These homologous genes are expected to increase plant yield, seed yield, oil yield, oil content, growth rate, fiber yield, fiber quality, fiber length, photosynthetic capacity, biomass, vigor, ABST and/or NUE of a plant.

Lengthy table referenced here

US10975383-20210413-T00001

Please refer to the end of the specification for access instructions.

The output of the functional genomics approach described herein is a set of genes highly predicted to improve yield and/or other agronomic important traits such as growth rate, vigor, oil content, fiber yield and/or quality, biomass, photosynthetic capacity, growth rate, abiotic stress tolerance, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described here alone or set of genes together increases the overall yield and/or other agronomic important traits, hence expects to increase agricultural productivity.

Example 3

Production of Barley Transcriptome and High Throughput Correlation Analysis Using 44K Barley Oligonucleotide Micro-Array In order to produce a high throughput correlation analysis, the present inventors utilized a Barley oligonucleotide micro-array, produced by Agilent Technologies [chem. (dot) agilent (dot) com/Scripts/PDS (dot) asp?1Page=50879]. The array oligonucleotide represents about 47,500 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Four tissues at different developmental stages [meristem, flower, booting spike, stem], representing different plant characteristics were sampled and RNA was extracted as described hereinabove under "GENERAL EXPERIMENTAL AND BIOINFORMATICS METHODS".

For convenience, each micro-array expression information tissue type has received a Set ID as summarized in Table 3 below.

TABLE 3

Barley transcriptome expression sets

| Expression Set | Set ID |
|---|---|
| Booting spike at flowering stage under normal conditions | 1 |
| Flowering spike at flowering stage under normal conditions | 2 |
| Meristem at flowering stage under normal conditions | 3 |
| Stem at flowering stage under normal conditions | 4 |

Table 3: Provided are the identification (ID) letters of each of the Barley expression sets.

Barley yield components and vigor related parameters assessment—13 Barley accessions in 4 repetitive blocks (named A, B, C, and D), each containing 4 plants per plot were grown at net house under normal conditions as recommended for commercial growth [normal growth conditions included irrigation given 2-3 times a week, and fertilization given in the first 1.5 months of the growth period]; under low Nitrogen (80% percent less Nitrogen); or under drought stress (cycles of drought and re-irrigating were conducted throughout the whole experiment, overall 40% less water were given in the drought treatment). Plants were phenotyped on a daily basis following the standard descriptor of barley (Table 4, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

TABLE 4

Barley standard descriptors

| Trait | Parameter | Range | Description |
|---|---|---|---|
| Growth habit | Scoring | 1-9 | Prostrate (1) or Erect (9) |
| Hairiness of basal leaves | Scoring | P (Presence)/ A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 4

At the end of the experiment (50% of the spikes were dry) all spikes from plots within blocks A-D were collected, and the following measurements were performed:

(i) Grains per spike—The total number of grains from 5 spikes that were manually threshed was counted. The average grain per spike was calculated by dividing the total grain number by the number of spikes.

(ii) Grain average size (cm)—The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

(iii) Grain average weight (mgr)—The total grains from 5 spikes that were manually threshed were counted and weight. The average weight was calculated by dividing the total weight by the total grain number.

(iv) Grain yield per spike (gr) (=seed yield of 5 spikes)—The total grains from 5 spikes that were manually threshed were weight. The grain yield was calculated by dividing the total weight by the spike number.

(v) Spike length analysis—The five chosen spikes per plant were measured using measuring tape excluding the awns.

(vi) Spike number analysis—The spikes per plant were counted.

Additional parameters were measured as follows:

Growth habit scoring—At growth stage 10 (booting), each of the plants was scored for its growth habit nature. The scale that was used was "1" for prostate nature till "9" for erect.

Hairiness of basal leaves—At growth stage 5 (leaf sheath strongly erect; end of tillering), each of the plants was scored for its hairiness nature of the leaf before the last. The scale that was used was "1" for prostate nature till "9" for erect.

Plant height—At harvest stage (50% of spikes were dry), each of the plants was measured for its height using measuring tape. Height was measured from ground level to top of the longest spike excluding awns.

Days to flowering—Each of the plants was monitored for flowering date. Days of flowering were calculated from sowing date till flowering date.

Stem pigmentation—At growth stage 10 (booting), each of the plants was scored for its stem color. The scale that was used was "1" for green till "5" for full purple.

Vegetative dry weight and spike yield—At the end of the experiment (50% of the spikes were dry) all spikes and vegetative material from plots within blocks A-D were collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr) after drying at 30° C. in oven for 48 hours.

TABLE 5

Barley correlated parameters (vectors)

| Correlated parameter with | Correlation ID |
|---|---|
| Grain weight [milligrams] | 1 |
| Grains size [mm²] | 2 |
| Grains per spike [numbers] | 3 |
| Growth habit [scores 1-9] | 4 |
| Hairiness of basal leaves [scoring 1-2] | 5 |
| Plant height (cm) | 6 |
| Seed yield of 5 spikes [gr/spike] | 7 |
| Spike length [cm] | 8 |
| Spikes per plant [numbers] | 9 |
| Stem pigmentation [scoring 1-5] | 10 |
| Vegetative dry weight [gram] | 11 |
| Days to flowering [days] | 12 |

Table 5. Provided are the Barley correlated parameters (vectors).

Experimental Results 13 different Barley accessions were grown and characterized for 12 parameters as described above. The average for each of the measured parameter was calculated using the JMP software and values are summarized in Tables 6 and 7 below. Subsequent correlation analysis between the various transcriptome expression sets (Table 3) and the average parameters was conducted. Follow, results were integrated to the database (Table 8 below).

TABLE 6

Measured parameters of correlation Ids in Barley accessions

| Ecotype/Treatment | Line-1 | Line-2 | Line-3 | Line-4 | Line-5 | Line-6 | Line-7 |
|---|---|---|---|---|---|---|---|
| 1 | 35.05 | 28.06 | 28.76 | 17.87 | 41.22 | 29.73 | 25.22 |
| 2 | 0.27 | 0.23 | 0.24 | 0.17 | 0.29 | 0.28 | 0.22 |
| 3 | 20.23 | 17.98 | 17.27 | 17.73 | 14.47 | 16.78 | 12.12 |
| 4 | 2.60 | 2.00 | 1.92 | 3.17 | 4.33 | 2.69 | 3.60 |
| 5 | 1.53 | 1.33 | 1.69 | 1.08 | 1.42 | 1.69 | 1.30 |
| 6 | 134.27 | 130.50 | 138.77 | 114.58 | 127.75 | 129.38 | 103.89 |
| 7 | 3.56 | 2.54 | 2.58 | 1.57 | 3.03 | 2.52 | 1.55 |
| 8 | 12.04 | 10.93 | 11.83 | 9.90 | 11.68 | 11.53 | 8.86 |
| 9 | 48.85 | 48.27 | 37.42 | 61.92 | 33.27 | 41.69 | 40.00 |
| 10 | 1.13 | 2.50 | 1.69 | 1.75 | 2.33 | 2.31 | 1.70 |
| 11 | 78.87 | 66.14 | 68.49 | 53.39 | 68.30 | 74.17 | 35.35 |
| 12 | 62.40 | 64.08 | 65.15 | 58.92 | 63.00 | 70.54 | 52.80 |

Table 6. Provided are the values of each of the parameters measured in Barley accessions (1-7) according to the correlation identifications (see Table 5).

TABLE 7

Barley accessions, additional measured parameters

| Ecotype/Treatment | Line-8 | Line-9 | Line-10 | Line-11 | Line-12 | Line-13 |
|---|---|---|---|---|---|---|
| 1 | 34.99 | 20.58 | 27.50 | 37.13 | 29.56 | 19.58 |
| 2 | 0.28 | 0.19 | 0.22 | 0.27 | 0.27 | 0.18 |
| 3 | 14.07 | 21.54 | 12.10 | 13.40 | 15.28 | 17.07 |
| 4 | 3.50 | 3.00 | 3.67 | 2.47 | 3.50 | 3.00 |
| 5 | 1.19 | 1.00 | 1.17 | 1.60 | 1.08 | 1.17 |
| 6 | 121.63 | 126.80 | 99.83 | 121.40 | 118.42 | 117.17 |
| 7 | 2.62 | 2.30 | 1.68 | 2.68 | 2.35 | 1.67 |
| 8 | 11.22 | 11.11 | 8.58 | 10.18 | 10.51 | 9.80 |
| 9 | 40.63 | 62.00 | 49.33 | 50.60 | 43.09 | 51.40 |
| 10 | 2.19 | 2.30 | 1.83 | 3.07 | 1.58 | 2.17 |
| 11 | 58.33 | 62.23 | 38.32 | 68.31 | 56.15 | 42.68 |
| 12 | 60.88 | 58.10 | 53.00 | 60.40 | 64.58 | 56.00 |

Table 7. Provided are the values of each of the parameters measured in Barley accessions (8-13) according to the correlation identifications (see Table 5).

TABLE 8

Correlation between the expression level of selected genes of some embodiments of the invention in various tissues and the phenotypic performance under normal fertilization conditions across barley accessions

| Gene Name | R | P value | Exp. set | Corr. Set ID | Gene Name | R | P value | Exp. set | Corr. Set ID |
|---|---|---|---|---|---|---|---|---|---|
| LBY20 | 0.72 | 1.32E-02 | 3 | 9 | LBY21 | 0.81 | 2.27E-03 | 1 | 2 |
| LBY21 | 0.75 | 7.63E-03 | 1 | 1 | LBY22 | 0.74 | 9.92E-03 | 3 | 7 |
| LBY25 | 0.75 | 7.51E-03 | 3 | 9 | LBY26 | 0.88 | 3.49E-04 | 3 | 2 |
| LBY26 | 0.83 | 1.63E-03 | 3 | 1 | LBY26 | 0.72 | 1.19E-02 | 3 | 7 |
| LBY26 | 0.81 | 2.69E-03 | 3 | 12 | LBY29 | 0.71 | 1.47E-02 | 3 | 12 |
| LBY30 | 0.78 | 4.36E-03 | 3 | 9 | LBY31 | 0.79 | 6.50E-03 | 2 | 10 |
| LBY32 | 0.88 | 4.12E-04 | 1 | 2 | LBY32 | 0.87 | 5.83E-04 | 1 | 1 |
| LBY32 | 0.70 | 1.56E-02 | 3 | 9 | LGN42 | 0.86 | 6.89E-04 | 3 | 9 |
| LGN43 | 0.74 | 8.67E-03 | 1 | 9 | LGN43 | 0.72 | 1.20E-02 | 1 | 3 |

Table 8. Provided are the correlations (R) between the gene expression levels in various tissues and the phenotypic performance "Corr. ID"—correlation set ID according to the correlated parameters specified in Table 86. "Exp. Set"—Expression set specified in Table 84. "R" = Pearson correlation coefficient; "P" = p value.

Example 4

Production of Barley Transcriptome and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [chem. (dot) agilent (dot) com/Scripts/PDS (dot) asp?1Page=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Analyzed Barley tissues—six tissues at different developmental stages [leaf, meristem, root tip, adventitious root, booting spike and stem], representing different plant characteristics, were sampled and RNA was extracted as described above. Each micro-array expression information tissue type has received a Set ID as summarized in Tables 9-11 below.

TABLE 9

Barley transcriptome expression sets under drought and recovery conditions

| Expression Set | Set ID |
| --- | --- |
| Booting spike under drought conditions | 1 |
| Leaf at reproductive stage under drought conditions | 2 |
| Leaf at vegetative stage under drought conditions | 3 |
| Meristem at vegetative stage under drought conditions | 4 |
| Root tip at vegetative stage under drought conditions | 5 |
| Root tip at vegetative stage under recovery from drought conditions | 6 |

Table 9. Provided are the barley transcriptome expression sets under drought and recovery conditions.

TABLE 10

Barley transcriptome expression sets under normal and low nitrogen conditions (set 1)

| Expression Set | Set ID |
| --- | --- |
| Adventitious roots under low nitrogen conditions | 1 |
| Adventitious roots under normal conditions | 2 |
| Leaf under low nitrogen conditions | 3 |
| Leaf under normal conditions | 4 |
| Root tip under low nitrogen conditions | 5 |
| Root tip under normal conditions | 6 |

Table 10. Provided are the barley transcriptome expression sets under normal and low nitrogen conditions (set 1-vegetative stage).

TABLE 11

Barley transcriptome expression sets under normal and low nitrogen conditions (set 2)

| Expression Set | Set ID |
| --- | --- |
| Booting spike under low nitrogen conditions | 1 |
| Booting spike under normal conditions | 2 |
| Leaf under low nitrogen conditions | 3 |
| Leaf under normal conditions | 4 |
| Stem under low nitrogen conditions | 5 |
| Stem under normal conditions | 6 |

Table 11. Provided are the barley transcriptome expression sets under normal and low nitrogen conditions (set 2-reproductive stage).

Barley yield components and vigor related parameters assessment—15 Barley accessions in 5 repetitive blocks, each containing 5 plants per pot were grown at net house. Three different treatments were applied: plants were regularly fertilized and watered during plant growth until harvesting as recommended for commercial growth under normal conditions [normal growth conditions included irrigation 2-3 times a week and fertilization given in the first 1.5 months of the growth period]; under low Nitrogen (80% percent less Nitrogen); or under drought stress (cycles of drought and re-irrigating were conducted throughout the whole experiment, overall 40% less water as compared to normal conditions were given in the drought treatment). Plants were phenotyped on a daily basis following the standard descriptor of barley (Tables 12-15, below). Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

Grain yield (gr.)—At the end of the experiment all spikes of the pots were collected. The total grains from all spikes that were manually threshed were weighted. The grain yield was calculated by per plot or per plant.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using a measuring tape. Height was measured from ground level to top of the longest spike excluding awns at two time points at the Vegetative growth (30 days after sowing) and at harvest.

Spike weight—The biomass and spikes weight of each plot were separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Spikelet per spike=number of spikelets per spike was counted.

Root/Shoot Ratio—The Root/Shoot Ratio is calculated using Formula XXII (above).

Total No. of tillers—all tillers were counted per plot at two time points at the Vegetative growth (30 days after sowing) and at harvest.

Percent of reproductive tillers—was calculated based on Formula XXVI (above).

SPAD [SPAD unit]—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—3 plants per plot were selected for measurement of root weight, root length and for counting the number of lateral roots formed.

Shoot FW (fresh weight)—weight of 3 plants per plot were recorded at different time-points.

Average Grain Area (cm$^2$)—At the end of the growing period the grains were separated from the spike. A sample of ~200 grains was weighted, photographed and images were processed using the below described image processing system. The grain area was measured from those images and was divided by the number of grains.

Average Grain Length and width (cm)—At the end of the growing period the grains were separated from the spike. A sample of ~200 grains was weighted, photographed and images were processed using the below described image processing system. The sum of grain lengths or width (longest axis) was measured from those images and was divided by the number of grains Average Grain perimeter (cm)—At the end of the growing period the grains were separated from the spike. A sample of ~200 grains was weighted, photographed and images were processed using the below described image processing system. The sum of grain perimeter was measured from those images and was divided by the number of grains.

Heading date—the day in which booting stage was observed was recorded and number of days from sowing to heading was calculated.

Relative water content—was calculated based on Formula I.

Harvest Index (for barley)—The harvest index is calculated using Formula XVIII (above).

Relative growth rate: the relative growth rates (RGR) of Plant Height, SPAD and number of tillers were calculated based on Formulas III, IV and V respectively.

RATIO Drought/Normal: Represent ratio for the specified parameter of Drought condition results divided by Normal conditions results (maintenance of phenotype under drought in comparison to normal conditions).

Data parameters collected are summarized in Table 12-15, hereinbelow

TABLE 12

Barley correlated parameters (vectors) under drought and recovery conditions

| Correlated parameter with | Correlation ID |
|---|---|
| Chlorophyll levels SPAD [unit] | 1 |
| Dry weight at harvest [gr] | 2 |
| Dry weight vegetative growth [gr/day] | 3 |
| Fresh weight [gr] | 4 |
| Grain number [num] | 5 |
| Grain weight [gr] | 6 |
| Harvest index [yield/(yield + biomass)] | 7 |
| Heading date [days] | 8 |
| Height Relative growth rate [cm/day] | 9 |
| Number of tillers Relative growth rate [num/day] | 10 |
| Plant height T2 [cm] | 11 |
| Root/shoot [ratio] | 12 |
| Relative water content [%] | 13 |
| Root dry weight [gr] | 14 |
| Root fresh weight [gr] | 15 |
| Root length [cm] | 16 |
| SPAD Relative growth rate SPAD [unit/day] | 17 |
| Spike length [cm] | 18 |
| Spike number [num] | 19 |
| Spike weight per plant [gr] | 20 |
| Spike width [cm] | 21 |
| Tillers number T2 [num] | 22 |
| Lateral root number [num] | 23 |

Table 12. Provided are the barley correlated parameters.

TABLE 13

Barley correlated parameters (vectors) for maintenance of performance under drought conditions

| Correlated parameter with | Correlation ID |
|---|---|
| Chlorophyll levels [ratio] | 1 |
| Dry weight at harvest [ratio] | 2 |
| Dry weight vegetative growth [ratio] | 3 |
| Fresh weight [ratio] | 4 |
| Grain number [ratio] | 5 |
| Grain weight [ratio] | 6 |
| Harvest index [ratio] | 7 |
| Heading date [ratio] | 8 |
| Plant height [ratio] | 9 |
| Root/shoot [ratio] | 10 |
| Relative water content [ratio] | 11 |
| Root dry weight [ratio] | 12 |
| Root fresh weight [ratio] | 13 |
| Root length [ratio] | 14 |
| Spike length [ratio] | 15 |
| Spike number [ratio] | 16 |
| Spike weight per plant [ratio] | 17 |
| Spike width [ratio] | 18 |

TABLE 13-continued

Barley correlated parameters (vectors) for maintenance of performance under drought conditions

| Correlated parameter with | Correlation ID |
|---|---|
| Tillers number [ratio] | 19 |
| Lateral root number [ratio] | 20 |

Table 13. Provided are the barley correlated parameters. "ratio"-ratio for the specified parameter of Drought condition results divided by Normal conditions results (maintenance of phenotype under drought in comparison to normal conditions.

TABLE 14

Barley correlated parameters (vectors) under low nitrogen and normal conditions (set 1)

| Correlated parameter with | Correlation ID |
|---|---|
| Lateral Roots under Normal growth conditions [number] | 1 |
| Leaf Area, under Normal growth conditions [mm²] | 2 |
| Leaf Number, TP4, under Low N growth conditions [number] | 3 |
| Max Length, under Normal growth conditions [mm] | 4 |
| Max Width, under Normal growth conditions [mm] | 5 |
| Max Length, TP4, under Low N growth conditions [mm] | 6 |
| Max Width, TP4, under Low N growth conditions [mm] | 7 |
| No of lateral roots, under Low N growth conditions, TP2 [number] | 8 |
| No of tillers, under Low N growth conditions, TP2 [number] | 9 |
| Num Leaves, under Normal growth conditions [number] | 10 |
| Num Seeds, under Normal growth conditions [number] | 11 |
| Number of Spikes, under Normal growth conditions [number] | 12 |
| Num Tillers, under Normal growth conditions[number] | 13 |
| Plant Height, under Normal growth conditions, T2 [cm] | 14 |
| Plant Height, under Low N growth conditions [cm] | 15 |
| Plant Height, under Low N growth conditions, TP2 [cm] | 16 |
| Root FW, under Normal growth conditions [gr.] | 17 |
| Root Length, under Normal growth conditions [cm] | 18 |
| Root FW, under Low N growth conditions, TP2 [gr.] | 19 |
| Root length, under Low N growth conditions, TP2 [cm] | 20 |
| SPAD, under Normal growth conditions SPAD [unit] | 21 |
| SPAD, under Low N growth conditions, TP2 SPAD [unit] | 22 |
| Seed Yield, under Normal growth conditions [gr.] | 23 |
| Seed Number (per plot) under Low N growth conditions [number] | 24 |
| Seed Yield, under Low N growth conditions [gr.] | 25 |
| Seed Yield, under Low N growth conditions [gr.] | 26 |
| Shoot FW, under Normal growth conditions [gr.] | 27 |
| Spike Length, under Normal growth conditions [cm] | 28 |
| Spike Width, under Normal growth conditions [cm] | 29 |
| Spike weight, under Normal growth conditions [gr.] | 30 |
| Spike Length, under Low N growth conditions [cm] | 31 |
| Spike Width, under Low N growth conditions [cm] | 32 |
| Spike total weight (per plot) under Low N growth conditions [gr.] | 33 |
| Total Tillers, under Normal growth conditions [number] | 34 |
| Total Leaf Area, TP4, under Low N growth conditions [mm²] | 35 |
| Total No of Spikes (per plot) under Low N growth conditions [number] | 36 |
| Total No of tillers (per plot) under Low N growth conditions [number] | 37 |
| Shoot FW, under Low N growth conditions, TP2 [gr.] | 38 |

Table 14. Provided are the barley correlated parameters. "TP" = time point; "DW" = dry weight; "FW" = fresh weight; "Low N" = Low Nitrogen; "Normal" = regular growth conditions. "Max" = maximum.

TABLE 15

Barley correlated parameters (vectors) under low nitrogen and normal conditions (set 2)

| Correlated parameter with | Correlation ID |
|---|---|
| Grain Perimeter (cm) | 1 |
| Grain area (cm²) | 2 |
| Grain length (cm) | 3 |
| Grain width (cm) | 4 |
| Grains DW/Shoots DW (ratio) | 5 |
| Grains per plot (number) | 6 |
| Grains weight per plant (gr.) | 7 |
| Grains weight per plot (gr.) | 8 |
| Plant Height (cm) | 9 |
| Roots DW (mg) | 10 |
| Row number (number) | 11 |
| Spikes FW (Harvest) (gr.) | 12 |
| Spikes num (number) | 13 |
| Tillering (Harvest) (number) | 14 |
| Vegetative DW (Harvest) (gr.) | 15 |
| percent of reproductive tillers (%) | 16 |
| shoot/root ratio (ratio) | 17 |

Table 15. Provided are the barley correlated parameters. "TP" = time point; "DW" = dry weight; "FW" = fresh weight; "Low N" = Low Nitrogen; "Normal" = regular growth conditions. "Max" = maximum. Note that each of the parameters described in this Table was measured under both low N growth conditions and normal growth conditions.

Experimental Results 15 different Barley accessions were grown and characterized for different parameters as described above. Tables 12-15 above describe the Barley correlated parameters. The average for each of the measured parameters was calculated using the JMP software and values are summarized in Tables 16-25 below. Subsequent correlation analysis between the various transcriptome sets and the average parameters (Tables 16-25) was conducted. Follow, results were integrated to the database (Tables 26-29).

TABLE 16

Measured parameters of correlation IDs in Barley accessions under drought and recovery conditions

| Corr. ID/Line | 1 | 2 | 3 | 4 | 5 | 6 | 7 | 8 | 9 | 10 | 11 | 12 |
|---|---|---|---|---|---|---|---|---|---|---|---|---|
| Line-1 | 41.33 | 6.15 | 0.21 | 1.90 | 170.00 | 5.55 | 0.47 | 75.00 | 0.27 | 0.070 | 46.00 | 0.013 |
| Line-2 | 33.57 | 5.05 | 0.21 | 1.52 | 267.50 | 9.80 | 0.66 | 71.00 | 0.86 | 0.097 | 52.80 | 0.012 |
| Line-3 | 36.57 | 3.20 |  | 1.17 | 111.00 | 3.55 | 0.53 | 65.00 | 0.73 | 0.059 | 35.00 | 0.008 |
| Line-4 | 40.50 | 3.28 |  | 1.95 | 205.33 | 7.20 | 0.69 |  | 0.88 | 0.071 | 38.00 | 0.006 |
| Line-5 | 45.07 | 4.76 |  | 1.90 | 153.60 | 5.28 | 0.53 | 66.75 | 0.40 | 0.164 | 45.20 | 0.025 |
| Line-6 | 39.73 | 3.55 | 0.17 | 1.22 | 252.50 | 7.75 | 0.69 | 90.00 | 0.94 | 0.061 | 48.00 | 0.020 |
| Line-7 | 38.33 | 4.52 |  | 1.75 | 288.40 | 9.92 | 0.69 | 90.00 | 0.70 | 0.104 | 37.67 | 0.008 |

TABLE 16-continued

Measured parameters of correlation IDs in Barley accessions under drought and recovery conditions

| Corr. ID/ Line | 1 | 2 | 3 | 4 | 5 | 6 | 7 | 8 | 9 | 10 | 11 | 12 |
|---|---|---|---|---|---|---|---|---|---|---|---|---|
| Line-8  | 36.17 | 3.38 |      | 1.58 | 274.50 | 10.25 | 0.75 |       | 0.71 | 0.049 | 41.20 | 0.008 |
| Line-9  | 42.13 | 5.67 | 0.25 | 1.88 | 348.50 | 8.50  | 0.60 | 90.00 | 0.77 | 0.100 | 40.80 | 0.012 |
| Line-10 | 31.77 | 3.31 |      | 1.73 | 358.00 | 14.03 | 0.81 |       | 0.80 | 0.061 | 49.86 | 0.007 |
| Line-11 | 33.47 | 2.65 |      | 1.00 | 521.39 | 17.52 | 0.87 |       | 0.92 | 0.063 | 43.00 | 0.016 |
| Line-12 | 42.37 | 5.12 | 0.13 | 0.90 | 71.50  | 2.05  | 0.29 | 90.00 | 0.39 | 0.183 | 47.40 | 0.023 |
| Line-13 | 42.27 | 6.86 | 0.19 | 0.90 | 160.13 | 5.38  | 0.44 | 81.60 | 0.88 | 0.149 | 64.80 | 0.012 |
| Line-14 | 36.77 | 3.11 | 0.22 | 1.43 | 376.67 | 11.00 | 0.78 | 90.00 | 0.13 | 0.022 | 52.60 | 0.012 |
| Line-15 | 40.63 | 3.74 |      | 0.83 | 105.00 | 2.56  | 0.41 |       | 0.20 | 0.442 | 32.00 | 0.026 |

Table 16. Provided are the values of each of the parameters (as described above in Table 12) measured in Barley accessions (line) under drought growth conditions. Growth conditions are specified in the experimental procedure section.

TABLE 17

Additional measured parameters of correlation IDs in Barley accessions under drought and recovery conditions

| Corr. ID/ Line | 13 | 14 | 15 | 16 | 17 | 18 | 19 | 20 | 21 | 22 | 23 |
|---|---|---|---|---|---|---|---|---|---|---|---|
| Line-1  | 80.60 | 77.52  | 2.07 | 21.67 | 0.087 | 16.70 | 4.20 | 17.72 | 8.64 | 11.68 | 8.33 |
| Line-2  | 53.40 | 60.19  | 1.48 | 20.33 | 0.123 | 16.85 | 4.36 | 24.24 | 9.07 | 9.04  | 8.67 |
| Line-3  | 55.87 | 27.13  | 1.12 | 22.00 | 0.001 | 13.27 | 7.60 | 18.20 | 7.82 | 10.92 | 7.33 |
| Line-4  |       | 18.62  | 1.87 | 24.00 | 0.010 | 13.55 | 8.44 | 18.00 | 7.32 | 10.16 | 7.67 |
| Line-5  | 43.21 | 117.42 | 1.67 | 20.67 | 0.037 | 14.19 | 4.92 | 19.50 | 8.74 | 10.32 | 6.67 |
| Line-6  | 69.78 | 70.72  | 1.68 | 18.33 | 0.072 | 15.64 | 3.43 | 15.00 | 7.62 | 8.78  | 6.67 |
| Line-7  | 45.49 | 37.34  | 1.62 | 21.00 | 0.013 | 15.66 | 6.90 | 23.40 | 6.98 | 13.00 | 7.67 |
| Line-8  | 76.51 | 25.56  | 0.85 | 20.33 | 0.003 | 17.49 | 5.80 | 28.16 | 8.05 | 7.44  | 6.67 |
| Line-9  | 87.41 | 66.18  | 1.45 | 21.67 | 0.063 | 16.00 | 8.55 | 21.96 | 6.06 | 13.92 | 6.00 |
| Line-10 |       | 22.13  | 1.38 | 19.67 | 0.035 | 18.31 | 9.67 | 33.03 | 6.73 | 11.00 | 8.67 |
| Line-11 |       | 41.12  | 0.82 | 16.67 | 0.050 | 17.42 | 5.42 | 34.80 | 9.55 | 6.78  | 7.67 |
| Line-12 | 58.32 | 116.95 | 0.58 | 17.00 | 0.004 | 14.23 | 3.05 | 11.73 | 7.84 | 8.45  | 6.33 |
| Line-13 | 80.58 | 84.10  | 0.63 | 15.17 | 0.072 | 14.81 | 4.07 | 18.78 | 7.81 | 9.15  | 7.00 |
| Line-14 | 73.09 | 37.46  | 1.07 | 27.00 | 0.025 | 16.54 | 3.72 | 21.00 | 8.35 | 5.12  | 7.00 |
| Line-15 |       | 98.86  | 0.70 | 15.00 | 0.063 | 12.72 | 3.21 | 9.88  | 5.47 | 16.13 | 6.67 |

Table 17. Provided are the values of each of the parameters (as described above in Table 12) measured in Barley accessions (line) under drought growth conditions. Growth conditions are specified in the experimental procedure section.

TABLE 18

Measured parameters of correlation IDs in Barley accessions) for maintenance of performance under drought conditions

| Corr. ID/ Line | 1 | 2 | 3 | 4 | 5 | 6 | 7 | 8 | 9 | 10 |
|---|---|---|---|---|---|---|---|---|---|---|
| Line-1  | 0.98 | 0.61 | 0.93 | 0.60 | 0.12 | 0.08 | 0.54 | 0.00 | 0.51 | 1.55 |
| Line-2  | 0.72 | 0.45 | 0.71 | 0.50 | 0.22 | 0.17 | 0.79 | 1.12 | 0.61 | 0.97 |
| Line-3  | 1.30 | 0.59 | 0.00 | 0.47 | 0.11 | 0.06 | 0.58 | 1.30 | 0.67 | 1.12 |
| Line-4  | 1.06 | 0.67 | 0.00 | 0.68 | 0.19 | 0.14 | 0.75 | 0.00 | 0.72 | 0.56 |
| Line-5  | 1.03 | 0.41 | 0.00 | 0.46 | 0.17 | 0.15 | 0.70 | 1.00 | 0.61 | 1.72 |
| Line-6  | 0.95 | 0.54 | 0.65 | 0.47 | 0.21 | 0.14 | 0.77 | 1.06 | 0.59 | 1.97 |
| Line-7  | 0.82 | 0.75 | 0.00 | 0.58 | 0.22 | 0.15 | 0.75 | 1.37 | 0.70 | 0.67 |
| Line-8  | 0.93 | 0.65 | 0.92 | 0.62 | 0.24 | 0.20 | 0.83 | 1.22 | 0.63 | 0.96 |
| Line-9  | 0.93 | 0.77 | 1.01 | 0.74 | 0.25 | 0.14 | 0.67 | 0.00 | 0.66 | 1.14 |
| Line-10 | 0.80 | 0.80 | 0.00 |      | 0.58 | 0.47 | 0.92 |      | 0.87 | 1.08 |
| Line-11 | 0.94 | 0.68 | 0.00 | 0.81 | 0.43 | 0.32 | 0.93 |      | 0.86 | 1.38 |
| Line-12 | 0.96 | 0.42 | 0.94 | 0.72 | 0.10 | 0.07 | 0.41 | 1.20 | 0.64 | 1.84 |
| Line-13 | 1.01 | 0.65 | 0.00 | 0.37 | 0.10 | 0.07 | 0.50 | 1.00 | 0.79 | 1.31 |
| Line-14 | 0.93 | 0.52 | 0.70 | 0.40 | 0.28 | 0.20 | 0.87 |      | 0.56 | 2.06 |
| Line-15 | 1.03 | 0.46 | 0.00 |      | 0.43 | 0.32 | 0.82 |      | 0.51 | 1.46 |

Table 18. Provided are the values of each of the parameters (as described above in Table 13) measured in Barley accessions (line) for maintenance of performance under drought (calculated as % of change under drought vs. normal growth conditions). Growth conditions are specified in the experimental procedure section.

TABLE 19

Additional measured parameters of correlation IDs in Barley accessions) for maintenance of performance under drought conditions

| Corr. ID/Line | 11 | 12 | 13 | 14 | 15 | 16 | 17 | 18 | 19 | 19 | 20 |
|---|---|---|---|---|---|---|---|---|---|---|---|
| Line-1 | 0.78 | 0.94 | 1.10 | 0.66 | 0.83 | 0.73 | 0.16 | 0.75 | 1.87 | 1.87 | 1.09 |
| Line-2 | 0.58 | 0.44 | 1.00 | 0.74 | 0.82 | 0.96 | 0.23 | 0.77 | 1.57 | 1.57 | 0.74 |
| Line-3 | 0.90 | 0.66 | 1.02 | 1.16 | 0.86 | 1.11 | 0.19 | 0.68 | 1.72 | 1.72 | 0.79 |
| Line-4 | 0.00 | 0.37 | 1.67 | 0.78 | 0.77 | 1.30 | 0.23 | 0.67 | 1.80 | 1.80 | 0.88 |
| Line-5 | 0.65 | 0.71 | 0.80 | 0.76 | 0.78 | 0.83 | 0.25 | 0.87 | 1.60 | 1.60 | 0.71 |
| Line-6 | 0.56 | 1.06 | 0.81 | 0.76 | 0.94 | 0.62 | 0.18 | 0.66 | 1.61 | 1.61 | 0.65 |
| Line-7 | 0.78 | 0.50 | 1.13 | 0.68 | 0.83 | 0.87 | 0.23 | 0.75 | 1.63 | 1.63 | 0.85 |
| Line-8 | 0.83 | 0.62 | 0.34 | 0.77 | 0.89 | 1.12 | 0.34 | 0.74 | 1.59 | 1.59 | 0.77 |
| Line-9 | 0.50 | 0.88 | 0.85 | 1.12 | 0.78 | 1.09 | 0.22 | 0.74 | 1.75 | 1.75 | 0.58 |
| Line-10 |  | 0.87 | 0.58 | 0.56 | 0.94 | 1.09 | 0.68 | 0.86 | 1.33 | 1.33 | 0.96 |
| Line-11 | 0.00 | 0.94 | 0.07 | 0.42 | 0.88 | 0.92 | 0.55 | 0.85 | 1.62 | 1.62 | 0.88 |
| Line-12 | 0.00 | 0.77 | 1.06 | 0.82 | 0.77 | 0.49 | 0.18 | 0.79 | 1.33 | 1.33 | 0.95 |
| Line-13 | 0.78 | 0.85 | 0.30 | 0.43 | 0.86 | 0.65 | 0.18 | 0.72 | 1.40 | 1.40 | 0.78 |
| Line-14 | 0.55 | 1.06 | 0.44 | 0.71 | 0.97 | 0.99 | 0.27 | 0.72 | 1.22 | 1.22 | 0.66 |
| Line-15 |  | 0.68 | 0.93 | 0.80 | 0.78 | 0.52 | 0.25 | 0.88 | 1.96 | 1.96 | 0.87 |

Table 19. Provided are the values of each of the parameters (as described above in Table 13) measured in Barley accessions (line) for maintenance of performance under drought (calculated as % of change under drought vs. normal growth conditions). Growth conditions are specified in the experimental procedure section.

TABLE 20

Measured parameters of correlation IDs in Barley accessions) under low nitrogen and normal conditions (set 1)

| Line/Corr. ID | Line-1 | Line-2 | Line-3 | Line-4 | Line-5 | Line-6 | Line-7 | Line-8 | Line-9 | Line-10 |
|---|---|---|---|---|---|---|---|---|---|---|
| 3 | 8.00 | 8.00 | 7.50 | 8.50 | 10.00 | 11.50 | 8.60 | 6.33 | 7.50 | 10.00 |
| 6 | 102.90 | 107.78 | 111.57 | 142.42 | 152.38 | 149.33 | 124.08 | 95.00 | 124.12 | 135.17 |
| 7 | 5.25 | 5.17 | 5.12 | 5.30 | 5.20 | 5.33 | 5.32 | 5.10 | 5.15 | 5.10 |
| 8 | 5.00 | 6.00 | 4.33 | 6.00 | 6.33 | 6.00 | 6.67 | 4.67 | 5.67 | 7.33 |
| 9 | 0.00 | 0.00 | 0.00 | 0.00 | 0.00 | 0.00 | 0.00 | 0.00 | 0.00 | 0.00 |
| 15 | 41.00 | 82.00 | 61.40 | 59.40 | 65.80 | 47.80 | 53.80 | 56.40 | 81.80 | 44.60 |
| 16 | 16.33 | 18.83 | 17.33 | 26.00 | 22.50 | 18.17 | 19.67 | 19.83 | 19.17 | 19.17 |
| 19 | 0.38 | 0.23 | 0.12 | 0.40 | 0.88 | 0.50 | 0.43 | 0.32 | 0.30 | 0.55 |
| 20 | 24.67 | 21.67 | 22.00 | 21.67 | 22.17 | 23.00 | 30.50 | 22.83 | 23.83 | 24.50 |
| 22 | 24.03 | 23.30 | 26.47 | 23.90 | 26.63 | 23.20 | 25.43 | 24.23 | 25.03 | 26.07 |
| 24 | 230.20 | 164.60 | 88.25 | 133.60 | 106.00 | 222.60 | 219.20 | 143.45 | 201.80 | 125.00 |
| 25 | 9.76 | 7.31 | 3.30 | 5.06 | 6.02 | 9.74 | 7.35 | 5.80 | 7.83 | 6.29 |
| 26 | 46.37 | 19.81 | 10.84 | 22.58 | 30.30 | 54.13 | 36.98 | 42.04 | 35.37 | 38.25 |
| 31 | 15.19 | 19.61 | 16.30 | 19.32 | 90.22 | 16.44 | 20.44 | 18.84 | 18.77 | 16.65 |
| 32 | 7.95 | 8.13 | 9.43 | 4.94 | 9.60 | 7.16 | 7.06 | 8.51 | 10.01 | 9.40 |
| 33 | 13.74 | 13.44 | 9.15 | 11.64 | 11.34 | 15.06 | 12.18 | 10.95 | 12.18 | 10.62 |
| 35 | 39.40 | 46.27 | 51.51 | 57.07 | 67.78 | 64.15 | 52.42 | 46.15 | 68.02 | 57.91 |
| 36 | 12.20 | 9.00 | 11.60 | 25.00 | 7.80 | 14.50 | 15.00 | 7.00 | 5.40 | 8.40 |
| 37 | 16.20 | 14.60 | 16.00 | 20.75 | 12.50 | 18.80 | 21.20 | 11.00 | 6.75 | 14.00 |
| 38 | 0.43 | 0.43 | 0.33 | 0.58 | 0.78 | 0.53 | 0.45 | 0.43 | 0.50 | 0.62 |

Table 20. Provided are the values of each of the parameters (as described above in Table 14) measured in Barley accessions (line) under low N and normal growth conditions. Growth conditions are specified in the experimental procedure section.

TABLE 21

Measured parameters of correlation IDs in Barley accessions) under normal conditions (set 1)

| Line/Corr. ID | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 7.00 | 8.67 | 8.33 | 9.67 | 10.70 | 9.67 | 9.67 | 8.67 | 10.00 | 9.67 |
| 2 | 294.0 | 199.0 | 273.0 | 276.0 | 313.0 | 309.0 | 259.0 | 291.0 | 299.0 | 296.0 |
| 4 | 502.0 | 348.0 | 499.0 | 594.0 | 535.0 | 551.0 | 479.0 | 399.0 | 384.0 | 470.0 |
| 5 | 5.77 | 5.45 | 5.80 | 6.03 | 4.63 | 5.33 | 5.83 | 5.43 | 5.75 | 6.03 |
| 10 | 24.2 | 18.2 | 22.7 | 25.5 | 23.2 | 28.3 | 22.2 | 19.0 | 17.3 | 22.0 |
| 11 | 1090.0 | 510.0 | 242.0 | 582.0 | 621.0 | 1070.0 | 903.0 | 950.0 | 984.0 | 768.0 |
| 12 | 41.5 | 32.0 | 36.0 | 71.4 | 34.2 | 45.6 | 49.8 | 28.0 | 19.3 | 38.0 |
| 13 | 2.00 | 2.00 | 1.00 | 2.33 | 2.33 | 3.33 | 2.33 | 1.33 | 1.33 | 1.67 |
| 14 | 64.7 | 84.0 | 67.4 | 82.0 | 72.0 | 56.6 | 65.8 | 62.8 | 91.6 | 66.2 |
| 17 | 0.27 | 0.27 | 0.25 | 0.35 | 0.62 | 0.27 | 0.35 | 0.32 | 0.23 | 0.27 |

TABLE 21-continued

Measured parameters of correlation IDs in Barley accessions) under normal conditions (set 1)

| Line/Corr. ID | Line-1 | Line-2 | Line-3 | Line-4 | Line-5 | Line-6 | Line-7 | Line-8 | Line-9 | Line-10 |
|---|---|---|---|---|---|---|---|---|---|---|
| 18 | 21.30 | 15.00 | 21.80 | 20.30 | 27.20 | 16.00 | 24.00 | 13.50 | 21.50 | 15.20 |
| 21 | 39.10 | 41.40 | 35.20 | 33.70 | 34.20 | 42.80 | 37.00 | 36.90 | 35.00 | 36.80 |
| 23 | 46.4 | 19.8 | 10.8 | 22.6 | 30.3 | 54.1 | 37.0 | 42.0 | 35.4 | 38.3 |
| 27 | 2.17 | 1.90 | 1.25 | 3.00 | 15.60 | 3.02 | 2.58 | 1.75 | 2.18 | 1.82 |
| 28 | 16.5 | 19.2 | 18.3 | 20.4 | 17.2 | 19.1 | 20.3 | 21.7 | 16.5 | 16.1 |
| 29 | 9.54 | 9.05 | 8.25 | 6.55 | 10.50 | 8.83 | 7.38 | 10.40 | 10.20 | 10.30 |
| 30 | 69.40 | 39.40 | 34.90 | 50.30 | 60.80 | 79.10 | 62.70 | 60.00 | 55.90 | 59.70 |
| 34 | 46.7 | 41.6 | 40.0 | 48.8 | 34.6 | 48.6 | 49.2 | 29.0 | 27.5 | 38.8 |

Table 21. Provided are the values of each of the parameters (as described above in Table 15) measured in Barley accessions (line) under normal growth conditions. Growth conditions are specified in the experimental procedure section.

TABLE 22

Measured parameters of correlation IDs in Barley accessions) under normal conditions (set 2)

| Line/Corr. ID | Line-1 | Line-2 | Line-3 | Line-4 | Line-5 | Line-6 | Line-7 | Line-8 |
|---|---|---|---|---|---|---|---|---|
| 1 | 2.239 | 2.243 | 2.182 | 2.047 | 2.083 | 2.028 | 2.247 | 1.878 |
| 2 | 0.246 | 0.241 | 0.238 | 0.232 | 0.237 | 0.248 | 0.244 | 0.218 |
| 3 | 0.887 | 0.874 | 0.863 | 0.796 | 0.825 | 0.778 | 0.901 | 0.717 |
| 4 | 0.352 | 0.350 | 0.350 | 0.369 | 0.365 | 0.406 | 0.346 | 0.387 |
| 5 | 0.398 | 0.156 | 1.010 | 0.793 | 0.413 | 0.987 | 0.665 | 0.614 |
| 6 | 683.4 | 510.5 | 1093.5 | 767.6 | 621.0 | 1069.0 | 987.8 | 903.2 |
| 7 | 6.65 | 3.96 | 9.27 | 7.65 | 6.06 | 10.83 | 7.94 | 7.40 |
| 8 | 33.24 | 19.81 | 46.37 | 38.25 | 30.30 | 54.13 | 39.69 | 36.98 |
| 9 | 76.40 | 84.00 | 64.67 | 66.20 | 72.00 | 56.60 | 68.00 | 65.80 |
| 10 | 118.30 | 150.68 | 86.28 | 85.19 | 120.31 | 90.70 | 40.58 | 90.51 |
| 11 | 6.0 | 6.0 | 6.0 | 6.0 | 6.0 | 2.8 | 6.0 | 2.0 |
| 12 | 69.84 | 39.86 | 69.40 | 59.72 | 60.83 | 79.12 | 63.50 | 62.74 |
| 13 | 38.60 | 32.00 | 41.50 | 38.00 | 34.20 | 45.60 | 30.00 | 49.80 |
| 14 | 44.25 | 41.60 | 46.67 | 38.80 | 34.60 | 48.60 | 32.40 | 55.20 |
| 15 | 89.20 | 99.65 | 45.79 | 49.39 | 74.32 | 55.11 | 47.29 | 60.32 |
| 16 | 82.30 | 77.75 | 86.69 | 94.23 | 89.74 | 93.73 | 89.49 | 90.27 |
| 17 | 1.48 | 0.64 | 0.84 | 0.82 | 1.15 | 0.69 | 1.26 | 0.72 |

Table 22. Provided are the values of each of the parameters (as described above in Table 15) measured in Barley accessions (line) under normal growth conditions. Growth conditions are specified in the experimental procedure section.

TABLE 23

Additional measured parameters of correlation IDs in Barley accessions) under normal conditions (set 2)

| Line/Corr. ID | Line-9 | Line-10 | Line-11 | Line-12 | Line-13 | Line-14 | Line-15 |
|---|---|---|---|---|---|---|---|
| 1 | 2.094 | 2.028 | 2.018 | 1.984 | 1.688 | 1.979 | 1.891 |
| 2 | 0.232 | 0.223 | 0.235 | 0.213 | 0.177 | 0.191 | 0.174 |
| 3 | 0.823 | 0.794 | 0.797 | 0.799 | 0.650 | 0.824 | 0.773 |
| 4 | 0.359 | 0.356 | 0.374 | 0.337 | 0.346 | 0.294 | 0.287 |
| 5 | 0.282 | 1.037 | 0.116 | 0.859 | 0.576 | 0.050 | 0.079 |
| 6 | 581.8 | 904.4 | 242.7 | 928.4 | 984.2 | 157.7 | 263.3 |
| 7 | 4.52 | 8.41 | 2.00 | 8.05 | 7.07 | 0.75 | 1.14 |
| 8 | 22.58 | 39.68 | 10.84 | 40.26 | 35.37 | 3.73 | 5.68 |
| 9 | 82.00 | 62.80 | 67.40 | 76.20 | 91.60 | 44.00 | 52.75 |
| 10 | 92.59 | 63.95 | 286.63 | 95.79 | 34.04 | 121.27 | 206.75 |
| 11 | 2.0 | 5.2 | 6.0 | 6.0 | 6.0 | 4.7 | 4.0 |
| 12 | 50.30 | 59.95 | 34.92 | 60.08 | 55.88 | 16.93 | 21.70 |
| 13 | 71.40 | 28.00 | 36.00 | 27.60 | 23.60 | 54.67 | 48.00 |
| 14 | 50.60 | 29.00 | 40.00 | 28.50 | 27.50 | 26.00 | |
| 15 | 88.01 | 38.89 | 97.71 | 48.33 | 62.52 | 57.97 | 72.78 |
| 16 | 91.21 | 92.50 | 91.73 | 85.31 | | | |
| 17 | 1.17 | 0.71 | 0.38 | 0.51 | 2.16 | 0.67 | 0.39 |

Table 23. Provided are the values of each of the parameters (as described above in Table 15) measured in Barley accessions (line) under normal growth conditions. Growth conditions are specified in the experimental procedure section.

TABLE 24

Measured parameters of correlation IDs in Barley accessions) under low nitrogen conditions (set 2)

| Line/ Corr. ID | Line-1 | Line-2 | Line-3 | Line-4 | Line-5 | Line-6 | Line-7 |
|---|---|---|---|---|---|---|---|
| 1 | 2.28 | 2.33 | 2.28 | 2.08 | 2.13 | 1.96 | 2.09 |
| 2 | 0.250 | 0.251 | 0.255 | 0.235 | 0.249 | 0.227 | 0.227 |
| 3 | 0.90 | 0.92 | 0.93 | 0.82 | 0.86 | 0.76 | 0.83 |
| 4 | 0.351 | 0.346 | 0.349 | 0.364 | 0.366 | 0.381 | 0.347 |
| 5 | 0.39 | 0.42 | 1.25 | 0.69 | 0.43 | 0.87 | 0.77 |
| 6 | 153.2 | 164.6 | 230.2 | 125.0 | 100.0 | 222.6 | 159.4 |
| 7 | 1.34 | 1.46 | 1.95 | 1.26 | 1.13 | 1.95 | 1.28 |
| 8 | 6.68 | 7.31 | 9.76 | 6.29 | 5.67 | 9.74 | 6.40 |
| 9 | 75.20 | 82.00 | 41.00 | 44.60 | 65.80 | 47.80 | 60.60 |
| 10 | 39.91 | 26.24 | 17.31 | 32.91 | 33.87 | 83.84 | 29.65 |
| 11 | 6.0 | 6.0 | 6.0 | 6.0 | 6.0 | 2.0 | 6.0 |
| 12 | 11.40 | 13.44 | 13.74 | 10.62 | 11.34 | 15.06 | 11.64 |
| 13 | 10.80 | 9.00 | 12.20 | 8.40 | 7.80 | 14.50 | 8.40 |
| 14 | 16.00 | 14.60 | 16.20 | 14.00 | 12.50 | 18.80 | 11.60 |
| 15 | 17.42 | 17.76 | 8.25 | 7.28 | 13.25 | 11.32 | 8.95 |
| 16 | 68.68 | 61.85 | 76.94 | 59.63 | 65.63 | 79.84 | 73.85 |
| 17 | 0.69 | 1.08 | 0.77 | 0.38 | 0.83 | 0.42 | 0.28 |

Table 24. Provided are the values of each of the parameters (as described above in Table 15) measured in Barley accessions (line) under low N growth conditions. Growth conditions are specified in the experimental procedure section.

TABLE 25

Additional measured parameters of correlation IDs in Barley accessions) under low nitrogen conditions (set 2)

| Line/ Corr. ID | Line-8 | Line-9 | Line-10 | Line-11 | Line-12 | Line-13 | Line-14 | Line-15 |
|---|---|---|---|---|---|---|---|---|
| 1 | 1.88 | 2.19 | 1.88 | 2.03 | 2.11 | 1.77 | 2.00 | 1.90 |
| 2 | 0.205 | 0.235 | 0.201 | 0.222 | 0.234 | 0.193 | 0.190 | 0.170 |
| 3 | 0.73 | 0.86 | 0.73 | 0.81 | 0.85 | 0.68 | 0.81 | 0.79 |
| 4 | 0.355 | 0.345 | 0.349 | 0.348 | 0.348 | 0.360 | 0.295 | 0.275 |
| 5 | 0.53 | 0.34 | 0.87 | 0.15 | 0.58 | 0.76 | 0.05 | 0.07 |
| 6 | 219.2 | 133.6 | 134.4 | 88.3 | 174.3 | 201.8 | 86.7 | 61.6 |
| 7 | 1.47 | 0.98 | 1.16 | 0.92 | 1.33 | 1.57 | 0.29 | 0.22 |
| 8 | 7.35 | 5.06 | 5.43 | 4.62 | 6.67 | 7.83 | 1.44 | 1.12 |
| 9 | 53.80 | 59.40 | 56.40 | 61.40 | 65.60 | 81.80 | 69.00 | 57.40 |
| 10 | 37.21 | 44.38 | 14.46 | 41.54 | 23.75 | 20.87 | 49.69 | 54.02 |
| 11 | 2.0 | 2.0 | 5.2 | 6.0 | 6.0 | 6.0 | 2.0 | 2.0 |
| 12 | 12.18 | 11.64 | 8.76 | 9.15 | 12.42 | 12.18 | 5.68 | 5.04 |
| 13 | 15.00 | 25.00 | 7.00 | 11.60 | 7.60 | 5.40 | 16.40 | 12.00 |
| 14 | 21.20 | 23.50 | 11.00 | 16.00 | 10.75 | 6.75 | 35.00 | |
| 15 | 14.18 | 15.68 | 6.42 | 55.92 | 11.54 | 10.88 | 58.92 | 17.05 |
| 16 | 71.01 | 95.83 | 64.87 | 68.75 | 74.24 | 81.40 | 37.14 | |
| 17 | 0.57 | 0.60 | 0.55 | 2.88 | 1.36 | 0.89 | 2.49 | 0.40 |

Table 25. Provided are the values of each of the parameters (as described above in Table 15) measured in Barley accessions (line) under low N growth conditions. Growth conditions are specified in the experimental procedure section.

TABLE 26

Correlation between the expression level of selected genes of some embodiments of the invention in various tissues and the phenotypic performance under drought stress conditions across Barley accessions

| Gene Name | R | P value | Exp. set | Corr. Set ID | Gene Name | R | P value | Exp. set | Corr. Set ID |
|---|---|---|---|---|---|---|---|---|---|
| LBY18 | 0.73 | 1.00E−01 | 1 | 23 | LBY18 | 0.70 | 5.29E−02 | 3 | 11 |
| LBY18 | 0.79 | 2.04E−02 | 3 | 12 | LBY18 | 0.77 | 4.21E−02 | 2 | 23 |
| LBY18 | 0.82 | 1.32E−02 | 5 | 11 | LBY18 | 0.80 | 1.75E−02 | 5 | 14 |
| LBY19 | 0.82 | 1.19E−02 | 3 | 19 | LBY19 | 0.75 | 5.33E−02 | 2 | 7 |
| LBY19 | 0.75 | 5.10E−02 | 2 | 21 | LBY19 | 0.82 | 2.51E−02 | 2 | 5 |
| LBY19 | 0.83 | 2.12E−02 | 2 | 6 | LBY19 | 0.71 | 7.32E−02 | 2 | 9 |
| LBY19 | 0.77 | 4.11E−02 | 2 | 12 | LBY19 | 0.74 | 5.55E−02 | 2 | 20 |
| LBY20 | 0.75 | 8.51E−02 | 1 | 7 | LBY20 | 0.89 | 1.89E−02 | 1 | 11 |
| LBY20 | 0.89 | 1.78E−02 | 1 | 18 | LBY20 | 0.71 | 1.15E−01 | 1 | 5 |
| LBY20 | 0.79 | 6.03E−02 | 1 | 6 | LBY20 | 0.86 | 2.77E−02 | 1 | 20 |
| LBY20 | 0.91 | 4.26E−03 | 2 | 23 | LBY21 | 0.74 | 9.14E−02 | 1 | 11 |

TABLE 26-continued

Correlation between the expression level of selected genes of some embodiments of the invention in various tissues and the phenotypic performance under drought stress conditions across Barley accessions

| Gene Name | R | P value | Exp. set | Corr. Set ID | Gene Name | R | P value | Exp. set | Corr. Set ID |
|---|---|---|---|---|---|---|---|---|---|
| LBY21 | 0.78 | 6.50E−02 | 1 | 20 | LBY21 | 0.75 | 1.94E−02 | 6 | 4 |
| LBY22 | 0.88 | 4.03E−03 | 3 | 19 | LBY22 | 0.84 | 1.87E−02 | 2 | 11 |
| LBY22 | 0.72 | 6.63E−02 | 2 | 23 | LBY22 | 0.74 | 5.84E−02 | 2 | 20 |
| LBY22 | 0.76 | 1.66E−02 | 4 | 19 | LBY23 | 0.90 | 1.56E−02 | 1 | 11 |
| LBY23 | 0.80 | 5.62E−02 | 1 | 18 | LBY23 | 0.91 | 1.09E−02 | 1 | 5 |
| LBY23 | 0.82 | 4.70E−02 | 1 | 6 | LBY23 | 0.75 | 8.69E−02 | 1 | 20 |
| LBY23 | 0.83 | 2.12E−02 | 2 | 12 | LBY23 | 0.75 | 4.98E−02 | 2 | 14 |
| LBY24 | 0.82 | 4.61E−02 | 1 | 11 | LBY24 | 0.77 | 7.62E−02 | 1 | 16 |
| LBY24 | 0.74 | 8.98E−02 | 1 | 18 | LBY24 | 0.76 | 7.93E−02 | 1 | 1 |
| LBY24 | 0.72 | 1.06E−01 | 1 | 20 | LBY24 | 0.76 | 1.81E−02 | 6 | 7 |
| LBY24 | 0.80 | 1.01E−02 | 6 | 5 | LBY24 | 0.81 | 7.77E−03 | 6 | 6 |
| LBY24 | 0.72 | 2.75E−02 | 6 | 20 | LBY24 | 0.81 | 5.18E−02 | 5 | 8 |
| LBY24 | 0.80 | 9.03E−03 | 4 | 19 | LBY24 | 0.80 | 9.83E−03 | 4 | 22 |
| LBY24 | 0.71 | 3.05E−02 | 4 | 4 | LBY25 | 0.76 | 7.88E−02 | 5 | 13 |
| LBY26 | 0.82 | 4.74E−02 | 1 | 11 | LBY26 | 0.82 | 4.40E−02 | 1 | 18 |
| LBY26 | 0.70 | 1.20E−01 | 1 | 6 | LBY26 | 0.95 | 3.89E−03 | 1 | 12 |
| LBY26 | 0.83 | 4.04E−02 | 1 | 2 | LBY26 | 0.93 | 6.61E−03 | 1 | 14 |
| LBY26 | 0.77 | 7.07E−02 | 1 | 20 | LBY26 | 0.76 | 4.81E−02 | 2 | 5 |
| LBY26 | 0.75 | 4.99E−02 | 2 | 12 | LBY26 | 0.75 | 5.45E−02 | 2 | 14 |
| LBY26 | 0.71 | 4.76E−02 | 5 | 19 | LBY26 | 0.77 | 7.38E−02 | 5 | 8 |
| LBY26 | 0.80 | 1.73E−02 | 5 | 4 | LBY26 | 0.84 | 4.32E−03 | 4 | 22 |
| LBY26 | 0.80 | 9.77E−03 | 4 | 4 | LBY26 | 0.74 | 2.27E−02 | 4 | 15 |
| LBY27 | 0.92 | 1.01E−02 | 1 | 21 | LBY27 | 0.78 | 3.87E−02 | 3 | 13 |
| LBY27 | 0.75 | 5.29E−02 | 6 | 8 | LBY28 | 0.79 | 6.17E−02 | 1 | 11 |
| LBY28 | 0.80 | 5.60E−02 | 1 | 23 | LBY28 | 0.77 | 7.31E−02 | 1 | 6 |
| LBY28 | 0.73 | 9.69E−02 | 1 | 20 | LBY28 | 0.82 | 1.34E−02 | 3 | 19 |
| LBY28 | 0.76 | 2.86E−02 | 3 | 7 | LBY28 | 0.83 | 2.22E−02 | 2 | 11 |
| LBY28 | 0.77 | 2.68E−02 | 5 | 19 | LBY28 | 0.83 | 5.45E−03 | 4 | 19 |
| LBY28 | 0.75 | 1.89E−02 | 4 | 22 | LBY29 | 0.72 | 1.10E−01 | 1 | 17 |
| LBY29 | 0.72 | 4.59E−02 | 3 | 19 | LBY29 | 0.73 | 2.52E−02 | 6 | 1 |
| LBY29 | 0.80 | 3.08E−02 | 2 | 11 | LBY29 | 0.80 | 3.11E−02 | 2 | 23 |
| LBY30 | 0.87 | 2.34E−02 | 1 | 16 | LBY30 | 0.75 | 8.62E−02 | 1 | 9 |
| LBY30 | 0.77 | 7.08E−02 | 1 | 1 | LBY30 | 0.75 | 3.10E−02 | 3 | 21 |
| LBY30 | 0.78 | 1.30E−02 | 6 | 7 | LBY30 | 0.87 | 2.10E−03 | 6 | 5 |
| LBY30 | 0.90 | 9.76E−04 | 6 | 6 | LBY30 | 0.91 | 5.90E−04 | 6 | 20 |
| LBY30 | 0.80 | 3.14E−02 | 2 | 16 | LBY30 | 0.81 | 2.64E−02 | 2 | 1 |
| LBY31 | 0.85 | 7.08E−03 | 3 | 4 | LBY31 | 0.75 | 2.03E−02 | 6 | 7 |
| LBY31 | 0.88 | 1.74E−03 | 6 | 5 | LBY31 | 0.89 | 1.41E−03 | 6 | 6 |
| LBY31 | 0.84 | 1.87E−02 | 6 | 8 | LBY31 | 0.74 | 2.29E−02 | 6 | 20 |
| LBY31 | 0.75 | 5.39E−02 | 2 | 5 | LBY31 | 0.95 | 1.31E−03 | 2 | 12 |
| LBY31 | 0.80 | 1.63E−02 | 5 | 17 | LBY31 | 0.77 | 1.62E−02 | 4 | 19 |
| LBY32 | 0.71 | 4.86E−02 | 3 | 20 | LBY32 | 0.85 | 1.61E−02 | 2 | 21 |
| LBY32 | 0.85 | 1.58E−02 | 4 | 8 | LGN42 | 0.80 | 5.78E−02 | 1 | 7 |
| LGN42 | 0.79 | 6.30E−02 | 1 | 18 | LGN42 | 0.75 | 8.76E−02 | 1 | 20 |
| LGN42 | 0.86 | 6.55E−03 | 3 | 21 | LGN42 | 0.71 | 3.31E−02 | 6 | 5 |
| LGN42 | 0.71 | 3.13E−02 | 6 | 6 | LGN42 | 0.83 | 1.07E−02 | 5 | 11 |
| LGN42 | 0.73 | 3.93E−02 | 5 | 14 | LGN42 | 0.77 | 4.47E−02 | 4 | 13 |
| LGN43 | 0.74 | 9.43E−02 | 1 | 21 | LGN43 | 0.86 | 2.70E−02 | 1 | 23 |
| LGN43 | 0.81 | 4.93E−02 | 1 | 17 | LGN43 | 0.82 | 1.34E−02 | 3 | 21 |
| LGN43 | 0.74 | 2.25E−02 | 6 | 19 | LGN43 | 0.76 | 4.63E−02 | 2 | 16 |
| LGN44 | 0.92 | 1.02E−02 | 1 | 12 | LGN44 | 0.87 | 2.37E−02 | 1 | 2 |
| LGN44 | 0.92 | 8.31E−03 | 1 | 14 | LGN44 | 0.77 | 2.62E−02 | 3 | 12 |
| LGN44 | 0.71 | 3.34E−02 | 4 | 21 | LGN45 | 0.79 | 1.19E−02 | 6 | 15 |
| LGN45 | 0.95 | 8.48E−04 | 2 | 16 | LGN45 | 0.71 | 7.10E−02 | 2 | 1 |
| LGN46 | 0.90 | 1.32E−02 | 1 | 12 | LGN46 | 0.88 | 2.20E−02 | 1 | 2 |
| LGN46 | 0.92 | 8.53E−03 | 1 | 14 | LGN46 | 0.72 | 4.39E−02 | 3 | 19 |
| LGN46 | 0.79 | 1.98E−02 | 3 | 5 | LGN46 | 0.86 | 1.24E−02 | 3 | 8 |
| LGN46 | 0.73 | 3.86E−02 | 3 | 20 | LGN46 | 0.81 | 2.88E−02 | 2 | 2 |
| LGN46 | 0.89 | 6.58E−03 | 2 | 14 | LGN46 | 0.73 | 2.43E−02 | 4 | 19 |
| LGN47 | 0.83 | 4.18E−02 | 1 | 16 | LGN47 | 0.82 | 1.20E−02 | 3 | 20 |
| LGN47 | 0.75 | 2.07E−02 | 6 | 14 | LGN47 | 0.73 | 2.66E−02 | 6 | 1 |
| LGN47 | 0.71 | 7.40E−02 | 2 | 7 | LGN47 | 0.87 | 1.16E−02 | 2 | 21 |
| LGN47 | 0.74 | 5.78E−02 | 2 | 5 | LGN47 | 0.77 | 4.14E−02 | 2 | 6 |
| LGN47 | 0.71 | 7.14E−02 | 2 | 17 | LGN47 | 0.85 | 1.45E−02 | 2 | 12 |
| LGN47 | 0.83 | 1.97E−02 | 2 | 20 | LGN47 | 0.73 | 4.03E−02 | 5 | 10 |
| LGN47 | 0.77 | 7.12E−02 | 5 | 13 | LGN47 | 0.76 | 2.91E−02 | 5 | 2 |
| LGN47 | 0.97 | 4.74E−05 | 5 | 14 | LGN47 | 0.73 | 3.92E−02 | 5 | 1 |

TABLE 26-continued

Correlation between the expression level of selected genes of some embodiments of the invention in various tissues and the phenotypic performance under drought stress conditions across Barley accessions

| Gene Name | R | P value | Exp. set | Corr. Set ID | Gene Name | R | P value | Exp. set | Corr. Set ID |
|---|---|---|---|---|---|---|---|---|---|
| LGN47 | 0.85 | 1.64E−02 | 4 | 13 | LGN47 | 0.80 | 1.00E−02 | 4 | 14 |
| LGN47 | 0.93 | 3.28E−04 | 4 | 1 | LGN48 | 0.72 | 4.35E−02 | 3 | 18 |
| LGN48 | 0.72 | 4.29E−02 | 3 | 6 | LGN48 | 0.87 | 5.41E−03 | 3 | 20 |
| LGN48 | 0.74 | 5.87E−02 | 2 | 21 | LGN48 | 0.83 | 4.06E−02 | 5 | 13 |

Table 26 Provided are the correlations (R) between the genes expression levels in various tissues and the phenotypic performance. "Corr. ID"—correlation set ID according to the correlated parameters specified in Table 12. "Exp. Set"—Expression set specified in Table 9. "R" = Pearson correlation coefficient; "P" = p value.

TABLE 27

Correlation between the expression level of selected genes of some embodiments of the invention in various tissues and the phenotypic performance of maintenance of performance under drought conditions across Barley accessions

| Gene Name | R | P value | Exp. set | Corr. Set ID | Gene Name | R | P value | Exp. set | Corr. Set ID |
|---|---|---|---|---|---|---|---|---|---|
| LBY1 | 0.78 | 6.96E−02 | 1 | 15 | LBY1 | 0.92 | 1.31E−03 | 3 | 15 |
| LBY1 | 0.89 | 7.36E−03 | 2 | 16 | LBY18 | 0.85 | 3.23E−02 | 1 | 1 |
| LBY18 | 0.95 | 3.79E−03 | 1 | 14 | LBY18 | 0.77 | 2.63E−02 | 3 | 10 |
| LBY19 | 0.77 | 2.60E−02 | 3 | 16 | LBY19 | 0.74 | 5.55E−02 | 2 | 9 |
| LBY19 | 0.70 | 7.88E−02 | 2 | 18 | LBY19 | 0.78 | 2.17E−02 | 5 | 1 |
| LBY20 | 0.79 | 5.90E−02 | 1 | 6 | LBY20 | 0.79 | 6.23E−02 | 1 | 17 |
| LBY20 | 0.78 | 6.89E−02 | 1 | 5 | LBY20 | 0.73 | 9.86E−02 | 1 | 18 |
| LBY20 | 0.79 | 5.92E−02 | 1 | 7 | LBY20 | 0.73 | 6.22E−02 | 2 | 6 |
| LBY20 | 0.73 | 6.40E−02 | 2 | 17 | LBY20 | 0.73 | 6.33E−02 | 2 | 15 |
| LBY20 | 0.83 | 1.96E−02 | 2 | 20 | LBY20 | 0.70 | 7.89E−02 | 2 | 9 |
| LBY20 | 0.77 | 2.50E−02 | 5 | 6 | LBY20 | 0.71 | 4.90E−02 | 5 | 17 |
| LBY20 | 0.78 | 2.28E−02 | 5 | 5 | LBY21 | 0.83 | 4.21E−02 | 1 | 6 |
| LBY21 | 0.90 | 1.51E−02 | 1 | 17 | LBY21 | 0.94 | 5.11E−03 | 1 | 15 |
| LBY21 | 0.79 | 6.41E−02 | 1 | 5 | LBY21 | 0.74 | 9.34E−02 | 1 | 9 |
| LBY21 | 0.78 | 6.99E−02 | 1 | 18 | LBY21 | 0.93 | 6.84E−04 | 3 | 15 |
| LBY21 | 0.90 | 6.41E−03 | 2 | 16 | LBY21 | 0.74 | 3.64E−02 | 5 | 5 |
| LBY21 | 0.77 | 2.48E−02 | 5 | 12 | LBY22 | 0.79 | 1.95E−02 | 3 | 2 |
| LBY22 | 0.90 | 5.10E−03 | 2 | 6 | LBY22 | 0.89 | 8.08E−03 | 2 | 17 |
| LBY22 | 0.92 | 3.00E−03 | 2 | 5 | LBY22 | 0.87 | 9.93E−03 | 2 | 9 |
| LBY22 | 0.88 | 9.01E−03 | 2 | 18 | LBY22 | 0.81 | 1.48E−02 | 5 | 15 |
| LBY22 | 0.77 | 1.49E−02 | 4 | 6 | LBY22 | 0.73 | 2.43E−02 | 4 | 17 |
| LBY22 | 0.76 | 1.78E−02 | 4 | 5 | LBY23 | 0.80 | 5.42E−02 | 1 | 6 |
| LBY23 | 0.74 | 9.18E−02 | 1 | 17 | LBY23 | 0.88 | 2.12E−02 | 1 | 5 |
| LBY23 | 0.88 | 2.11E−02 | 1 | 18 | LBY23 | 0.89 | 1.70E−02 | 1 | 2 |
| LBY23 | 0.75 | 8.32E−02 | 1 | 12 | LBY23 | 0.83 | 2.22E−02 | 3 | 4 |
| LBY23 | 0.72 | 1.04E−01 | 2 | 4 | LBY23 | 0.85 | 7.72E−03 | 5 | 1 |
| LBY24 | 0.72 | 1.07E−01 | 1 | 17 | LBY24 | 0.80 | 5.62E−02 | 1 | 19 |
| LBY24 | 0.83 | 3.95E−02 | 1 | 13 | LBY24 | 0.74 | 3.62E−02 | 3 | 14 |
| LBY24 | 0.73 | 4.01E−02 | 3 | 13 | LBY24 | 0.77 | 4.45E−02 | 6 | 8 |
| LBY24 | 0.75 | 2.09E−02 | 6 | 7 | LBY24 | 0.88 | 2.23E−02 | 2 | 11 |
| LBY24 | 0.79 | 1.89E−02 | 5 | 19 | LBY24 | 0.74 | 2.36E−02 | 4 | 2 |
| LBY25 | 0.73 | 4.10E−02 | 5 | 12 | LBY26 | 0.70 | 1.21E−01 | 1 | 6 |
| LBY26 | 0.72 | 1.06E−01 | 1 | 7 | LBY26 | 0.80 | 1.61E−02 | 3 | 15 |
| LBY26 | 0.74 | 3.77E−02 | 3 | 14 | LBY26 | 0.71 | 3.31E−02 | 6 | 13 |
| LBY26 | 0.84 | 1.83E−02 | 2 | 16 | LBY26 | 0.86 | 1.25E−02 | 2 | 12 |
| LBY26 | 0.80 | 1.81E−02 | 5 | 6 | LBY26 | 0.80 | 1.83E−02 | 5 | 5 |
| LBY26 | 0.82 | 2.37E−02 | 5 | 4 | LBY26 | 0.71 | 5.07E−02 | 5 | 2 |
| LBY26 | 0.85 | 3.87E−03 | 4 | 19 | LBY26 | 0.70 | 5.13E−02 | 4 | 4 |
| LBY26 | 0.71 | 3.11E−02 | 4 | 3 | LBY27 | 0.85 | 7.44E−03 | 5 | 1 |
| LBY28 | 0.89 | 1.78E−02 | 1 | 6 | LBY28 | 0.87 | 2.53E−02 | 1 | 17 |
| LBY28 | 0.90 | 1.57E−02 | 1 | 5 | LBY28 | 0.93 | 7.37E−03 | 1 | 9 |
| LBY28 | 0.88 | 2.10E−02 | 1 | 18 | LBY28 | 0.70 | 1.19E−01 | 1 | 7 |
| LBY28 | 0.79 | 2.04E−02 | 3 | 6 | LBY28 | 0.81 | 1.55E−02 | 3 | 17 |
| LBY28 | 0.83 | 1.05E−02 | 3 | 5 | LBY28 | 0.71 | 4.70E−02 | 3 | 2 |
| LBY28 | 0.82 | 2.47E−02 | 2 | 6 | LBY28 | 0.75 | 5.02E−02 | 2 | 17 |
| LBY28 | 0.80 | 3.20E−02 | 2 | 5 | LBY28 | 0.77 | 1.58E−02 | 4 | 2 |
| LBY29 | 0.71 | 1.14E−01 | 1 | 15 | LBY29 | 0.76 | 2.94E−02 | 3 | 17 |
| LBY29 | 0.88 | 9.55E−03 | 2 | 6 | LBY29 | 0.83 | 1.97E−02 | 2 | 17 |
| LBY29 | 0.73 | 6.16E−02 | 2 | 15 | LBY29 | 0.86 | 1.37E−02 | 2 | 5 |
| LBY29 | 0.77 | 4.23E−02 | 2 | 9 | LBY29 | 0.79 | 3.55E−02 | 2 | 18 |
| LBY29 | 0.78 | 2.36E−02 | 5 | 15 | LBY29 | 0.76 | 1.65E−02 | 4 | 10 |
| LBY29 | 0.74 | 2.20E−02 | 4 | 1 | LBY30 | 0.81 | 5.04E−02 | 1 | 16 |
| LBY30 | 0.73 | 9.66E−02 | 1 | 19 | LBY30 | 0.76 | 2.91E−02 | 3 | 3 |

TABLE 27-continued

Correlation between the expression level of selected genes of some embodiments of the invention in various tissues and the phenotypic performance of maintenance of performance under drought conditions across Barley accessions

| Gene Name | R | P value | Exp. set | Corr. Set ID | Gene Name | R | P value | Exp. set | Corr. Set ID |
|---|---|---|---|---|---|---|---|---|---|
| LBY30 | 0.74 | 2.20E−02 | 6 | 6 | LBY30 | 0.82 | 6.23E−03 | 6 | 17 |
| LBY30 | 0.77 | 1.52E−02 | 6 | 5 | LBY30 | 0.71 | 4.75E−02 | 6 | 4 |
| LBY30 | 0.82 | 6.84E−03 | 6 | 9 | LBY30 | 0.80 | 8.90E−03 | 6 | 18 |
| LBY30 | 0.71 | 3.11E−02 | 6 | 7 | LBY30 | 0.76 | 4.88E−02 | 2 | 19 |
| LBY30 | 0.86 | 1.26E−02 | 2 | 14 | LBY30 | 0.90 | 2.17E−03 | 5 | 1 |
| LBY30 | 0.86 | 6.48E−03 | 5 | 3 | LBY31 | 0.72 | 1.06E−01 | 1 | 9 |
| LBY31 | 0.81 | 2.73E−02 | 3 | 4 | LBY31 | 0.74 | 5.67E−02 | 2 | 10 |
| LBY31 | 0.73 | 4.10E−02 | 5 | 6 | LBY31 | 0.81 | 1.46E−02 | 5 | 17 |
| LBY31 | 0.76 | 2.74E−02 | 5 | 5 | LBY32 | 0.83 | 4.19E−02 | 1 | 16 |
| LBY32 | 0.86 | 2.84E−02 | 1 | 1 | LBY32 | 0.81 | 1.56E−02 | 3 | 6 |
| LBY32 | 0.87 | 4.91E−03 | 3 | 17 | LBY32 | 0.75 | 3.23E−02 | 3 | 5 |
| LBY32 | 0.75 | 3.23E−02 | 3 | 18 | LBY32 | 0.71 | 5.01E−02 | 5 | 6 |
| LBY32 | 0.77 | 2.46E−02 | 5 | 10 | LBY32 | 0.72 | 4.51E−02 | 5 | 17 |
| LBY32 | 0.72 | 4.19E−02 | 5 | 15 | LBY32 | 0.75 | 3.06E−02 | 5 | 5 |
| LBY32 | 0.89 | 3.29E−03 | 5 | 12 | LGN42 | 0.80 | 5.73E−02 | 1 | 7 |
| LGN43 | 0.81 | 4.85E−02 | 1 | 16 | LGN43 | 0.88 | 1.93E−02 | 1 | 20 |
| LGN43 | 0.74 | 2.29E−02 | 6 | 16 | LGN43 | 0.89 | 6.74E−03 | 2 | 1 |
| LGN43 | 0.73 | 2.67E−02 | 4 | 15 | LGN44 | 0.73 | 9.79E−02 | 1 | 3 |
| LGN44 | 0.86 | 5.94E−03 | 3 | 10 | LGN44 | 0.82 | 1.20E−02 | 3 | 12 |
| LGN44 | 0.75 | 2.04E−02 | 6 | 9 | LGN44 | 0.82 | 2.34E−02 | 2 | 19 |
| LGN44 | 0.81 | 1.42E−02 | 5 | 1 | LGN45 | 0.75 | 5.31E−02 | 2 | 16 |
| LGN45 | 0.72 | 6.72E−02 | 2 | 14 | LGN45 | 0.76 | 4.90E−02 | 2 | 13 |
| LGN46 | 0.77 | 7.35E−02 | 1 | 12 | LGN46 | 0.85 | 6.91E−03 | 3 | 6 |
| LGN46 | 0.91 | 1.91E−03 | 3 | 17 | LGN46 | 0.86 | 6.03E−03 | 3 | 5 |
| LGN46 | 0.74 | 5.74E−02 | 3 | 4 | LGN46 | 0.76 | 2.73E−02 | 3 | 2 |
| LGN46 | 0.74 | 2.35E−02 | 6 | 10 | LGN46 | 0.82 | 6.62E−03 | 6 | 15 |
| LGN46 | 0.75 | 5.38E−02 | 6 | 8 | LGN46 | 0.85 | 8.19E−03 | 5 | 1 |
| LGN46 | 0.78 | 1.35E−02 | 4 | 2 | LGN47 | 0.74 | 9.16E−02 | 1 | 19 |
| LGN47 | 0.77 | 7.20E−02 | 1 | 13 | LGN47 | 0.92 | 1.16E−03 | 3 | 6 |
| LGN47 | 0.97 | 9.54E−05 | 3 | 17 | LGN47 | 0.89 | 2.94E−03 | 3 | 5 |
| LGN47 | 0.83 | 9.98E−03 | 3 | 18 | LGN47 | 0.76 | 4.68E−02 | 2 | 6 |
| LGN47 | 0.86 | 1.20E−02 | 2 | 10 | LGN47 | 0.87 | 1.16E−02 | 2 | 17 |
| LGN47 | 0.72 | 6.78E−02 | 2 | 15 | LGN47 | 0.77 | 4.37E−02 | 2 | 5 |
| LGN47 | 0.85 | 1.48E−02 | 2 | 9 | LGN47 | 0.82 | 2.37E−02 | 2 | 18 |
| LGN47 | 0.70 | 7.79E−02 | 2 | 7 | LGN47 | 0.75 | 5.21E−02 | 2 | 12 |
| LGN48 | 0.92 | 1.30E−03 | 3 | 6 | LGN48 | 0.96 | 1.83E−04 | 3 | 17 |
| LGN48 | 0.89 | 2.83E−03 | 3 | 5 | LGN48 | 0.88 | 3.88E−03 | 3 | 18 |

Table 27. Provided are the correlations (R) between the genes expression levels in various tissues and the phenotypic performance. "Corr. ID"—correlation set ID according to the correlated parameters specified in Table 13. "Exp. Set"—Expression set specified in Table 9. "R" = Pearson correlation coefficient; "P" = p value.

TABLE 28

Correlation between the expression level of selected genes of some embodiments of the invention in various tissues and the phenotypic performance under normal and low nitrogen growth conditions across Barley accessions (set 1)

| Gene Name | R | P value | Exp. set | Corr. Set ID | Gene Name | R | P value | Exp. set | Corr. Set ID |
|---|---|---|---|---|---|---|---|---|---|
| LBY1 | 0.71 | 3.15E−02 | 2 | 34 | LBY1 | 0.70 | 3.44E−02 | 2 | 11 |
| LBY18 | 0.77 | 2.51E−02 | 4 | 28 | LBY18 | 0.71 | 3.32E−02 | 2 | 18 |
| LBY18 | 0.90 | 1.05E−03 | 2 | 27 | LBY18 | 0.86 | 3.24E−03 | 2 | 17 |
| LBY19 | 0.70 | 2.36E−02 | 5 | 19 | LBY19 | 0.83 | 3.14E−03 | 5 | 38 |
| LBY19 | 0.72 | 2.90E−02 | 2 | 27 | LBY19 | 0.78 | 1.30E−02 | 3 | 31 |
| LBY19 | 0.80 | 9.83E−03 | 3 | 19 | LBY19 | 0.89 | 1.28E−03 | 3 | 38 |
| LBY19 | 0.85 | 4.12E−03 | 3 | 6 | LBY19 | 0.71 | 3.25E−02 | 3 | 16 |
| LBY20 | 0.71 | 3.15E−02 | 1 | 32 | LBY21 | 0.83 | 5.99E−03 | 3 | 24 |
| LBY21 | 0.73 | 2.69E−02 | 3 | 25 | LBY21 | 0.82 | 6.55E−03 | 3 | 33 |
| LBY22 | 0.74 | 3.63E−02 | 4 | 10 | LBY22 | 0.85 | 3.54E−03 | 2 | 27 |
| LBY22 | 0.87 | 2.26E−03 | 2 | 17 | LBY23 | 0.79 | 1.20E−02 | 1 | 31 |
| LBY23 | 0.81 | 8.03E−03 | 1 | 19 | LBY23 | 0.80 | 9.98E−03 | 1 | 35 |
| LBY23 | 0.87 | 2.05E−03 | 1 | 38 | LBY23 | 0.78 | 1.26E−02 | 1 | 6 |
| LBY23 | 0.92 | 4.36E−04 | 2 | 27 | LBY23 | 0.84 | 4.29E−03 | 2 | 17 |
| LBY24 | 0.77 | 2.63E−02 | 6 | 28 | LBY24 | 0.73 | 4.06E−02 | 6 | 27 |
| LBY24 | 0.77 | 2.56E−02 | 6 | 17 | LBY24 | 0.73 | 2.67E−02 | 1 | 7 |
| LBY24 | 0.71 | 5.06E−02 | 4 | 12 | LBY24 | 0.74 | 1.42E−02 | 5 | 8 |
| LBY24 | 0.80 | 5.91E−03 | 5 | 20 | LBY25 | 0.88 | 1.81E−03 | 2 | 21 |
| LBY26 | 0.71 | 3.17E−02 | 1 | 20 | LBY26 | 0.82 | 7.15E−03 | 2 | 28 |
| LBY26 | 0.80 | 9.94E−03 | 3 | 16 | LBY27 | 0.73 | 4.17E−02 | 6 | 21 |

TABLE 28-continued

Correlation between the expression level of selected genes of some embodiments of the invention in various tissues and the phenotypic performance under normal and low nitrogen growth conditions across Barley accessions (set 1)

| Gene Name | R | P value | Exp. set | Corr. Set ID | Gene Name | R | P value | Exp. set | Corr. Set ID |
|---|---|---|---|---|---|---|---|---|---|
| LBY27 | 0.81 | 1.59E−02 | 6 | 27 | LBY27 | 0.97 | 6.16E−05 | 6 | 13 |
| LBY27 | 0.70 | 2.40E−02 | 5 | 8 | LBY27 | 0.74 | 1.38E−02 | 5 | 20 |
| LBY27 | 0.90 | 8.31E−04 | 2 | 21 | LBY27 | 0.82 | 6.71E−03 | 3 | 3 |
| LBY27 | 0.78 | 1.26E−02 | 3 | 8 | LBY28 | 0.76 | 2.89E−02 | 6 | 18 |
| LBY28 | 0.86 | 1.35E−03 | 5 | 7 | LBY28 | 0.75 | 1.31E−02 | 5 | 24 |
| LBY28 | 0.70 | 2.36E−02 | 5 | 33 | LBY28 | 0.99 | 1.21E−06 | 2 | 27 |
| LBY28 | 0.93 | 3.28E−04 | 2 | 17 | LBY28 | 0.85 | 3.52E−03 | 3 | 7 |
| LBY28 | 0.78 | 1.38E−02 | 3 | 20 | LBY29 | 0.70 | 2.31E−02 | 5 | 19 |
| LBY29 | 0.93 | 2.63E−04 | 3 | 31 | LBY29 | 0.86 | 3.19E−03 | 3 | 19 |
| LBY29 | 0.72 | 2.74E−02 | 3 | 3 | LBY29 | 0.82 | 7.14E−03 | 3 | 38 |
| LBY30 | 0.80 | 1.81E−02 | 4 | 12 | LBY30 | 0.71 | 2.12E−02 | 5 | 7 |
| LBY30 | 0.77 | 1.60E−02 | 3 | 32 | LBY31 | 0.81 | 1.44E−02 | 6 | 17 |
| LBY31 | 0.79 | 7.10E−03 | 5 | 36 | LBY32 | 0.72 | 4.35E−02 | 6 | 34 |
| LBY32 | 0.74 | 3.75E−02 | 6 | 10 | LBY32 | 0.70 | 5.14E−02 | 6 | 27 |
| LBY32 | 0.85 | 8.13E−03 | 6 | 13 | LBY32 | 0.83 | 5.58E−03 | 2 | 21 |
| LGN42 | 0.75 | 1.32E−02 | 5 | 24 | LGN42 | 0.73 | 1.67E−02 | 5 | 25 |
| LGN43 | 0.79 | 1.93E−02 | 6 | 21 | LGN43 | 0.81 | 1.50E−02 | 6 | 13 |
| LGN43 | 0.88 | 1.66E−03 | 1 | 32 | LGN43 | 0.70 | 3.41E−02 | 2 | 29 |
| LGN43 | 0.86 | 3.26E−03 | 2 | 27 | LGN43 | 0.81 | 8.55E−03 | 2 | 17 |
| LGN43 | 0.87 | 2.05E−03 | 3 | 31 | LGN43 | 0.78 | 1.37E−02 | 3 | 38 |
| LGN44 | 0.76 | 1.14E−02 | 5 | 8 | LGN44 | 0.72 | 2.92E−02 | 2 | 18 |
| LGN44 | 0.97 | 1.76E−05 | 2 | 27 | LGN44 | 0.94 | 1.29E−04 | 2 | 17 |
| LGN45 | 0.71 | 4.90E−02 | 4 | 21 | LGN46 | 0.79 | 2.04E−02 | 6 | 17 |
| LGN46 | 0.88 | 1.77E−03 | 1 | 31 | LGN46 | 0.84 | 4.20E−03 | 1 | 19 |
| LGN46 | 0.86 | 3.14E−03 | 1 | 38 | LGN46 | 0.80 | 1.67E−02 | 4 | 18 |
| LGN46 | 0.84 | 2.44E−03 | 5 | 3 | LGN46 | 0.74 | 2.24E−02 | 2 | 14 |
| LGN46 | 0.75 | 2.09E−02 | 3 | 35 | LGN46 | 0.79 | 1.17E−02 | 3 | 38 |
| LGN47 | 0.94 | 4.33E−04 | 6 | 12 | LGN47 | 0.72 | 4.30E−02 | 6 | 18 |
| LGN47 | 0.77 | 2.68E−02 | 6 | 4 | LGN47 | 0.78 | 2.28E−02 | 6 | 17 |
| LGN47 | 1.00 | 3.30E−09 | 1 | 31 | LGN47 | 0.79 | 1.08E−02 | 1 | 19 |
| LGN47 | 0.76 | 1.78E−02 | 1 | 38 | LGN47 | 0.72 | 2.86E−02 | 1 | 36 |
| LGN47 | 0.84 | 4.27E−03 | 4 | 16 | LGN47 | 0.73 | 4.11E−02 | 4 | 10 |
| LGN47 | 0.83 | 1.15E−02 | 4 | 30 | LGN47 | 0.91 | 1.52E−03 | 4 | 13 |
| LGN47 | 0.74 | 3.45E−02 | 4 | 23 | LGN47 | 0.82 | 3.71E−03 | 5 | 36 |
| LGN47 | 0.80 | 9.17E−03 | 2 | 34 | LGN47 | 0.90 | 9.98E−04 | 2 | 12 |
| LGN47 | 0.70 | 3.45E−02 | 2 | 10 | LGN47 | 0.71 | 3.16E−02 | 2 | 14 |
| LGN47 | 0.73 | 2.51E−02 | 2 | 13 | LGN47 | 0.83 | 5.37E−03 | 3 | 36 |
| LGN47 | 0.75 | 1.97E−02 | 3 | 16 | LGN48 | 0.80 | 5.58E−03 | 5 | 7 |
| LGN48 | 0.72 | 1.84E−02 | 5 | 37 | LGN48 | 0.81 | 8.00E−03 | 3 | 19 |
| LGN48 | 0.72 | 2.86E−02 | 3 | 3 | LGN48 | 0.75 | 2.08E−02 | 3 | 38 |

Table 28. Provided are the correlations (R) between the genes expression levels in various tissues and the phenotypic performance. "Corr. ID"—correlation set ID according to the correlated parameters specified Table 14. "Exp. Set"—Expression set specified in Table 10. "R" = Pearson correlation coefficient; "P" = p value.

TABLE 29

Correlation between the expression level of selected genes of some embodiments of the invention in various tissues and the phenotypic performance under low nitrogen and normal growth conditions across Barley accessions (set 2)

| Gene Name | R | P value | Exp. set | Corr. Set ID | Gene Name | R | P value | Exp. set | Corr. Set ID |
|---|---|---|---|---|---|---|---|---|---|
| LBY1 | 0.77 | 9.07E−03 | 5 | 14 | LBY1 | 0.73 | 1.68E−02 | 5 | 13 |
| LBY18 | 0.81 | 4.82E−03 | 1 | 13 | LBY18 | 0.76 | 1.10E−02 | 1 | 16 |
| LBY19 | 0.71 | 2.06E−02 | 5 | 17 | LBY19 | 0.77 | 9.36E−03 | 4 | 17 |
| LBY20 | 0.80 | 5.61E−03 | 6 | 13 | LBY21 | 0.70 | 2.35E−02 | 5 | 14 |
| LBY21 | 0.74 | 1.46E−02 | 5 | 13 | LBY21 | 0.74 | 1.53E−02 | 1 | 17 |
| LBY22 | 0.81 | 4.84E−03 | 5 | 17 | LBY23 | 0.74 | 1.51E−02 | 2 | 4 |
| LBY24 | 0.71 | 2.12E−02 | 2 | 9 | LBY25 | 0.71 | 2.26E−02 | 2 | 6 |
| LBY26 | 0.74 | 1.52E−02 | 3 | 1 | LBY26 | 0.80 | 5.88E−03 | 4 | 1 |
| LBY26 | 0.78 | 7.38E−03 | 4 | 3 | LBY27 | 0.81 | 4.78E−03 | 5 | 17 |
| LBY32 | 0.81 | 4.28E−03 | 5 | 17 | LGN42 | 0.76 | 1.07E−02 | 5 | 9 |
| LGN42 | 0.73 | 1.58E−02 | 1 | 11 | LGN43 | 0.75 | 1.24E−02 | 2 | 9 |
| LGN43 | 0.70 | 2.38E−02 | 3 | 1 | LGN44 | 0.76 | 1.09E−02 | 3 | 13 |
| LGN44 | 0.74 | 1.36E−02 | 4 | 15 | LGN45 | 0.72 | 1.96E−02 | 2 | 5 |
| LGN45 | 0.74 | 1.35E−02 | 3 | 2 | LGN45 | 0.72 | 1.82E−02 | 3 | 3 |
| LGN46 | 0.83 | 3.08E−03 | 3 | 5 | LGN47 | 0.74 | 1.38E−02 | 3 | 14 |
| LGN47 | 0.81 | 4.94E−03 | 5 | 17 | LGN48 | 0.93 | 1.22E−04 | 2 | 6 |

TABLE 29-continued

Correlation between the expression level of selected genes of some embodiments of the invention in various tissues and the phenotypic performance under low nitrogen and normal growth conditions across Barley accessions (set 2)

| Gene Name | R | P value | Exp. set | Corr. Set ID | Gene Name | R | P value | Exp. set | Corr. Set ID |
|---|---|---|---|---|---|---|---|---|---|
| LGN48 | 0.72 | 2.00E−02 | 2 | 5 | LGN48 | 0.74 | 1.51E−02 | 2 | 7 |
| LGN48 | 0.73 | 1.72E−02 | 2 | 8 | LGN48 | 0.80 | 5.51E−03 | 3 | 13 |
| LGN48 | 0.78 | 8.39E−03 | 3 | 16 | LGN48 | 0.79 | 6.04E−03 | 5 | 17 |

Table 29. Provided are the correlations (R) between the genes expression levels in various tissues and the phenotypic performance. "Corr. ID"—correlation set ID according to the correlated parameters specified in Table 15. "Exp. Set"—Expression set specified in Table 11 (Exp. Set 1, 3, 5 under low N growth conditions. Exp. Set 2, 4, 6 under normal growth conditions). "R" = Pearson correlation coefficient; "P" = p value.

Example 5

Production of Arabidopsis Transcriptome and High Throughput Correlation Analysis of Yield, Biomass and/or Vigor Related Parameters Using 44K Arabidopsis Full Genome Oligonucleotide Micro-Array To produce a high throughput correlation analysis, the present inventors utilized an *Arabidopsis thaliana* oligonucleotide micro-array, produced by Agilent Technologies [chem. (dot) agilent (dot) com/Scripts/PDS (dot) asp?1Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Analyzed *Arabidopsis* tissues—Five tissues at different developmental stages including root, leaf, flower at anthesis, seed at 5 days after flowering (DAF) and seed at 12 DAF, representing different plant characteristics, were sampled and RNA was extracted as described as described hereinabove under "GENERAL EXPERIMENTAL AND BIOINFORMATICS METHODS". For convenience, each micro-array expression information tissue type has received a Set ID as summarized in Table 30 below.

TABLE 30

Tissues used for *Arabidopsis* transcriptome expression sets

| Expression Set | Set ID |
|---|---|
| Leaf | 1 |
| Root | 2 |
| Seed 5 DAF | 3 |
| Flower | 4 |
| Seed 12 DAF | 5 |

Table 30: Provided are the identification (ID) digits of each of the *Arabidopsis* expression sets (1-5). DAF = days after flowering.

Yield components and vigor related parameters assessment—Eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K [nitrogen (N), phosphorus (P) and potassium (K)] fertilizer (20:20:20; weight ratios) was added. During this time data was collected, documented and analyzed. Additional data was collected through the seedling stage of plants grown in a tissue culture in vertical grown transparent agar plates. Most of chosen parameters were analyzed by digital imaging.

Digital imaging in Tissue culture (seedling assay)—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37, Java based image processing program, which was developed at the U.S National Institutes of Health and is freely available on the internet at rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 3 days starting at day 7 in the photography room and the roots development was documented (see examples in FIGS. 3A-3F). The growth rate of root coverage was calculated according to Formula XXVIII above.

Vegetative growth rate analysis—was calculated according to Formula VII above. The analysis was ended with the appearance of overlapping plants.

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra-Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The vegetative portion above ground was separated from the seeds. The total weight of the vegetative portion above ground and the seed weight of each plot were measured and divided by the number of plants.

Dry weight (vegetative biomass)=total weight of the vegetative portion above ground (excluding roots) after drying at 30° C. in a drying chamber; all the above ground biomass that is not yield.

Seed yield per plant=total seed weight per plant (gr).

Oil yield—The oil yield was calculated using Formula XXIX above.

Harvest Index (seed)—The harvest index was calculated using Formula XV (described above).

Experimental Results

Nine different *Arabidopsis* ecotypes were grown and characterized for 18 parameters (named as vectors).

TABLE 31

Arabidopsis correlated parameters (vectors)

| Correlated parameter with | Correlation ID |
| --- | --- |
| Blade circularity (cm) | 1 |
| Dry matter per plant (gr) | 2 |
| Harvest Index (value) | 3 |
| Lamina length (cm) | 4 |
| Lamina width (cm) | 5 |
| Leaf width/length (ratio) | 6 |
| Oil % per seed (percent) | 7 |
| Oil yield per plant (mg) | 8 |
| Seeds per silique (number) | 9 |
| Silique length (cm) | 10 |
| Total Leaf Area per plant (cm$^2$) | 11 |
| Vegetative growth rate (cm$^2$/day) | 12 |
| Until leaves were in overlap | |
| Fresh weight (gr) (at bolting stage) | 13 |
| Relative root growth (cm/day) in early seedling stages | 14 |
| Root length day 13 (cm) | 15 |
| Root length day 7 (cm) | 16 |
| 1000 Seed weight (gr) | 17 |
| Seed yield per plant (gr) | 18 |

Table 31. Provided are the *Arabidopsis* correlated parameters (correlation ID Nos. 1-18). Abbreviations: Cm = centimeter(s); gr = gram(s); mg = milligram(s).

The characterized values are summarized in Table 32. Correlation analysis is provided in Table 52 below.

TABLE 32

Measured parameters in Arabidopsis ecotypes

| Ecotype/ Treatment | Line-1 | Line-2 | Line-3 | Line-4 | Line-5 | Line-6 | Line-7 | Line-8 | Line-9 |
| --- | --- | --- | --- | --- | --- | --- | --- | --- | --- |
| 1 | 0.51 | 0.48 | 0.45 | 0.37 | 0.50 | 0.38 | 0.39 | 0.49 | 0.41 |
| 2 | 0.64 | 1.27 | 1.05 | 1.28 | 1.69 | 1.34 | 0.81 | 1.21 | 1.35 |
| 3 | 0.53 | 0.35 | 0.56 | 0.33 | 0.37 | 0.32 | 0.45 | 0.51 | 0.41 |
| 4 | 2.77 | 3.54 | 3.27 | 3.78 | 3.69 | 4.60 | 3.88 | 3.72 | 4.15 |
| 5 | 1.38 | 1.70 | 1.46 | 1.37 | 1.83 | 1.65 | 1.51 | 1.82 | 1.67 |
| 6 | 0.35 | 0.29 | 0.32 | 0.26 | 0.36 | 0.27 | 0.30 | 0.34 | 0.31 |
| 7 | 34.42 | 31.19 | 38.05 | 27.76 | 35.49 | 32.91 | 31.56 | 30.79 | 34.02 |
| 8 | 118.63 | 138.73 | 224.06 | 116.26 | 218.27 | 142.11 | 114.15 | 190.06 | 187.62 |
| 9 | 45.44 | 53.47 | 58.47 | 35.27 | 48.56 | 37.00 | 39.38 | 40.53 | 25.53 |
| 10 | 1.06 | 1.26 | 1.31 | 1.47 | 1.24 | 1.09 | 1.18 | 1.18 | 1.00 |
| 11 | 46.86 | 109.89 | 58.36 | 56.80 | 114.66 | 110.82 | 88.49 | 121.79 | 93.04 |
| 12 | 0.31 | 0.38 | 0.48 | 0.47 | 0.43 | 0.64 | 0.43 | 0.38 | 0.47 |
| 13 | 1.51 | 3.61 | 1.94 | 2.08 | 3.56 | 4.34 | 3.47 | 3.48 | 3.71 |
| 14 | 0.63 | 0.66 | 1.18 | 1.09 | 0.91 | 0.77 | 0.61 | 0.70 | 0.78 |

TABLE 32-continued

Measured parameters in Arabidopsis ecotypes

| Ecotype/<br>Treatment | Line-<br>1 | Line-<br>2 | Line-<br>3 | Line-<br>4 | Line-<br>5 | Line-<br>6 | Line-<br>7 | Line-<br>8 | Line-<br>9 |
|---|---|---|---|---|---|---|---|---|---|
| 15 | 4.42 | 8.53 | 5.62 | 4.83 | 5.96 | 6.37 | 5.65 | 7.06 | 7.04 |
| 16 | 0.94 | 1.76 | 0.70 | 0.73 | 0.99 | 1.16 | 1.28 | 1.41 | 1.25 |
| 17 | 0.02 | 0.02 | 0.03 | 0.03 | 0.02 | 0.03 | 0.02 | 0.02 | 0.02 |
| 18 | 0.34 | 0.44 | 0.59 | 0.42 | 0.61 | 0.43 | 0.36 | 0.62 | 0.55 |

Table 32. Provided are the values of each of the parameters measured in Arabidopsis ecotypes.

TABLE 33

Correlation between the expression level of selected genes of some embodiments of the invention in various tissues and the phenotypic performance under normal conditions across Arabidopsis accessions

| Gene<br>Name | R | P value | Exp.<br>set | Corr.<br>Set ID | Gene<br>Name | R | P value | Exp.<br>set | Corr.<br>Set ID |
|---|---|---|---|---|---|---|---|---|---|
| LBY16 | 0.82 | 1.37E−02 | 5 | 4 | LBY16 | 0.72 | 4.38E−02 | 5 | 12 |
| LBY16 | 0.76 | 2.78E−02 | 1 | 18 | LBY16 | 0.86 | 6.45E−03 | 1 | 7 |
| LBY16 | 0.87 | 4.99E−03 | 1 | 8 | LBY17 | 0.78 | 2.22E−02 | 2 | 17 |
| LBY17 | 0.79 | 2.04E−02 | 2 | 14 | LBY17 | 0.73 | 3.98E−02 | 1 | 1 |

Table 33. Provided are the correlations (R) between the expression levels of yield improving genes and their homologues in tissues [leaf, flower, seed and root; Expression sets (Exp)] and the phenotypic performance in various yield, biomass, growth rate and/or vigor components [Correlation vector (corr.)] under normal conditions across Arabidopsis accessions. "Corr. ID"—correlation set ID according to the correlated parameters specified in Table 31. "Exp. Set"—Expression set specified in Table 30. "R" = Pearson correlation coefficient; "P" = p value.

Example 6

Production of Sorghum Transcriptome and High Throughput Correlation Analysis with ABST Related Parameters Using 44K Sorghum Oligonucleotide Micro-Arrays In order to produce a high throughput correlation analysis between plant phenotype and gene expression level, the present inventors utilized a sorghum oligonucleotide microarray, produced by Agilent Technologies [chem. (dot) agilent (dot) com/Scripts/PDS (dot) asp?1Page=50879]. The array oligonucleotide represents about 44,000 sorghum genes and transcripts. In order to define correlations between the levels of RNA expression with ABST, yield and NUE components or vigor related parameters, various plant characteristics of 17 different sorghum hybrids were analyzed. Among them, 10 hybrids encompassing the observed variance were selected for RNA expression analysis. The correlation between the RNA levels and the characterized parameters was analyzed using Pearson correlation test [davidmlane (dot) com/hyperstat/A34739 (dot) html].

I. Correlation of Sorghum Varieties Across Ecotypes Grown Under Regular Growth Conditions, Severe Drought Conditions and Low Nitrogen Conditions

Experimental Procedures

17 Sorghum varieties were grown in 3 repetitive plots, in field. Briefly, the growing protocol was as follows:

1. Regular growth conditions: Sorghum plants were grown in the field using commercial fertilization and irrigation protocols (370,000 liter per dunam (1000 square meters), fertilization of 14 units of nitrogen per dunam entire growth period).

2. Drought conditions: Sorghum seeds were sown in soil and grown under normal condition until around 35 days from sowing, around stage V8 (eight green leaves are fully expanded, booting not started yet). At this point, irrigation was stopped, and severe drought stress was developed.

3. Low Nitrogen fertilization conditions: Sorghum plants were fertilized with 50% less amount of nitrogen in the field than the amount of nitrogen applied in the regular growth treatment. All the fertilizer was applied before flowering.

Analyzed Sorghum tissues—All 10 selected Sorghum hybrids were sampled per each treatment. Tissues [Flag leaf, Flower meristem and Flower] from plants growing under normal conditions, severe drought stress and low nitrogen conditions were sampled and RNA was extracted as described above. Each micro-array expression information tissue type has received a Set ID as summarized in Table 34 below.

TABLE 34

Sorghum transcriptome expression sets

| Expression Set | Set ID |
|---|---|
| Flag leaf at flowering stage under drought growth conditions | 1 |
| Flag leaf at flowering stage under low nitrogen growth conditions | 2 |
| Flag leaf at flowering stage under normal growth conditions | 3 |
| Flower meristem at flowering stage under drought growth conditions | 4 |
| Flower meristem at flowering stage under low nitrogen growth conditions | 5 |
| Flower meristem at flowering stage under normal growth conditions | 6 |
| Flower at flowering stage under drought growth conditions | 7 |

TABLE 34-continued

Sorghum transcriptome expression sets

| Expression Set | Set ID |
|---|---|
| Flower at flowering stage under low nitrogen growth conditions | 8 |
| Flower at flowering stage under normal growth conditions | 9 |

Table 34: Provided are the sorghum transcriptome expression sets 1-9. Flag leaf = the leaf below the flower; Flower meristem = Apical meristem following panicle initiation; Flower = the flower at the anthesis day. Expression sets 3, 6, and 9 are from plants grown under normal conditions; Expression sets 2, 5 and 8 are from plants grown under Nitrogen-limiting conditions; Expression sets 1, 4 and 7 are from plants grown under drought conditions.

The following parameters were collected using digital imaging system:

At the end of the growing period the grains were separated from the Plant 'Head' and the following parameters were measured and collected:

Average Grain Area ($cm^2$)—A sample of ~200 grains was weighted, photographed and images were processed using the below described image processing system. The grain area was measured from those images and was divided by the number of grains.

Upper and Lower Ratio Average of Grain Area, width, length, diameter and perimeter—Grain projection of area, width, diameter and perimeter were extracted from the digital images using open source package imagej (nih). Seed data was analyzed in plot average levels as follows:

Average of all seeds;
Average of upper 20% fraction—contained upper 20% fraction of seeds;
Average of lower 20% fraction—contained lower 20% fraction of seeds;

Further on, ratio between each fraction and the plot average was calculated for each of the data parameters.

At the end of the growing period 5 'Heads' were photographed and images were processed using the below described image processing system.

(i) Head Average Area ($cm^2$)—At the end of the growing period 5 'Heads' were photographed and images were processed using the below described image processing system. The 'Head' area was measured from those images and was divided by the number of 'Heads'.

(ii) Head Average Length (cm)—At the end of the growing period 5 'Heads' were photographed and images were processed using the below described image processing system. The 'Head' length (longest axis) was measured from those images and was divided by the number of 'Heads'.

(iii) Head Average width (cm)—At the end of the growing period 5 'Heads' were photographed and images were processed using the below described image processing system. The 'Head' width was measured from those images and was divided by the number of 'Heads'.

(iv) Head Average perimeter (cm)—At the end of the growing period 5 'Heads' were photographed and images were processed using the below described image processing system. The 'Head' perimeter was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Grain Weight/Head (gr.) (grain yield)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head/Plant gram—At the end of the experiment (when heads were harvested) total and 5 selected heads per plots within blocks A-C were collected separately. The heads (total and 5) were weighted (gr.) separately and the average fresh weight per plant was calculated for total (FW Head/Plant gr. based on plot) and for 5 (FW Head/Plant gr. based on 5 plants) plants.

Plant height—Plants were characterized for height during growing period at 5 time points. In each measure, plants were measured for their height using a measuring tape. Height was measured from ground level to top of the longest leaf.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative fresh weight and Heads—At the end of the experiment (when Inflorescence were dry) all Inflorescence and vegetative material from plots within blocks A-C were collected. The biomass and Heads weight of each plot was separated, measured and divided by the number of Heads.

Plant biomass (Fresh weight)—At the end of the experiment (when Inflorescence were dry) the vegetative material from plots within blocks A-C were collected. The plants biomass without the Inflorescence were measured and divided by the number of Plants.

FW Heads/(FW Heads+FW Plants)—The total fresh weight of heads and their respective plant biomass were measured at the harvest day. The heads weight was divided by the sum of weights of heads and plants.

Experimental Results 17 different sorghum varieties were grown and characterized for different parameters: The average for each of the measured parameters was calculated using the JMP software (Tables 36-37) and a subsequent correlation analysis between the various transcriptome sets (Table 34) and the average parameters, was conducted (Table 38). Results were then integrated to the database.

TABLE 35

Sorghum correlated parameters (vectors)

| Correlated parameter with | Correlation ID |
|---|---|
| Average Grain Area ($cm^2$), Drought | 1 |
| Average Grain Area ($cm^2$), Low N | 2 |
| Average Grain Area ($cm^2$), Normal | 3 |
| FW-Head/Plant (gr) (based on plot), Drought | 4 |

TABLE 35-continued

Sorghum correlated parameters (vectors)

| Correlated parameter with | Correlation ID |
|---|---|
| FW-Head/Plant (gr.) (based on plot), Low N | 5 |
| FW-Head/Plant (gr.) (based on plot), Normal | 6 |
| FW-Head/Plant (gr.) (based on 5 plants), Low N | 7 |
| FW-Head/Plant (gr.) (based on 5 plants), Normal | 8 |
| FW Heads/(FW Heads + FW Plants) (all plot), Drought | 9 |
| FW Heads/(FW Heads + FW Plants) (all plot), Low N | 10 |
| FW Heads/(FW Heads + FW Plants) (all plot), Normal | 11 |
| FW/Plant (gr) (based on plot), Drought | 12 |
| FW/Plant (gr.) (based on plot), Low N | 13 |
| FW/Plant (gr.) (based on plot), Normal | 14 |
| Final Plant Height (cm), Drought | 15 |
| Final Plant Height (cm), Low N | 16 |
| Final Plant Height (cm), Normal | 17 |
| Head Average Area (cm$^2$), Drought | 18 |
| Head Average Area (cm$^2$), Low N | 19 |
| Head Average Area (cm$^2$), Normal | 20 |
| Head Average Length (cm), Drought | 21 |
| Head Average Length (cm), Low N | 22 |
| Head Average Length (cm), Normal | 23 |
| Head Average Perimeter (cm), Drought | 24 |
| Head Average Perimeter (cm), Low N | 25 |
| Head Average Perimeter (cm), Normal | 26 |
| Head Average Width (cm), Drought | 27 |
| Head Average Width (cm), Low N | 28 |
| Head Average Width (cm), Normal | 29 |
| Leaf SPAD 64 DPS (Days Post Sowing), Drought | 30 |
| Leaf SPAD 64 DPS (Days Post Sowing), Low N | 31 |
| Leaf SPAD 64 DPS (Days Post Sowing), Normal | 32 |
| Lower Ratio Average Grain Area (value), Low N | 33 |
| Lower Ratio Average Grain Area (value), Normal | 34 |
| Lower Ratio Average Grain Length (value), Low N | 35 |
| Lower Ratio Average Grain Length (value), Normal | 36 |
| Lower Ratio Average Grain Perimeter (value), Low N | 37 |
| Lower Ratio Average Grain Perimeter, (value) Normal | 38 |
| Lower Ratio Average Grain Width (value), Low N | 39 |
| Lower Ratio Average Grain Width (value), Normal | 40 |
| Total grain weight/Head (based on plot) (gr.), Low N | 41 |
| Total grain weight/Head (gr.) (based on 5 heads), Low N | 42 |
| Total grain weight/Head (gr.) (based on 5 heads), Normal | 43 |
| Total grain weight/Head (gr.) (based on plot), Normal | 44 |
| Total grain weight/Head (gr.) (based on plot), Drought | 45 |
| Upper Ratio Average Grain Area, Drought (value) | 46 |
| Upper Ratio Average Grain Area (value), Low N | 47 |
| Upper Ratio Average Grain Area (value), Normal | 48 |
| [Grain Yield + plant biomass/SPAD 64 DPS] (gr.), Normal | 49 |
| [Grain Yield + plant biomass/SPAD 64 DPS] (gr.), Low N | 50 |
| [Grain yield/SPAD 64 DPS] (gr.), Low N | 51 |
| [Grain yield/SPAD 64 DPS] (gr.), Normal | 52 |
| [Plant biomass (FW)/SPAD 64 DPS] (gr) Drought | 53 |
| [Plant biomass (FW)/SPAD 64 DPS] (gr.), Low N | 54 |
| [Plant biomass (FW)/SPAD 64 DPS] (gr.), Normal | 55 |

Table 35. Provided are the Sorghum correlated parameters (vectors). "gr." = grams; "SPAD" = chlorophyll levels; "FW" = Plant Fresh weight; "normal" = standard growth conditions.

TABLE 36

Measured parameters in Sorghum accessions

| Ecotype/Treatment | Line-1 | Line-2 | Line-3 | Line-4 | Line-5 | Line-6 | Line-7 | Line-8 | Line-9 |
|---|---|---|---|---|---|---|---|---|---|
| 1 | 0.10 | 0.11 | 0.11 | 0.09 | 0.09 | 0.11 | | | |
| 2 | 0.11 | 0.11 | 0.14 | 0.12 | 0.14 | 0.13 | 0.12 | 0.12 | 0.12 |
| 3 | 0.105 | 0.112 | 0.131 | 0.129 | 0.139 | 0.141 | 0.110 | 0.113 | 0.102 |
| 4 | 154.90 | 122.02 | 130.51 | 241.11 | 69.03 | 186.41 | 62.11 | 39.02 | 58.94 |
| 5 | 214.78 | 205.05 | 73.49 | 122.96 | 153.07 | 93.23 | 134.11 | 77.43 | 129.63 |
| 6 | 175.15 | 223.49 | 56.40 | 111.62 | 67.34 | 66.90 | 126.18 | 107.74 | 123.86 |
| 7 | 388.00 | 428.67 | 297.67 | 280.00 | 208.33 | 303.67 | 436.00 | 376.33 | 474.67 |
| 8 | 406.50 | 518.00 | 148.00 | 423.00 | 92.00 | 101.33 | 423.50 | 386.50 | 409.50 |
| 9 | 0.42 | 0.47 | 0.42 | 0.37 | 0.23 | 0.31 | 0.41 | 0.44 | 0.40 |
| 10 | 0.51 | 0.51 | 0.17 | 0.39 | 0.21 | 0.19 | 0.48 | 0.37 | 0.42 |
| 11 | 0.51 | 0.51 | 0.12 | 0.26 | 0.12 | 0.18 | 0.46 | 0.43 | 0.42 |
| 12 | 207.99 | 138.02 | 255.41 | 402.22 | 233.55 | 391.75 | 89.31 | 50.61 | 87.02 |
| 13 | 204.78 | 199.64 | 340.51 | 240.60 | 537.78 | 359.40 | 149.20 | 129.06 | 178.71 |
| 14 | 162.56 | 212.59 | 334.83 | 313.46 | 462.28 | 318.26 | 151.13 | 137.60 | 167.98 |
| 15 | 89.40 | 75.73 | 92.10 | 94.30 | 150.80 | 110.73 | 99.20 | 84.00 | 99.00 |
| 16 | 104.00 | 80.93 | 204.73 | 125.40 | 225.40 | 208.07 | 121.40 | 100.27 | 121.13 |
| 17 | 95.25 | 79.20 | 197.85 | 234.20 | 189.40 | 194.67 | 117.25 | 92.80 | 112.65 |
| 18 | 83.14 | 107.79 | 88.68 | 135.91 | 90.76 | 123.95 | 86.06 | 85.20 | 113.10 |
| 19 | 96.24 | 214.72 | 98.59 | 182.83 | 119.64 | 110.19 | 172.36 | 84.81 | 156.25 |
| 20 | 120.14 | 167.60 | 85.14 | 157.26 | 104.00 | 102.48 | 168.54 | 109.32 | 135.13 |
| 21 | 21.63 | 21.94 | 21.57 | 22.01 | 20.99 | 28.60 | 21.35 | 20.81 | 24.68 |
| 22 | 23.22 | 25.58 | 20.93 | 28.43 | 24.32 | 22.63 | 32.11 | 20.38 | 26.69 |
| 23 | 25.58 | 26.84 | 21.02 | 26.84 | 23.14 | 21.82 | 31.33 | 23.18 | 25.70 |
| 24 | 52.78 | 64.49 | 56.59 | 64.37 | 53.21 | 71.66 | 55.61 | 52.96 | 69.83 |
| 25 | 56.32 | 79.20 | 53.25 | 76.21 | 67.27 | 59.49 | 79.28 | 51.52 | 69.88 |
| 26 | 61.22 | 67.90 | 56.26 | 65.38 | 67.46 | 67.46 | 74.35 | 56.16 | 61.64 |

TABLE 36-continued

Measured parameters in Sorghum accessions

| Ecotype/Treatment | Line-1 | Line-2 | Line-3 | Line-4 | Line-5 | Line-6 | Line-7 | Line-8 | Line-9 |
|---|---|---|---|---|---|---|---|---|---|
| 27 | 4.83 | 6.31 | 5.16 | 7.78 | 5.28 | 5.49 | 5.04 | 5.07 | 5.77 |
| 28 | 5.26 | 10.41 | 5.93 | 8.25 | 6.19 | 6.12 | 6.80 | 5.25 | 7.52 |
| 29 | 5.97 | 7.92 | 4.87 | 7.43 | 5.58 | 5.88 | 6.78 | 5.99 | 6.62 |
| 30 | 40.58 | 40.88 | 45.01 | 42.30 | 45.24 | 40.56 | 44.80 | 45.07 | 40.65 |
| 31 | 38.33 | 38.98 | 42.33 | 40.90 | 43.15 | 39.85 | 42.68 | 43.31 | 39.01 |
| 32 | 43.01 | . | 43.26 | 44.74 | 45.76 | 41.61 | 45.21 | 45.14 | 43.03 |
| 33 | 0.82 | 0.77 | 0.81 | 0.79 | 0.78 | 0.80 | 0.83 | 0.79 | 0.81 |
| 34 | 0.825 | 0.740 | 0.778 | 0.802 | 0.697 | 0.699 | 0.827 | 0.805 | 0.841 |
| 35 | 0.91 | 0.90 | 0.92 | 0.90 | 0.91 | 0.93 | 0.92 | 0.89 | 0.90 |
| 36 | 0.914 | 0.884 | 0.921 | 0.908 | 0.890 | 0.877 | 0.913 | 0.903 | 0.920 |
| 37 | 0.90 | 0.88 | 0.92 | 0.90 | 0.92 | 0.92 | 0.92 | 0.89 | 0.90 |
| 38 | 0.91 | 0.87 | 0.91 | 0.95 | 0.90 | 0.91 | 0.91 | 0.91 | 0.92 |
| 39 | 0.90 | 0.85 | 0.89 | 0.88 | 0.86 | 0.87 | 0.91 | 0.89 | 0.90 |
| 40 | 0.91 | 0.83 | 0.85 | 0.87 | 0.79 | 0.80 | 0.90 | 0.89 | 0.91 |
| 41 | 25.95 | 30.57 | 19.37 | 35.62 | 25.18 | 22.18 | 49.96 | 27.48 | 51.12 |
| 42 | 50.27 | 50.93 | 36.13 | 73.10 | 37.87 | 36.40 | 71.67 | 35.00 | 76.73 |
| 43 | 47.40 | 46.30 | 28.37 | 70.40 | 32.15 | 49.23 | 63.45 | 44.45 | 56.65 |
| 44 | 31.12 | 26.35 | 18.72 | 38.38 | 26.67 | 28.84 | 47.67 | 31.00 | 39.99 |
| 45 | 22.11 | 16.77 | 9.19 | 104.44 | 3.24 | 22.00 | 9.97 | 18.58 | 29.27 |
| 46 | 1.31 | 1.19 | 1.29 | 1.46 | 1.21 | 1.21 | | | |
| 47 | 1.18 | 1.31 | 1.11 | 1.21 | 1.19 | 1.18 | 1.16 | 1.23 | 1.17 |
| 48 | 1.22 | 1.30 | 1.13 | 1.14 | 1.16 | 1.15 | 1.19 | 1.23 | 1.25 |
| 49 | 4.50 | 8.17 | 7.87 | 10.68 | 8.34 | 4.40 | 3.74 | 4.83 | 3.67 |
| 50 | 6.02 | 5.91 | 8.50 | 6.75 | 13.05 | 9.58 | 4.67 | 3.61 | 5.89 |
| 51 | 0.68 | 0.78 | 0.46 | 0.87 | 0.58 | 0.56 | 1.17 | 0.63 | 1.31 |
| 52 | 3.78 | 7.74 | 7.01 | 10.10 | 7.65 | 3.34 | 3.05 | 3.90 | 2.83 |
| 53 | 5.13 | 3.38 | 5.67 | 9.51 | 5.16 | 9.66 | 1.99 | 1.12 | 2.14 |
| 54 | 5.34 | 5.12 | 8.05 | 5.88 | 12.46 | 9.02 | 3.50 | 2.98 | 4.58 |
| 55 | 0.72 | 0.43 | 0.86 | 0.58 | 0.69 | 1.05 | 0.69 | 0.93 | 0.84 |

Table 36: Provided are the values of each of the parameters (as described above) measured in Sorghum accessions (ecotype) under normal, low nitrogen and drought conditions. Growth conditions are specified in the experimental procedure section.

TABLE 37

Additional measured parameters in Sorghum accessions

| Ecotype/Treatment | Line-10 | Line-11 | Line-12 | Line-13 | Line-14 | Line-15 | Line-16 | Line-17 |
|---|---|---|---|---|---|---|---|---|
| 2 | 0.13 | 0.13 | 0.12 | 0.12 | 0.11 | 0.11 | 0.12 | 0.11 |
| 3 | 0.118 | 0.121 | 0.111 | 0.117 | 0.108 | 0.105 | 0.110 | 0.105 |
| 4 | 76.37 | 33.47 | 42.20 | 41.53 | 131.67 | 60.84 | 44.33 | 185.44 |
| 5 | 99.83 | 76.95 | 84.25 | 92.24 | 138.83 | 113.32 | 95.50 | 129.49 |
| 6 | 102.75 | 82.33 | 77.59 | 91.17 | 150.44 | 109.10 | 107.58 | 130.88 |
| 7 | 437.67 | 383.00 | 375.00 | 425.00 | 434.00 | 408.67 | 378.50 | 432.00 |
| 8 | 328.95 | 391.00 | 435.75 | 429.50 | 441.00 | 415.75 | 429.50 | 428.50 |
| 9 | 0.44 | 0.47 | 0.47 | 0.48 | 0.35 | 0.35 | 0.23 | 0.33 |
| 10 | 0.44 | 0.43 | 0.39 | 0.44 | 0.44 | 0.44 | 0.43 | 0.42 |
| 11 | 0.44 | 0.46 | 0.45 | 0.45 | 0.51 | 0.46 | 0.44 | 0.39 |
| 12 | 120.43 | 37.21 | 48.18 | 44.20 | 231.60 | 116.01 | 123.08 | 342.50 |
| 13 | 124.27 | 101.33 | 132.12 | 117.90 | 176.99 | 143.67 | 126.98 | 180.45 |
| 14 | 128.97 | 97.62 | 99.32 | 112.24 | 157.42 | 130.55 | 135.66 | 209.21 |
| 15 | 92.20 | 81.93 | 98.80 | 86.47 | 99.60 | 83.00 | 83.53 | 92.30 |
| 16 | 94.53 | 110.00 | 115.07 | 104.73 | 173.67 | 115.60 | 138.80 | 144.40 |
| 17 | 97.50 | 98.00 | 100.00 | 105.60 | 151.15 | 117.10 | 124.45 | 126.50 |
| 18 | 100.79 | 80.41 | 126.89 | 86.41 | 92.29 | 77.89 | 76.93 | |
| 19 | 136.71 | 137.70 | 96.54 | 158.19 | 163.95 | 138.39 | 135.46 | 165.64 |
| 20 | 169.03 | 156.10 | 112.14 | 154.74 | 171.70 | 168.51 | 162.51 | 170.46 |
| 21 | 24.28 | 21.95 | 24.98 | 19.49 | 20.42 | 16.81 | 18.88 | |
| 22 | 26.31 | 25.43 | 23.11 | 27.87 | 28.88 | 27.64 | 25.52 | 30.33 |
| 23 | 28.82 | 28.13 | 22.97 | 28.09 | 30.00 | 30.54 | 27.17 | 29.26 |
| 24 | 65.14 | 55.27 | 69.06 | 53.32 | 56.29 | 49.12 | 51.88 | |
| 25 | 66.17 | 67.37 | 57.90 | 70.61 | 73.76 | 66.87 | 65.40 | 75.97 |
| 26 | 71.40 | 68.56 | 56.44 | 67.79 | 71.54 | 78.94 | 67.03 | 74.11 |
| 27 | 5.37 | 4.66 | 6.35 | 5.58 | 5.76 | 5.86 | 5.10 | |
| 28 | 6.59 | 6.85 | 5.32 | 7.25 | 7.19 | 6.27 | 6.57 | 6.82 |
| 29 | 7.42 | 6.98 | 6.19 | 7.02 | 7.18 | 7.00 | 7.39 | 7.35 |
| 30 | 45.43 | 42.58 | 44.18 | 44.60 | 42.41 | 43.25 | 40.30 | 40.75 |
| 31 | 42.71 | 40.08 | 43.98 | 45.44 | 44.75 | 42.58 | 43.81 | 46.73 |
| 32 | 45.59 | 44.83 | 45.33 | 46.54 | 43.99 | 45.09 | 45.14 | 43.13 |
| 33 | 0.77 | 0.74 | 0.80 | 0.79 | 0.82 | 0.80 | 0.81 | 0.81 |
| 34 | 0.788 | 0.765 | 0.803 | 0.806 | 0.821 | 0.814 | 0.818 | 0.817 |
| 35 | 0.91 | 0.89 | 0.90 | 0.89 | 0.91 | 0.89 | 0.89 | 0.90 |

TABLE 37-continued

Additional measured parameters in Sorghum accessions

| Ecotype/Treatment | Line-10 | Line-11 | Line-12 | Line-13 | Line-14 | Line-15 | Line-16 | Line-17 |
|---|---|---|---|---|---|---|---|---|
| 36 | 0.923 | 0.893 | 0.913 | 0.907 | 0.911 | 0.904 | 0.903 | 0.913 |
| 37 | 0.91 | 0.89 | 0.90 | 0.90 | 0.91 | 0.89 | 0.90 | 0.90 |
| 38 | 0.93 | 0.91 | 0.92 | 0.90 | 0.91 | 0.90 | 0.91 | 0.91 |
| 39 | 0.86 | 0.84 | 0.90 | 0.89 | 0.91 | 0.90 | 0.90 | 0.90 |
| 40 | 0.85 | 0.86 | 0.88 | 0.90 | 0.90 | 0.91 | 0.90 | 0.90 |
| 41 | 36.84 | 29.45 | 26.70 | 29.42 | 51.12 | 37.04 | 39.85 | 41.78 |
| 42 | 57.58 | 42.93 | 36.47 | 68.60 | 71.80 | 49.27 | 43.87 | 52.07 |
| 43 | 60.00 | 45.45 | 58.19 | 70.60 | 70.10 | 53.95 | 59.87 | 52.65 |
| 44 | 38.36 | 32.10 | 32.69 | 32.79 | 51.53 | 35.71 | 38.31 | 42.44 |
| 45 | 10.45 | 14.77 | 12.86 | 18.24 | 11.60 | 18.65 | 16.36 | |
| 46 | | | | | | | | |
| 47 | 1.22 | 1.24 | 1.19 | 1.23 | 1.16 | 1.34 | 1.21 | 1.21 |
| 48 | 1.24 | 1.32 | 1.22 | 1.18 | 1.18 | 1.22 | 1.25 | 1.22 |
| 49 | 2.89 | 2.91 | 3.12 | 4.75 | 3.69 | 3.85 | 5.84 | |
| 50 | 3.77 | 3.26 | 3.61 | 3.24 | 5.10 | 4.25 | 3.81 | 4.76 |
| 51 | 0.86 | 0.73 | 0.61 | 0.65 | 1.14 | 0.87 | 0.91 | 0.89 |
| 52 | 2.18 | 2.19 | 2.41 | 3.58 | 2.90 | 3.01 | 4.85 | |
| 53 | 2.65 | 0.87 | 1.09 | 0.99 | 5.46 | 2.68 | 3.05 | 8.40 |
| 54 | 2.91 | 2.53 | 3.00 | 2.60 | 3.96 | 3.38 | 2.90 | 3.86 |
| 55 | 0.72 | 0.72 | 0.70 | 1.17 | 0.79 | 0.85 | 0.98 | |

Table 37: Provided are the values of each of the parameters (as described above) measured in Sorghum accessions (ecotype) under normal, low nitrogen and drought conditions. Growth conditions are specified in the experimental procedure section.

TABLE 38

Correlation between the expression level of selected genes of some embodiments of the invention in various tissues and the phenotypic performance under low nitrogen, normal or drought stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY14 | 0.72 | 1.91E−02 | 6 | 17 | LBY14 | 0.80 | 5.97E−03 | 6 | 44 |
| LBY14 | 0.74 | 1.41E−02 | 2 | 47 | LBY14 | 0.83 | 2.89E−03 | 4 | 53 |
| LBY14 | 0.73 | 1.74E−02 | 4 | 4 | LBY14 | 0.83 | 2.86E−03 | 4 | 12 |
| LBY14 | 0.79 | 6.98E−03 | 5 | 5 | LBY14 | 0.83 | 3.07E−03 | 5 | 50 |
| LBY14 | 0.79 | 6.21E−03 | 5 | 54 | LBY14 | 0.89 | 6.00E−04 | 5 | 13 |
| LBY148 | 0.71 | 2.02E−02 | 6 | 52 | LBY148 | 0.70 | 2.30E−02 | 6 | 49 |
| LBY148 | 0.73 | 1.58E−02 | 6 | 3 | LBY148 | 0.77 | 9.54E−03 | 2 | 47 |
| LBY148 | 0.73 | 1.70E−02 | 5 | 2 | LBY149 | 0.72 | 2.82E−02 | 4 | 18 |
| LBY149 | 0.72 | 2.83E−02 | 4 | 24 | LBY149 | 0.73 | 2.69E−02 | 4 | 21 |
| LBY149 | 0.78 | 7.48E−03 | 5 | 5 | LBY149 | 0.71 | 2.10E−02 | 5 | 50 |
| LBY149 | 0.77 | 9.23E−03 | 5 | 10 | LBY149 | 0.70 | 2.35E−02 | 5 | 13 |
| LBY150 | 0.80 | 5.82E−03 | 5 | 2 | LBY150 | 0.71 | 3.06E−02 | 3 | 55 |
| LBY150 | 0.75 | 1.32E−02 | 1 | 53 | LBY150 | 0.74 | 1.40E−02 | 1 | 12 |
| LBY151 | 0.73 | 1.61E−02 | 8 | 5 | LBY151 | 0.84 | 2.25E−03 | 8 | 50 |
| LBY151 | 0.77 | 9.57E−03 | 8 | 54 | LBY151 | 0.73 | 1.60E−02 | 8 | 35 |
| LBY151 | 0.81 | 4.63E−03 | 8 | 13 | LBY151 | 0.95 | 1.08E−04 | 3 | 52 |
| LBY151 | 0.82 | 3.54E−03 | 3 | 6 | LBY151 | 0.92 | 3.92E−04 | 3 | 49 |
| LBY151 | 0.84 | 2.50E−03 | 3 | 8 | LBY152 | 0.81 | 4.52E−03 | 2 | 16 |
| LBY152 | 0.78 | 7.77E−03 | 8 | 31 | LBY152 | 0.81 | 4.63E−03 | 3 | 17 |
| LBY152 | 0.78 | 7.80E−03 | 3 | 44 | LBY153 | 0.84 | 2.15E−03 | 9 | 17 |
| LBY153 | 0.71 | 2.03E−02 | 9 | 40 | LBY153 | 0.74 | 1.48E−02 | 9 | 38 |
| LBY153 | 0.84 | 2.36E−03 | 9 | 44 | LBY153 | 0.74 | 1.34E−02 | 9 | 34 |
| LBY153 | 0.83 | 2.75E−03 | 4 | 53 | LBY153 | 0.72 | 1.83E−02 | 4 | 4 |
| LBY153 | 0.83 | 2.73E−03 | 4 | 12 | LBY153 | 0.74 | 1.45E−02 | 7 | 15 |
| LBY154 | 0.79 | 6.58E−03 | 6 | 17 | LBY154 | 0.71 | 2.11E−02 | 6 | 23 |
| LBY154 | 0.79 | 6.33E−03 | 6 | 44 | LBY154 | 0.80 | 5.44E−03 | 2 | 16 |
| LBY154 | 0.74 | 2.28E−02 | 4 | 18 | LBY154 | 0.75 | 2.10E−02 | 4 | 27 |
| LBY154 | 0.73 | 1.59E−02 | 4 | 53 | LBY154 | 0.72 | 2.84E−02 | 4 | 24 |
| LBY154 | 0.74 | 1.39E−02 | 4 | 12 | LBY154 | 0.72 | 1.86E−02 | 5 | 50 |
| LBY154 | 0.72 | 1.92E−02 | 5 | 13 | LBY155 | 0.75 | 1.31E−02 | 6 | 3 |
| LBY156 | 0.89 | 4.92E−04 | 6 | 52 | LBY156 | 0.70 | 2.33E−02 | 6 | 14 |
| LBY156 | 0.90 | 4.08E−04 | 6 | 49 | LBY156 | 0.80 | 5.60E−03 | 2 | 31 |
| LBY156 | 0.88 | 1.63E−03 | 7 | 18 | LBY156 | 0.72 | 2.77E−02 | 7 | 27 |
| LBY156 | 0.80 | 9.08E−03 | 7 | 24 | LBY156 | 0.77 | 1.61E−02 | 7 | 21 |
| LBY157 | 0.72 | 1.81E−02 | 6 | 6 | LBY157 | 0.76 | 1.13E−02 | 2 | 47 |
| LBY158 | 0.87 | 1.09E−03 | 4 | 53 | LBY158 | 0.87 | 9.17E−04 | 4 | 4 |
| LBY158 | 0.87 | 1.01E−03 | 4 | 12 | LBY159 | 0.74 | 1.53E−02 | 7 | 9 |
| LBY159 | 0.76 | 1.65E−02 | 1 | 18 | LBY159 | 0.74 | 1.53E−02 | 1 | 15 |
| LBY160 | 0.79 | 6.72E−03 | 6 | 48 | LBY160 | 0.85 | 1.70E−03 | 6 | 3 |
| LBY160 | 0.72 | 1.78E−02 | 5 | 2 | LBY161 | 0.92 | 1.65E−04 | 4 | 53 |
| LBY161 | 0.84 | 2.25E−03 | 4 | 4 | LBY161 | 0.92 | 1.73E−04 | 4 | 12 |

TABLE 38-continued

Correlation between the expression level of selected genes of some embodiments of the invention in various tissues and the phenotypic performance under low nitrogen, normal or drought stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY161 | 0.91 | 2.66E−04 | 8 | 35 | LBY161 | 0.70 | 2.31E−02 | 8 | 42 |
| LBY161 | 0.71 | 2.22E−02 | 8 | 37 | LBY161 | 0.86 | 1.51E−03 | 5 | 5 |
| LBY161 | 0.89 | 5.33E−04 | 5 | 50 | LBY161 | 0.88 | 7.10E−04 | 5 | 54 |
| LBY161 | 0.91 | 2.41E−04 | 5 | 13 | LBY161 | 0.76 | 1.03E−02 | 1 | 53 |
| LBY161 | 0.81 | 4.72E−03 | 1 | 4 | LBY161 | 0.77 | 8.76E−03 | 1 | 12 |
| LBY162 | 0.71 | 2.06E−02 | 6 | 3 | LBY162 | 0.73 | 1.73E−02 | 2 | 31 |
| LBY162 | 0.77 | 9.20E−03 | 8 | 37 | LBY162 | 0.91 | 2.88E−04 | 3 | 32 |
| LBY162 | 0.72 | 1.85E−02 | 3 | 40 | LBY162 | 0.77 | 1.52E−02 | 3 | 55 |
| LBY162 | 0.80 | 5.47E−03 | 3 | 38 | LBY162 | 0.73 | 1.69E−02 | 3 | 36 |
| LBY163 | 0.76 | 1.79E−02 | 3 | 52 | LBY163 | 0.74 | 2.41E−02 | 3 | 49 |
| LBY163 | 0.78 | 8.21E−03 | 3 | 8 | LBY164 | 0.89 | 6.23E−04 | 4 | 53 |
| LBY164 | 0.83 | 3.15E−03 | 4 | 4 | LBY164 | 0.90 | 4.03E−04 | 4 | 12 |
| LBY164 | 0.76 | 1.11E−02 | 8 | 47 | LBY164 | 0.73 | 1.76E−02 | 8 | 28 |
| LBY165 | 0.81 | 4.65E−03 | 6 | 3 | LBY165 | 0.76 | 1.08E−02 | 5 | 2 |
| LBY165 | 0.88 | 1.74E−03 | 3 | 52 | LBY165 | 0.88 | 1.57E−03 | 3 | 49 |
| LBY166 | 0.75 | 1.31E−02 | 2 | 41 | LBY166 | 0.78 | 7.83E−03 | 2 | 42 |
| LBY166 | 0.72 | 1.96E−02 | 2 | 51 | LBY166 | 0.74 | 1.40E−02 | 2 | 16 |
| LBY166 | 0.71 | 2.16E−02 | 8 | 16 | LBY166 | 0.80 | 9.36E−03 | 3 | 52 |
| LBY166 | 0.85 | 2.03E−03 | 3 | 6 | LBY166 | 0.73 | 1.67E−02 | 3 | 14 |
| LBY166 | 0.78 | 1.37E−02 | 3 | 49 | LBY166 | 0.78 | 7.40E−03 | 3 | 8 |
| LBY167 | 0.77 | 8.71E−03 | 6 | 3 | LBY167 | 0.72 | 1.89E−02 | 9 | 17 |
| LBY167 | 0.70 | 3.53E−02 | 4 | 27 | LBY167 | 0.78 | 1.24E−02 | 3 | 52 |
| LBY167 | 0.72 | 2.86E−02 | 3 | 49 | LBY167 | 0.87 | 1.21E−03 | 3 | 8 |
| LBY168 | 0.84 | 2.56E−03 | 6 | 6 | LBY168 | 0.81 | 4.40E−03 | 6 | 14 |
| LBY168 | 0.76 | 9.94E−03 | 2 | 7 | LBY168 | 0.84 | 2.16E−03 | 2 | 41 |
| LBY168 | 0.84 | 2.20E−03 | 2 | 22 | LBY168 | 0.83 | 3.03E−03 | 2 | 51 |
| LBY168 | 0.77 | 1.50E−02 | 7 | 21 | LBY170 | 0.77 | 8.79E−03 | 6 | 52 |
| LBY170 | 0.73 | 1.58E−02 | 6 | 49 | LBY170 | 0.74 | 1.47E−02 | 6 | 8 |
| LBY171 | 0.70 | 2.39E−02 | 6 | 11 | LBY171 | 0.77 | 8.75E−03 | 2 | 47 |
| LBY171 | 0.90 | 4.10E−04 | 4 | 53 | LBY171 | 0.84 | 2.20E−03 | 4 | 4 |
| LBY171 | 0.89 | 5.28E−04 | 4 | 12 | LBY171 | 0.84 | 2.61E−03 | 5 | 5 |
| LBY171 | 0.82 | 3.36E−03 | 5 | 50 | LBY171 | 0.82 | 4.06E−03 | 5 | 54 |
| LBY171 | 0.84 | 2.13E−03 | 5 | 13 | LBY173 | 0.77 | 9.12E−03 | 2 | 41 |
| LBY173 | 0.72 | 2.01E−02 | 2 | 51 | LBY173 | 0.78 | 7.72E−03 | 2 | 37 |
| LBY173 | 0.76 | 1.05E−02 | 2 | 16 | LBY174 | 0.74 | 1.46E−02 | 6 | 17 |
| LBY174 | 0.74 | 1.36E−02 | 6 | 11 | LBY174 | 0.75 | 1.22E−02 | 6 | 44 |
| LBY174 | 0.87 | 1.06E−03 | 2 | 41 | LBY174 | 0.70 | 2.40E−02 | 2 | 35 |
| LBY174 | 0.71 | 2.12E−02 | 2 | 42 | LBY174 | 0.86 | 1.36E−03 | 2 | 51 |
| LBY174 | 0.80 | 5.02E−03 | 2 | 37 | LBY174 | 0.75 | 1.30E−02 | 2 | 16 |
| LBY174 | 0.87 | 9.84E−04 | 5 | 5 | LBY174 | 0.87 | 9.19E−04 | 5 | 50 |
| LBY174 | 0.81 | 4.20E−03 | 5 | 54 | LBY174 | 0.82 | 3.95E−03 | 5 | 10 |
| LBY174 | 0.80 | 5.46E−03 | 5 | 35 | LBY174 | 0.84 | 2.36E−03 | 5 | 13 |
| LBY174 | 0.90 | 8.09E−04 | 3 | 52 | LBY174 | 0.72 | 2.00E−02 | 3 | 6 |
| LBY174 | 0.88 | 1.78E−03 | 3 | 49 | LBY174 | 0.80 | 5.36E−03 | 3 | 8 |
| LBY175 | 0.73 | 2.44E−02 | 4 | 18 | LBY175 | 0.72 | 2.74E−02 | 4 | 21 |
| LBY176 | 0.70 | 3.46E−02 | 3 | 52 | LBY176 | 0.89 | 4.94E−04 | 3 | 6 |
| LBY177 | 0.87 | 1.07E−03 | 6 | 17 | LBY177 | 0.73 | 1.59E−02 | 6 | 40 |
| LBY177 | 0.86 | 1.39E−03 | 6 | 44 | LBY177 | 0.71 | 2.07E−02 | 6 | 43 |
| LBY177 | 0.71 | 2.16E−02 | 6 | 36 | LBY177 | 0.78 | 7.48E−03 | 6 | 34 |
| LBY177 | 0.70 | 2.39E−02 | 8 | 2 | LBY177 | 0.79 | 6.60E−03 | 5 | 33 |
| LBY177 | 0.74 | 1.49E−02 | 5 | 39 | LBY178 | 0.76 | 1.09E−02 | 6 | 40 |
| LBY178 | 0.75 | 1.22E−02 | 6 | 55 | LBY178 | 0.72 | 1.98E−02 | 6 | 43 |
| LBY178 | 0.81 | 4.70E−03 | 9 | 14 | LBY178 | 0.77 | 9.03E−03 | 2 | 33 |
| LBY178 | 0.91 | 2.45E−04 | 2 | 41 | LBY178 | 0.73 | 1.68E−02 | 2 | 39 |
| LBY178 | 0.70 | 2.28E−02 | 2 | 35 | LBY178 | 0.87 | 9.72E−04 | 2 | 51 |
| LBY178 | 0.79 | 7.09E−03 | 2 | 37 | LBY178 | 0.91 | 2.35E−04 | 2 | 16 |
| LBY178 | 0.83 | 2.91E−03 | 4 | 53 | LBY178 | 0.73 | 1.72E−02 | 4 | 4 |
| LBY178 | 0.83 | 2.88E−03 | 4 | 12 | LBY178 | 0.72 | 1.87E−02 | 5 | 31 |
| LBY178 | 0.76 | 9.95E−03 | 5 | 16 | LBY178 | 0.86 | 3.24E−03 | 3 | 52 |
| LBY178 | 0.81 | 4.72E−03 | 3 | 6 | LBY178 | 0.84 | 4.57E−03 | 3 | 49 |
| LBY178 | 0.73 | 1.71E−02 | 3 | 8 | LBY179 | 0.76 | 1.08E−02 | 6 | 17 |
| LBY179 | 0.70 | 2.34E−02 | 6 | 44 | LBY179 | 0.92 | 1.95E−04 | 4 | 53 |
| LBY179 | 0.83 | 2.91E−03 | 4 | 4 | LBY179 | 0.91 | 2.08E−04 | 4 | 12 |
| LBY179 | 0.70 | 2.32E−02 | 5 | 13 | LBY180 | 0.73 | 1.68E−02 | 6 | 48 |
| LBY180 | 0.75 | 1.17E−02 | 8 | 16 | LBY181 | 0.77 | 8.50E−03 | 6 | 40 |
| LBY181 | 0.73 | 1.60E−02 | 6 | 34 | LBY181 | 0.76 | 1.78E−02 | 9 | 55 |
| LBY181 | 0.74 | 2.38E−02 | 7 | 45 | LBY182 | 0.72 | 1.97E−02 | 2 | 33 |
| LBY182 | 0.72 | 1.92E−02 | 2 | 50 | LBY182 | 0.90 | 4.10E−04 | 2 | 35 |
| LBY182 | 0.77 | 9.14E−03 | 5 | 5 | LBY182 | 0.80 | 5.92E−03 | 5 | 50 |
| LBY182 | 0.79 | 6.98E−03 | 5 | 54 | LBY182 | 0.74 | 1.41E−02 | 5 | 13 |
| LBY182 | 0.79 | 6.72E−03 | 3 | 11 | LBY182 | 0.94 | 5.85E−05 | 3 | 6 |
| LBY183 | 0.71 | 2.12E−02 | 6 | 11 | LBY183 | 0.74 | 1.51E−02 | 9 | 11 |
| LBY183 | 0.76 | 1.13E−02 | 8 | 10 | LBY183 | 0.73 | 1.62E−02 | 5 | 50 |

TABLE 38-continued

Correlation between the expression level of selected genes of some embodiments of the invention in various tissues and the phenotypic performance under low nitrogen, normal or drought stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY183 | 0.73 | 1.74E−02 | 5 | 10 | LBY183 | 0.72 | 1.90E−02 | 3 | 11 |
| LBY186 | 0.80 | 5.01E−03 | 9 | 17 | LBY186 | 0.84 | 2.54E−03 | 9 | 44 |
| LBY186 | 0.77 | 9.83E−03 | 3 | 44 | LBY188 | 0.81 | 4.23E−03 | 5 | 2 |
| LBY189 | 0.75 | 1.28E−02 | 2 | 16 | LBY189 | 0.74 | 1.45E−02 | 3 | 6 |
| LBY191 | 0.74 | 1.39E−02 | 1 | 30 | LBY192 | 0.74 | 1.35E−02 | 8 | 2 |
| LBY192 | 0.78 | 7.83E−03 | 5 | 5 | LBY192 | 0.71 | 2.20E−02 | 5 | 50 |
| LBY192 | 0.74 | 1.42E−02 | 5 | 54 | LBY192 | 0.71 | 2.06E−02 | 5 | 13 |
| LGN3 | 0.82 | 3.99E−03 | 6 | 17 | LGN3 | 0.78 | 7.76E−03 | 6 | 44 |
| LGN3 | 0.84 | 4.41E−03 | 9 | 52 | LGN3 | 0.83 | 5.83E−03 | 9 | 49 |
| LGN3 | 0.79 | 7.06E−03 | 9 | 8 | LGN3 | 0.91 | 2.59E−04 | 4 | 53 |
| LGN3 | 0.84 | 2.38E−03 | 4 | 4 | LGN3 | 0.92 | 1.64E−04 | 4 | 12 |
| LGN3 | 0.74 | 1.35E−02 | 8 | 47 | LGN4 | 0.81 | 4.25E−03 | 6 | 17 |
| LGN4 | 0.77 | 9.90E−03 | 6 | 44 | LGN4 | 0.70 | 3.52E−02 | 9 | 52 |
| LGN4 | 0.71 | 3.11E−02 | 9 | 49 | LGN4 | 0.80 | 5.52E−03 | 4 | 53 |
| LGN4 | 0.74 | 1.35E−02 | 4 | 4 | LGN4 | 0.82 | 3.99E−03 | 4 | 12 |
| LGN5 | 0.70 | 2.37E−02 | 6 | 55 | LGN5 | 0.86 | 1.27E−03 | 2 | 41 |
| LGN5 | 0.76 | 1.05E−02 | 2 | 35 | LGN5 | 0.87 | 9.62E−04 | 2 | 51 |
| LGN5 | 0.85 | 1.75E−03 | 2 | 37 | LGN5 | 0.72 | 1.78E−02 | 2 | 16 |
| LGN5 | 0.79 | 6.72E−03 | 5 | 2 | LGN5 | 0.73 | 1.56E−02 | 3 | 17 |
| LGN5 | 0.73 | 1.58E−02 | 7 | 4 | LGN5 | 0.78 | 1.26E−02 | 1 | 45 |
| LGN54 | 0.70 | 2.31E−02 | 9 | 14 | LGN54 | 0.81 | 4.13E−03 | 9 | 8 |
| LGN57 | 0.85 | 1.73E−03 | 9 | 17 | LGN57 | 0.79 | 6.65E−03 | 9 | 44 |
| LGN57 | 0.75 | 1.23E−02 | 2 | 41 | LGN57 | 0.80 | 5.40E−03 | 2 | 16 |
| LGN57 | 0.83 | 3.06E−03 | 8 | 33 | LGN57 | 0.86 | 1.38E−03 | 8 | 41 |
| LGN57 | 0.71 | 2.15E−02 | 8 | 39 | LGN57 | 0.82 | 3.75E−03 | 8 | 35 |
| LGN57 | 0.84 | 2.09E−03 | 8 | 51 | LGN57 | 0.86 | 1.42E−03 | 8 | 37 |
| LGN57 | 0.78 | 8.45E−03 | 8 | 16 | LGN57 | 0.74 | 2.26E−02 | 3 | 55 |
| LGN57 | 0.81 | 4.59E−03 | 3 | 43 | LGN6 | 0.78 | 7.30E−03 | 6 | 17 |
| LGN6 | 0.84 | 2.54E−03 | 6 | 44 | LGN6 | 0.70 | 2.40E−02 | 5 | 50 |
| LGN6 | 0.70 | 2.38E−02 | 5 | 13 | LGN6 | 0.85 | 3.72E−03 | 3 | 52 |
| LGN6 | 0.88 | 1.83E−03 | 3 | 49 | LGN6 | 0.71 | 2.08E−02 | 7 | 30 |
| LGN7 | 0.75 | 1.33E−02 | 6 | 17 | LGN7 | 0.70 | 2.40E−02 | 6 | 44 |
| LGN7 | 0.70 | 2.40E−02 | 6 | 36 | LGN7 | 0.76 | 1.07E−02 | 4 | 53 |
| LGN7 | 0.76 | 1.04E−02 | 4 | 12 | LGN7 | 0.71 | 2.23E−02 | 8 | 47 |
| LGN7 | 0.76 | 1.14E−02 | 5 | 41 | LGN7 | 0.75 | 1.25E−02 | 5 | 22 |
| LGN7 | 0.71 | 2.15E−02 | 5 | 51 | LGN7 | 0.70 | 3.57E−02 | 3 | 52 |
| LGN7 | 0.88 | 7.09E−04 | 1 | 53 | LGN7 | 0.85 | 1.97E−03 | 1 | 4 |
| LGN7 | 0.89 | 5.78E−04 | 1 | 12 | | | | | |

Table 38. Provided are the correlations (R) between the genes expression levels in various tissues and the phenotypic performance. "Corr. ID"—correlation set ID according to the correlated parameters specified in Table 35. "Exp. Set"—Expression set specified in Table 34. "R" = Pearson correlation coefficient; "P" = p value.

II. Correlation of Sorghum Varieties Across Ecotype Grown Under Salinity Stress, Cold Stress, Low Nitrogen and Normal Conditions Sorghum vigor related parameters under 100 mM NaCl and low temperature (10±2° C.)—Ten Sorghum varieties were grown in 3 repetitive plots, each containing 17 plants, at a net house under semi-hydroponics conditions. Briefly, the growing protocol was as follows: Sorghum seeds were sown in trays filled with a mix of vermiculite and peat in a 1:1 ratio. Following germination, the trays were transferred to the high salinity solution (100 mM NaCl in addition to the Full Hogland solution at 28±2° C.), low temperature (10±2° C. in the presence of Full Hogland solution), low nitrogen (1.2 mM Nitrogen at 28±2° C.) or at Normal growth solution [Full Hogland solution at 28±2° C.].

Full Hogland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

All 10 selected varieties were sampled per each treatment. Two tissues [meristems and roots] growing at 100 mM NaCl, low temperature (10±2° C.), low nitrogen (1.2 mM Nitrogen) or under Normal conditions (full Hogland at a temperature between 28±2° C.) were sampled and RNA was extracted as described hereinabove under "GENERAL EXPERIMENTAL AND BIOINFORMATICS METHODS".

TABLE 39

Sorghum transcriptome expression sets

| Expression Set | Set ID |
|---|---|
| root at vegetative stage (V4-V5) under cold conditions | 1 |
| root vegetative stage (V4-V5) under normal conditions | 2 |
| root vegetative stage (V4-V5) under low nitrogen conditions | 3 |
| root vegetative stage (V4-V5) under salinity conditions | 4 |
| vegetative meristem at vegetative stage (V4-V5) under cold conditions | 5 |

TABLE 39-continued

Sorghum transcriptome expression sets

| Expression Set | Set ID |
|---|---|
| vegetative meristem at vegetative stage (V4-V5) under low nitrogen conditions | 6 |
| vegetative meristem at vegetative stage (V4-V5) under salinity conditions | 7 |
| vegetative meristem at vegetative stage (V4-V5) under normal conditions | 8 |

Table 39: Provided are the Sorghum transcriptome expression sets. Cold conditions = 10 ± 2° C.; NaCl = 100 mM NaCl; low nitrogen Nitrogen; Normal conditions = 16 mM Nitrogen.

Sorghum Biomass, Vigor, Nitrogen Use Efficiency and Growth-Related Components

Root DW (dry weight)—At the end of the experiment, the root material was collected, measured and divided by the number of plants.

Shoot DW—At the end of the experiment, the shoot material (without roots) was collected, measured and divided by the number of plants.

Total biomass—total biomass including roots and shoots.

Plant leaf number—Plants were characterized for leaf number at 3 time points during the growing period. In each measure, plants were measured for their leaf number by counting all the leaves of 3 selected plants per plot.

Shoot/root Ratio—The shoot/root Ratio was calculated using Formula XXX above.

Percent of reduction of root biomass compared to normal—the difference (reduction in percent) between root biomass under normal and under low nitrogen conditions.

Percent of reduction of shoot biomass compared to normal—the difference (reduction in percent) between shoot biomass under normal and under low nitrogen conditions.

Percent of reduction of total biomass compared to normal—the difference (reduction in percent) between total biomass (shoot and root) under normal and under low nitrogen conditions.

Plant height—Plants were characterized for height at 3 time points during the growing period. In each measure, plants were measured for their height using a measuring tape. Height was measured from ground level to top of the longest leaf Relative Growth Rate of leaf number was calculated using Formula VIII above.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Root Biomass [DW-gr.]/SPAD—root biomass divided by SPAD results.

Shoot Biomass [DW-gr.]/SPAD—shoot biomass divided by SPAD results.

Total Biomass-Root+Shoot [DW-gr.]/SPAD—total biomass divided by SPAD results.

Plant nitrogen level (calculated as SPAD/leaf biomass)—The chlorophyll content of leaves is a good indicator of the nitrogen plant status since the degree of leaf greenness is highly correlated to this parameter.

Experimental Results 10 different Sorghum varieties were grown and characterized for the following parameters: "Leaf number Normal"=leaf number per plant under normal conditions (average of five plants); "Plant Height Normal"=plant height under normal conditions (average of five plants); "Root DW 100 mM NaCl"—root dry weight per plant under salinity conditions (average of five plants); The average for each of the measured parameters was calculated using the JMP software and values are summarized in Table 41 below. Subsequent correlation analysis between the various transcriptome sets and the average parameters were conducted (Table 42). Results were then integrated to the database.

TABLE 40

Sorghum correlated parameters (vectors)

| Correlated parameter with | Correlation ID |
|---|---|
| DW Root/Plant (gr./number) at 100 mM NaCl conditions | 1 |
| DW Root/Plant (gr./number) at Cold conditions | 2 |
| DW Root/Plant (gr./number) at Low Nitrogen conditions | 3 |
| DW Root/Plant (gr./number) at Normal conditions | 4 |
| DW Shoot/Plant (gr./number) at Low Nitrogen conditions | 5 |
| DW Shoot/Plant (gr./number) at 100 mM NaCl conditions | 6 |
| DW Shoot/Plant (gr./number) at Cold conditions | 7 |
| DW Shoot/Plant (gr./number) at Normal conditions | 8 |
| Leaf number (at time point 1) at 100 mM NaCl conditions | 9 |
| Leaf number (at time point 1) at Cold conditions | 10 |
| Leaf number (at time point 1) at Low Nitrogen conditions | 11 |
| Leaf number (at time point 1) at Normal conditions | 12 |
| Leaf number (at time point 2) at 100 mM NaCl conditions | 13 |
| Leaf number (at time point 2) at Cold conditions | 14 |
| Leaf number (at time point 2) at Low Nitrogen conditions | 15 |
| Leaf number (at time point 2) at Normal conditions | 16 |
| Leaf number (at time point 3) at 100 mM NaCl conditions | 17 |
| Leaf number (at time point 3) at Cold conditions | 18 |
| Leaf number (at time point 3) at Low Nitrogen conditions | 19 |
| Leaf number (at time point 3) at Normal conditions | 20 |
| total biomass DW (gr.) at Low N conditions | 21 |
| Shoot/Root (ratio) at Low N conditions | 22 |
| roots DW (gr.) at Low N conditions | 23 |
| shoots DW (gr.) at Low N conditions | 24 |
| percent root biomass at Low N compared to normal conditions | 25 |
| percent shoot biomass at Low N compared to normal conditions | 26 |

TABLE 40-continued

Sorghum correlated parameters (vectors)

| Correlated parameter with | Correlation ID |
|---|---|
| percent total biomass reduction at Low N compared to normal conditions | 27 |
| N level/Leaf (SPAD/gr.) at Low Nitrogen conditions | 28 |
| N level/Leaf (SPAD/gr.) at 100 mM NaCl conditions | 29 |
| N level/Leaf (SPAD/gr.) at Cold conditions | 30 |
| N level/Leaf (SPAD/gr.) at Normal conditions | 31 |
| Normal, Shoot/Root (ratio) at normal conditions | 32 |
| Roots DW (gr.) at normal conditions | 33 |
| Shoots DW (gr.) at normal conditions | 34 |
| Total biomass (gr. at normal conditions | 35 |
| Plant Height (at time point 1) (cm) at 100 mM NaCl conditions | 36 |
| Plant Height (at time point 1) (cm) at Cold conditions | 37 |
| Plant Height (at time point 1), (cm) at Low Nitrogen conditions | 38 |
| Plant Height (at time point 1), (cm) at normal conditions | 39 |
| Plant Height (at time point 2), (cm) at Cold conditions | 40 |
| Plant Height (at time point 2), (cm) at Low Nitrogen conditions | 41 |
| Plant Height (at time point 2), (cm) at normal conditions | 42 |
| Plant Height (at time point 2), (cm) at 100 mM NaCl conditions | 43 |
| Plant Height (at time point 3), (cm) at 100 mM NaCl conditions | 44 |
| Plant Height (at time point 3), (cm) at Low Nitrogen conditions | 45 |
| RGR Leaf Num at Normal conditions | 46 |
| Root Biomass (DW-gr.)/SPAD at 100 mM NaCl conditions | 47 |
| Root Biomass (DW, gr.)/SPAD at Cold conditions | 48 |
| Root Biomass (DW, gr.)/SPAD at Low Nitrogen conditions | 49 |
| Root Biomass [DW, gr.]/SPAD at Normal conditions | 50 |
| SPAD, at Cold conditions | 51 |
| SPAD (number) at Low Nitrogen conditions | 52 |
| SPAD (number) at Normal conditions | 53 |
| SPAD (number) at 100 mM NaCl conditions | 54 |
| Shoot Biomass (DW, gr.)/SPAD at 100 mM NaCl conditions | 55 |
| Shoot Biomass (DW, gr.)/SPAD at Cold conditions | 56 |
| Shoot Biomass (DW, gr.)/SPAD at Low Nitrogen conditions | 57 |
| Shoot Biomass (DW, gr.)/SPAD at Normal conditions | 58 |
| Total Biomass (Root + Shoot; DW, gr.)/SPAD at 100 mM NaCl conditions | 59 |
| Total Biomass (Root + Shoot; DW, gr.)/SPAD at Cold conditions | 60 |
| Total Biomass (Root + Shoot; DW, gr.)/SPAD at Low Nitrogen conditions | 61 |
| Total Biomass (Root + Shoot; DW, gr.)/SPAD at Normal conditions | 62 |

Table 40: Provided are the Sorghum correlated parameters. Cold conditions = 10 ± 2° C.; NaCl = 100 mM NaCl; low nitrogen = 1.2 mM Nitrogen; Normal conditions = 16 mM Nitrogen.

TABLE 41

Sorghum accessions, measured parameters

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 4 | 0.05 | 0.13 | 0.17 | 0.10 | 0.11 | 0.12 | 0.14 | 0.12 | 0.10 | 0.11 |
| 8 | 0.10 | 0.24 | 0.31 | 0.16 | 0.19 | 0.19 | 0.24 | 0.24 | 0.19 | 0.24 |
| 12 | 3.00 | 3.07 | 3.80 | 3.20 | 3.23 | 3.23 | 3.13 | 3.43 | 3.00 | 3.00 |
| 16 | 4.17 | 4.50 | 4.80 | 4.60 | 4.53 | 4.97 | 4.60 | 4.93 | 4.50 | 4.57 |
| 20 | 5.33 | 5.87 | 6.20 | 5.80 | 5.80 | 5.73 | 5.73 | 6.00 | 5.60 | 6.07 |
| 39 | 7.47 | 9.30 | 12.87 | 8.57 | 8.93 | 8.53 | 10.67 | 10.27 | 7.87 | 8.77 |
| 42 | 14.97 | 18.23 | 22.10 | 17.60 | 18.07 | 18.53 | 22.83 | 22.03 | 20.03 | 21.80 |
| 46 | 0.16 | 0.19 | 0.16 | 0.17 | 0.17 | 0.17 | 0.17 | 0.17 | 0.17 | 0.20 |
| 53 | 26.70 | 29.33 | 29.86 | 29.09 | 24.98 | 24.62 | 30.79 | 25.50 | 32.89 | 33.54 |
| 3 | 0.04 | 0.11 | 0.20 | 0.10 | 0.08 | 0.09 | 0.13 | 0.09 | 0.09 | 0.09 |
| 5 | 0.08 | 0.19 | 0.33 | 0.16 | 0.16 | 0.16 | 0.26 | 0.20 | 0.13 | 0.18 |
| 11 | 3.00 | 3.13 | 3.87 | 3.53 | 3.20 | 3.13 | 3.13 | 3.30 | 3.07 | 3.07 |
| 15 | 4.00 | 4.58 | 4.97 | 4.73 | 4.60 | 4.70 | 4.97 | 4.87 | 4.67 | 4.57 |
| 19 | 3.90 | 4.27 | 4.70 | 4.23 | 4.30 | 4.57 | 4.63 | 4.67 | 3.97 | 4.10 |
| 38 | 6.73 | 9.77 | 12.70 | 8.67 | 9.77 | 9.23 | 10.27 | 10.10 | 7.93 | 8.23 |
| 41 | 13.30 | 20.63 | 23.70 | 18.03 | 19.33 | 19.20 | 21.87 | 22.13 | 18.20 | 21.00 |
| 45 | 22.23 | 31.07 | 34.67 | 30.03 | 30.83 | 29.87 | 30.87 | 32.40 | 29.37 | 30.70 |
| 52 | 26.88 | 28.02 | 29.64 | 31.52 | 29.61 | 26.82 | 28.48 | 28.21 | 30.48 | 27.63 |
| 1 | 0.05 | 0.10 | 0.12 | 0.07 | 0.08 | 0.08 | 0.14 | 0.10 | 0.16 | 0.14 |
| 6 | 0.09 | 0.19 | 0.20 | 0.14 | 0.13 | 0.13 | 0.15 | 0.19 | 0.10 | 0.12 |
| 9 | 3.00 | 3.13 | 3.40 | 3.07 | 3.33 | 3.07 | 3.07 | 3.27 | 3.00 | 3.07 |
| 13 | 4.00 | 4.37 | 4.87 | 4.60 | 4.50 | 4.53 | 4.50 | 4.77 | 4.32 | 4.20 |
| 17 | 4.00 | 4.13 | 4.57 | 4.43 | 4.07 | 4.33 | 4.13 | 4.50 | 3.78 | 4.20 |
| 36 | 7.90 | 9.50 | 10.93 | 7.93 | 9.70 | 8.53 | 8.90 | 10.37 | 7.00 | 7.83 |
| 43 | 14.20 | 16.27 | 20.37 | 13.33 | 15.90 | 16.53 | 15.47 | 18.93 | 13.68 | 15.77 |
| 44 | 21.80 | 23.17 | 30.37 | 22.83 | 23.70 | 23.30 | 22.47 | 26.83 | 20.28 | 23.57 |
| 54 | 32.73 | 35.14 | 27.97 | 30.93 | 34.53 | 29.99 | 32.09 | 31.86 | 32.51 | 34.32 |

TABLE 41-continued

Sorghum accessions, measured parameters

| Ecotype/ Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 2 | 0.07 | 0.11 | 0.16 | 0.09 | 0.08 | 0.11 | 0.14 | 0.13 | 0.11 | 0.14 |
| 7 | 0.08 | 0.15 | 0.19 | 0.11 | 0.13 | 0.16 | 0.15 | 0.15 | 0.11 | 0.14 |
| 10 | 3.00 | 3.00 | 3.50 | 3.17 | 3.40 | 3.20 | 3.13 | 3.07 | 3.07 | 3.00 |
| 14 | 3.90 | 4.13 | 4.63 | 4.17 | 4.27 | 4.23 | 4.20 | 4.30 | 4.17 | 4.00 |
| 18 | 4.73 | 5.33 | 5.43 | 5.50 | 5.33 | 5.07 | 4.50 | 5.40 | 5.37 | 5.18 |
| 37 | 6.50 | 8.77 | 10.40 | 6.80 | 9.03 | 9.00 | 7.97 | 9.17 | 6.50 | 7.23 |
| 40 | 11.17 | 15.87 | 18.43 | 12.20 | 16.03 | 14.63 | 14.60 | 17.27 | 13.43 | 13.91 |
| 51 | 28.62 | 30.31 | 27.04 | 32.28 | 28.28 | 29.89 | 32.47 | 28.63 | 31.71 | 29.56 |
| 30 | 6.05 | 5.68 | 4.98 | 5.87 | 5.30 | 5.90 | 7.21 | 5.30 | 5.91 | 5.70 |
| 48 | 0.002 | 0.004 | 0.006 | 0.003 | 0.003 | 0.004 | 0.004 | 0.004 | 0.003 | 0.005 |
| 56 | 0.003 | 0.005 | 0.007 | 0.003 | 0.005 | 0.006 | 0.005 | 0.005 | 0.004 | 0.005 |
| 60 | 0.005 | 0.009 | 0.013 | 0.006 | 0.008 | 0.009 | 0.009 | 0.010 | 0.007 | 0.009 |
| 21 | 27.53 | 64.12 | 115.23 | 58.02 | 52.22 | 35.10 | 84.57 | 63.73 | 47.03 | 60.00 |
| 22 | 1.87 | 1.71 | 1.73 | 1.57 | 2.10 | 1.81 | 2.06 | 2.10 | 1.50 | 2.00 |
| 23 | 9.65 | 23.54 | 43.88 | 22.58 | 16.89 | 12.44 | 28.19 | 20.53 | 18.76 | 20.09 |
| 24 | 17.88 | 40.59 | 71.35 | 35.44 | 35.33 | 22.66 | 56.38 | 43.20 | 28.27 | 39.91 |
| 25 | 84.53 | 80.95 | 117.00 | 100.52 | 72.54 | 71.78 | 93.47 | 76.05 | 86.82 | 80.51 |
| 26 | 81.57 | 79.16 | 104.75 | 103.50 | 83.71 | 83.22 | 107.69 | 81.39 | 70.30 | 75.86 |
| 27 | 82.58 | 79.81 | 109.10 | 102.32 | 79.74 | 78.77 | 102.49 | 79.59 | 76.07 | 77.36 |
| 28 | 6.89 | 6.57 | 6.31 | 7.45 | 6.89 | 5.87 | 6.15 | 6.05 | 7.68 | 6.74 |
| 49 | 0.002 | 0.004 | 0.007 | 0.003 | 0.003 | 0.003 | 0.005 | 0.003 | 0.003 | 0.003 |
| 57 | 0.003 | 0.007 | 0.011 | 0.005 | 0.005 | 0.006 | 0.009 | 0.007 | 0.004 | 0.007 |
| 61 | 0.005 | 0.011 | 0.018 | 0.008 | 0.008 | 0.009 | 0.014 | 0.010 | 0.007 | 0.010 |
| 29 | 8.18 | 8.50 | 6.12 | 6.98 | 8.49 | 6.92 | 7.76 | 7.08 | 8.60 | 8.17 |
| 47 | 0.002 | 0.003 | 0.004 | 0.002 | 0.002 | 0.003 | 0.004 | 0.003 | 0.005 | 0.004 |
| 55 | 0.003 | 0.005 | 0.007 | 0.004 | 0.004 | 0.004 | 0.005 | 0.006 | 0.003 | 0.004 |
| 59 | 0.004 | 0.008 | 0.012 | 0.007 | 0.006 | 0.007 | 0.009 | 0.009 | 0.008 | 0.008 |
| 31 | 5.01 | 5.00 | 4.82 | 5.02 | 4.31 | 4.29 | 5.37 | 4.25 | 5.87 | 5.53 |
| 32 | 1.98 | 1.94 | 1.90 | 1.59 | 1.81 | 1.58 | 1.76 | 1.99 | 1.89 | 2.20 |
| 33 | 0.86 | 2.19 | 2.83 | 1.69 | 1.76 | 1.96 | 2.27 | 2.04 | 1.09 | 1.88 |
| 34 | 1.65 | 3.87 | 5.14 | 2.58 | 3.18 | 3.08 | 3.95 | 4.00 | 2.02 | 3.97 |
| 35 | 2.51 | 6.06 | 7.96 | 4.28 | 4.94 | 5.04 | 6.22 | 6.04 | 3.11 | 5.85 |
| 50 | 0.002 | 0.005 | 0.006 | 0.004 | 0.004 | 0.005 | 0.005 | 0.005 | 0.003 | 0.003 |
| 58 | 0.004 | 0.008 | 0.010 | 0.005 | 0.008 | 0.008 | 0.008 | 0.010 | 0.006 | 0.007 |
| 62 | 0.006 | 0.013 | 0.016 | 0.009 | 0.012 | 0.012 | 0.012 | 0.014 | 0.009 | 0.011 |

Table 41: Provided are the measured parameters under 100 mM NaCl, low nitrogen (1.2 mM), low temperature (8-10 ° C.) and normal conditions of Sorghum accessions (Seed ID) according to the Correlation ID numbers (described in Table 40 above).

TABLE 42

Correlation between the expression level of selected genes of some embodiments of the invention in various tissues and the phenotypic performance under low nitrogen, normal, cold or salinity stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY14 | 0.75 | 1.28E−02 | 1 | 30 | LBY148 | 0.73 | 2.60E−02 | 5 | 10 |
| LBY148 | 0.76 | 1.80E−02 | 5 | 14 | LBY148 | 0.84 | 4.97E−03 | 8 | 12 |
| LBY149 | 0.77 | 4.09E−02 | 3 | 38 | LBY149 | 0.72 | 2.97E−02 | 6 | 49 |
| LBY149 | 0.73 | 2.52E−02 | 6 | 3 | LBY149 | 0.71 | 3.34E−02 | 6 | 5 |
| LBY149 | 0.84 | 4.83E−03 | 6 | 11 | LBY149 | 0.73 | 2.52E−02 | 6 | 23 |
| LBY149 | 0.71 | 3.34E−02 | 6 | 24 | LBY149 | 0.72 | 2.73E−02 | 6 | 21 |
| LBY149 | 0.71 | 3.25E−02 | 6 | 38 | LBY149 | 0.85 | 4.13E−03 | 2 | 46 |
| LBY150 | 0.79 | 1.06E−02 | 7 | 29 | LBY150 | 0.73 | 2.65E−02 | 7 | 54 |
| LBY151 | 0.78 | 1.36E−02 | 8 | 39 | LBY151 | 0.75 | 2.01E−02 | 8 | 33 |
| LBY151 | 0.73 | 2.61E−02 | 8 | 50 | LBY151 | 0.73 | 2.50E−02 | 8 | 4 |
| LBY152 | 0.72 | 2.94E−02 | 6 | 28 | LBY153 | 0.75 | 1.98E−02 | 7 | 29 |
| LBY153 | 0.71 | 3.29E−02 | 7 | 54 | LBY153 | 0.84 | 4.94E−03 | 2 | 46 |
| LBY154 | 0.86 | 1.27E−02 | 3 | 38 | LBY156 | 0.79 | 1.11E−02 | 5 | 48 |
| LBY156 | 0.73 | 2.54E−02 | 5 | 10 | LBY156 | 0.76 | 1.67E−02 | 5 | 56 |
| LBY156 | 0.80 | 9.81E−03 | 5 | 60 | LBY156 | 0.83 | 5.18E−03 | 5 | 14 |
| LBY157 | 0.73 | 2.49E−02 | 2 | 12 | LBY157 | 0.71 | 3.36E−02 | 2 | 39 |
| LBY158 | 0.71 | 3.31E−02 | 6 | 3 | LBY158 | 0.74 | 2.39E−02 | 6 | 45 |
| LBY158 | 0.81 | 8.44E−03 | 6 | 11 | LBY158 | 0.71 | 3.31E−02 | 6 | 23 |
| LBY158 | 0.72 | 2.92E−02 | 6 | 38 | LBY159 | 0.70 | 7.77E−02 | 3 | 25 |
| LBY161 | 0.75 | 5.23E−02 | 3 | 49 | LBY161 | 0.70 | 7.78E−02 | 3 | 3 |
| LBY161 | 0.78 | 3.98E−02 | 3 | 5 | LBY161 | 0.78 | 3.68E−02 | 3 | 61 |
| LBY161 | 0.71 | 7.58E−02 | 3 | 38 | LBY161 | 0.81 | 2.71E−02 | 3 | 19 |
| LBY161 | 0.77 | 4.27E−02 | 3 | 57 | LBY161 | 0.75 | 1.99E−02 | 7 | 29 |
| LBY161 | 0.72 | 2.75E−02 | 7 | 54 | LBY162 | 0.74 | 5.48E−02 | 3 | 15 |
| LBY162 | 0.83 | 2.06E−02 | 3 | 28 | LBY162 | 0.75 | 1.88E−02 | 5 | 51 |
| LBY162 | 0.82 | 7.09E−03 | 5 | 30 | LBY163 | 0.70 | 7.97E−02 | 3 | 38 |

TABLE 42-continued

Correlation between the expression level of selected genes of some embodiments of the invention in various tissues and the phenotypic performance under low nitrogen, normal, cold or salinity stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY164 | 0.70 | 3.43E−02 | 7 | 29 | LBY165 | 0.75 | 5.44E−02 | 3 | 27 |
| LBY165 | 0.88 | 9.23E−03 | 3 | 26 | LBY167 | 0.88 | 1.71E−03 | 8 | 12 |
| LBY167 | 0.77 | 1.52E−02 | 8 | 35 | LBY167 | 0.75 | 1.99E−02 | 8 | 34 |
| LBY167 | 0.93 | 2.25E−04 | 8 | 39 | LBY167 | 0.85 | 4.11E−03 | 8 | 58 |
| LBY167 | 0.87 | 2.58E−03 | 8 | 62 | LBY167 | 0.79 | 1.16E−02 | 8 | 33 |
| LBY167 | 0.88 | 1.77E−03 | 8 | 50 | LBY167 | 0.74 | 2.16E−02 | 8 | 8 |
| LBY167 | 0.79 | 1.10E−02 | 8 | 4 | LBY167 | 0.84 | 4.41E−03 | 7 | 44 |
| LBY167 | 0.75 | 1.96E−02 | 7 | 9 | LBY167 | 0.87 | 2.51E−03 | 2 | 12 |
| LBY167 | 0.74 | 2.13E−02 | 2 | 16 | LBY167 | 0.72 | 1.85E−02 | 1 | 51 |
| LBY170 | 0.70 | 3.46E−02 | 5 | 7 | LBY170 | 0.74 | 2.30E−02 | 5 | 56 |
| LBY170 | 0.73 | 2.59E−02 | 5 | 60 | LBY170 | 0.71 | 3.18E−02 | 5 | 37 |
| LBY170 | 0.83 | 5.43E−03 | 5 | 40 | LBY170 | 0.77 | 1.42E−02 | 7 | 6 |
| LBY171 | 0.76 | 4.55E−02 | 3 | 27 | LBY171 | 0.70 | 7.89E−02 | 3 | 11 |
| LBY171 | 0.87 | 1.14E−02 | 3 | 26 | LBY171 | 0.87 | 2.21E−03 | 5 | 7 |
| LBY171 | 0.77 | 1.50E−02 | 5 | 48 | LBY171 | 0.71 | 3.07E−02 | 5 | 2 |
| LBY171 | 0.88 | 1.55E−03 | 5 | 56 | LBY171 | 0.85 | 3.34E−03 | 5 | 60 |
| LBY171 | 0.87 | 2.51E−03 | 5 | 37 | LBY171 | 0.86 | 2.70E−03 | 5 | 40 |
| LBY171 | 0.86 | 3.26E−03 | 5 | 14 | LBY171 | 0.79 | 1.08E−02 | 6 | 49 |
| LBY171 | 0.81 | 7.89E−03 | 6 | 3 | LBY171 | 0.71 | 3.04E−02 | 6 | 25 |
| LBY171 | 0.71 | 3.13E−02 | 6 | 5 | LBY171 | 0.81 | 7.89E−03 | 6 | 23 |
| LBY171 | 0.73 | 2.69E−02 | 6 | 61 | LBY171 | 0.71 | 3.13E−02 | 6 | 24 |
| LBY171 | 0.76 | 1.78E−02 | 6 | 21 | LBY173 | 0.79 | 3.32E−02 | 3 | 23 |
| LBY173 | 0.85 | 1.57E−02 | 3 | 52 | LBY173 | 0.73 | 6.06E−02 | 3 | 24 |
| LBY173 | 0.77 | 4.11E−02 | 3 | 21 | LBY173 | 0.77 | 1.49E−02 | 7 | 59 |
| LBY173 | 0.71 | 3.25E−02 | 7 | 6 | LBY174 | 0.75 | 5.31E−02 | 3 | 28 |
| LBY174 | 0.77 | 1.61E−02 | 5 | 7 | LBY174 | 0.72 | 3.02E−02 | 5 | 56 |
| LBY174 | 0.74 | 2.24E−02 | 5 | 40 | LBY174 | 0.70 | 3.49E−02 | 8 | 31 |
| LBY175 | 0.75 | 5.08E−02 | 3 | 61 | LBY175 | 0.76 | 4.76E−02 | 3 | 57 |
| LBY176 | 0.73 | 6.46E−02 | 3 | 23 | LBY176 | 0.75 | 5.20E−02 | 3 | 52 |
| LBY176 | 0.71 | 7.49E−02 | 3 | 24 | LBY176 | 0.73 | 6.40E−02 | 3 | 21 |
| LBY176 | 0.79 | 6.66E−03 | 1 | 48 | LBY176 | 0.71 | 2.27E−02 | 1 | 2 |
| LBY176 | 0.76 | 1.10E−02 | 1 | 60 | LBY178 | 0.81 | 2.73E−02 | 3 | 49 |
| LBY178 | 0.72 | 6.56E−02 | 3 | 3 | LBY178 | 0.72 | 6.64E−02 | 3 | 61 |
| LBY178 | 0.71 | 7.39E−02 | 3 | 41 | LBY179 | 0.75 | 2.09E−02 | 5 | 7 |
| LBY179 | 0.76 | 1.84E−02 | 5 | 56 | LBY179 | 0.81 | 8.31E−03 | 5 | 37 |
| LBY179 | 0.82 | 6.58E−03 | 5 | 40 | LBY179 | 0.85 | 3.36E−03 | 5 | 14 |
| LBY179 | 0.81 | 8.29E−03 | 6 | 27 | LBY179 | 0.73 | 2.53E−02 | 6 | 25 |
| LBY179 | 0.77 | 1.46E−02 | 6 | 26 | LBY180 | 0.71 | 7.16E−02 | 3 | 27 |
| LBY180 | 0.92 | 3.53E−03 | 3 | 25 | LBY180 | 0.70 | 3.47E−02 | 8 | 33 |
| LBY180 | 0.71 | 3.26E−02 | 7 | 9 | LBY180 | 0.70 | 3.42E−02 | 7 | 13 |
| LBY183 | 0.75 | 5.38E−02 | 3 | 52 | LBY183 | 0.75 | 5.21E−02 | 3 | 28 |
| LBY183 | 0.74 | 2.38E−02 | 5 | 7 | LBY183 | 0.90 | 8.91E−04 | 5 | 10 |
| LBY183 | 0.78 | 1.26E−02 | 5 | 56 | LBY183 | 0.88 | 1.93E−03 | 5 | 37 |
| LBY183 | 0.79 | 1.20E−02 | 5 | 40 | LBY183 | 0.88 | 1.74E−03 | 5 | 14 |
| LBY184 | 0.72 | 6.62E−02 | 3 | 61 | LBY184 | 0.71 | 7.31E−02 | 3 | 57 |
| LBY184 | 0.75 | 1.93E−02 | 2 | 46 | LBY185 | 0.75 | 5.39E−02 | 3 | 15 |
| LBY185 | 0.79 | 3.26E−02 | 3 | 52 | LBY185 | 0.74 | 2.33E−02 | 6 | 3 |
| LBY185 | 0.70 | 3.52E−02 | 6 | 15 | LBY185 | 0.71 | 3.18E−02 | 6 | 45 |
| LBY185 | 0.71 | 3.36E−02 | 6 | 11 | LBY185 | 0.74 | 2.33E−02 | 6 | 23 |
| LBY185 | 0.71 | 3.16E−02 | 6 | 21 | LBY185 | 0.79 | 1.12E−02 | 7 | 59 |
| LBY186 | 0.81 | 4.89E−03 | 1 | 48 | LBY186 | 0.77 | 9.92E−03 | 1 | 2 |
| LBY187 | 0.72 | 6.75E−02 | 3 | 22 | LBY188 | 0.89 | 1.18E−03 | 5 | 10 |
| LBY188 | 0.71 | 3.26E−02 | 5 | 14 | LBY190 | 0.73 | 6.10E−02 | 3 | 49 |
| LBY190 | 0.73 | 6.40E−02 | 3 | 3 | LBY191 | 0.80 | 9.80E−03 | 5 | 51 |
| LGN3 | 0.72 | 6.78E−02 | 3 | 22 | LGN3 | 0.76 | 1.78E−02 | 5 | 56 |
| LGN3 | 0.82 | 6.98E−03 | 5 | 37 | LGN3 | 0.79 | 1.07E−02 | 5 | 40 |
| LGN3 | 0.81 | 8.13E−03 | 5 | 14 | LGN4 | 0.82 | 2.25E−02 | 3 | 15 |
| LGN4 | 0.76 | 4.83E−02 | 3 | 45 | LGN4 | 0.85 | 3.98E−03 | 5 | 7 |
| LGN4 | 0.74 | 2.17E−02 | 5 | 48 | LGN4 | 0.71 | 3.24E−02 | 5 | 10 |
| LGN4 | 0.85 | 3.86E−03 | 5 | 56 | LGN4 | 0.82 | 6.63E−03 | 5 | 60 |
| LGN4 | 0.80 | 8.96E−03 | 5 | 37 | LGN4 | 0.80 | 9.21E−03 | 5 | 40 |
| LGN4 | 0.95 | 6.09E−05 | 5 | 14 | LGN4 | 0.82 | 6.74E−03 | 6 | 49 |
| LGN4 | 0.83 | 5.67E−03 | 6 | 3 | LGN4 | 0.78 | 1.30E−02 | 6 | 25 |
| LGN4 | 0.72 | 2.73E−02 | 6 | 5 | LGN4 | 0.83 | 5.67E−03 | 6 | 23 |
| LGN4 | 0.75 | 1.93E−02 | 6 | 61 | LGN4 | 0.72 | 2.73E−02 | 6 | 24 |
| LGN4 | 0.77 | 1.45E−02 | 6 | 21 | LGN5 | 0.87 | 1.06E−02 | 3 | 22 |
| LGN5 | 0.78 | 1.39E−02 | 8 | 12 | LGN5 | 0.73 | 2.70E−02 | 6 | 22 |
| LGN57 | 0.83 | 2.18E−02 | 3 | 25 | LGN57 | 0.70 | 3.46E−02 | 5 | 51 |
| LGN57 | 0.72 | 2.96E−02 | 5 | 30 | LGN57 | 0.79 | 1.15E−02 | 2 | 31 |
| LGN6 | 0.76 | 1.85E−02 | 7 | 1 | LGN6 | 0.70 | 3.54E−02 | 7 | 47 |

TABLE 42-continued

Correlation between the expression level of selected genes of some embodiments of the invention in various tissues and the phenotypic performance under low nitrogen, normal, cold or salinity stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LGN7 | 0.74 | 5.77E−02 | 3 | 11 | LGN7 | 0.71 | 7.22E−02 | 3 | 24 |
| LGN7 | 0.71 | 3.06E−02 | 5 | 37 | LGN7 | 0.71 | 3.07E−02 | 6 | 38 |
| LGN7 | 0.77 | 1.48E−02 | 6 | 19 | | | | | |

Table 42 Provided are the correlations (R) between the genes expression levels in various tissues and the phenotypic performance. "Corr. ID"—correlation set ID according to the correlated parameters specified in Table 40. "Exp. Set"—Expression set specified in Table 39. "R" = Pearson correlation coefficient; "P" = p value.

Example 7

Production of Sorghum Transcriptome and High Throughput Correlation Analysis Using 60K Sorghum Oligonucleotide Micro-Array In order to produce a high throughput correlation analysis between plant phenotype and gene expression level, the present inventors utilized a sorghum oligonucleotide microarray, produced by Agilent Technologies [chem. (dot) agilent (dot) com/Scripts/PDS (dot) asp?1Page=50879]. The array oligonucleotide represents about 60,000 sorghum genes and transcripts. In order to define correlations between the levels of RNA expression with vigor related parameters, various plant characteristics of 10 different sorghum hybrids were analyzed. The correlation between the RNA levels and the characterized parameters was analyzed using Pearson correlation test [davidmlane (dot) com/hyperstat/A34739 (dot) html].

Experimental Procedures

Correlation of Sorghum varieties across ecotypes grown in growth chambers under temperature of 30° C. or 14° C. at low light (100 μE) or high light (250 μE) conditions.

Analyzed Sorghum tissues—All 10 selected Sorghum hybrids were sampled per each condition. Leaf tissue growing under 30° C. and low light (100 μE m$^{-2}$ sec$^{-1}$), 14° C. and low light (100 μE m$^{-2}$ sec$^{-1}$), 30° C. and high light (250 μE m$^{-2}$ sec$^{-1}$), 14° C. and high light (250 μE m$^{-2}$ sec$^{-1}$) were sampled at vegetative stage of four-five leaves and RNA was extracted as described above. Each micro-array expression information tissue type has received a Set ID as summarized in Table 43 below.

TABLE 43

Sorghum transcriptome expression sets in field experiments

| Description | Expression set |
|---|---|
| Sorghum/leaf, under 14 Celsius degrees and high light (light on) | 1 |
| Sorghum/leaf, under 14 Celsius degrees and low light (light on) | 2 |
| Sorghum/leaf, under 30 Celsius degrees and high light (light on) | 3 |
| Sorghum/leaf, under 30 Celsius degrees and low light (light on) | 4 |

Table 43: Provided are the sorghum transcriptome expression sets.

The following parameters were collected by sampling 8-10 plants per plot or by measuring the parameter across all the plants within the plot (Table 44 below).

Relative Growth Rate of vegetative dry weight was performed using Formula VII.

Leaves number—Plants were characterized for leaf number during growing period. In each measure, plants were measured for their leaf number by counting all the leaves of selected plants per plot.

Shoot FW—shoot fresh weight (FW) per plant, measurement of all vegetative tissue above ground.

Shoot DW—shoot dry weight (DW) per plant, measurement of all vegetative tissue above ground after drying at 70° C. in oven for 48 hours.

The average for each of the measured parameters was calculated and values are summarized in Tables 45-48 below. Subsequent correlation analysis was performed (Table 49). Results were then integrated to the database.

TABLE 44

Sorghum correlated parameters (vectors)

| Correlated parameter with | Correlation ID |
|---|---|
| Leaves number | 1 |
| Leaves temperature [° C.] | 2 |
| RGR (relative growth rate) | 3 |
| Shoot DW (dry weight) (gr.) | 4 |
| Shoot FW (fresh weight) (gr.) | 5 |

Table 44. Provided are the Sorghum correlated parameters (vectors).

TABLE 45

Measured parameters in Sorghum accessions under 14° C. and low light (100 μE m–2 sec–1)

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 3.00 | 3.00 | 2.75 | 2.75 | 2.63 | 3.00 | 3.50 | 2.75 | 2.43 | 2.00 |
| 3 | 0.032 | −0.014 | −0.022 | 0.024 | −0.037 | −0.045 | 0.083 | NA | −0.050 | −0.073 |

TABLE 45-continued

Measured parameters in Sorghum accessions under 14° C. and low light (100 μE m$^{-2}$ sec$^{-1}$)

| Ecotype/ Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 4 | 0.041 | 0.013 | 0.013 | 0.009 | 0.011 | 0.011 | 0.031 | 0.009 | 0.009 | 0.009 |
| 5 | 0.55 | 0.30 | 0.33 | 0.28 | 0.36 | 0.36 | 0.58 | 0.22 | 0.18 | 0.30 |

Table 45: Provided are the values of each of the parameters (as described above) measured in Sorghum accessions (Seed ID) under 14° C. and low light (100 μE m$^{-2}$ sec$^{-1}$).

TABLE 46

Measured parameters in Sorghum accessions under 30° C. and low light (100 μE m$^{-2}$ sec$^{-1}$)

| Ecotype/ Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 5.27 | 5.00 | 4.75 | 4.00 | 4.00 | 4.00 | 5.25 | 4.50 | 3.75 | 4.00 |
| 2 | 28.140 | 29.813 | 24.213 | 23.138 | 19.900 | 21.350 | 23.360 | 29.922 | 21.525 | 24.440 |
| 3 | 0.099 | 0.098 | 0.090 | 0.122 | 0.108 | 0.084 | 0.113 | 0.121 | 0.042 | 0.039 |
| 4 | 0.114 | 0.079 | 0.071 | 0.056 | 0.093 | 0.077 | 0.040 | 0.055 | 0.036 | 0.050 |
| 5 | 1.35 | 1.05 | 0.88 | 0.95 | 1.29 | 1.13 | 0.71 | 0.79 | 0.67 | 0.82 |

Table 46: Provided are the values of each of the parameters (as described above) measured in Sorghum accessions (Seed ID) under 30° C. and low light (100 μE m$^{-2}$ sec$^{-1}$).

TABLE 47

Measured parameters in Sorghum accessions under 30° C. and high light (250 μE m$^{-2}$ sec$^{-1}$)

| Ecotype/ Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 4.00 | 3.70 | 3.50 | 3.33 | 4.00 | 4.00 | 3.60 | 3.40 | 3.30 | 3.40 |
| 3 | 0.098 | 0.096 | 0.087 | 0.070 | 0.094 | 0.118 | 0.097 | 0.099 | 0.106 | 0.121 |
| 4 | 0.076 | 0.050 | 0.047 | 0.036 | 0.065 | 0.085 | 0.049 | 0.042 | 0.042 | 0.062 |
| 5 | 0.77 | 0.52 | 0.49 | 0.38 | 0.71 | 0.86 | 0.49 | 0.45 | 0.44 | 0.67 |

Table 47: Provided are the values of each of the parameters (as described above) measured in Sorghum accessions (Seed ID) under 30° C. and high light (250 μE m$^{-2}$ sec$^{-1}$).

TABLE 48

Measured parameters in Sorghum accessions under 14° C. and high light (250 μE m$^{-2}$ sec$^{-1}$)

| Ecotype/ Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 3 | 0.053 | 0.052 | 0.034 | 0.040 | 0.056 | 0.061 | 0.049 | 0.056 | 0.068 | 0.063 |
| 4 | 0.037 | 0.026 | 0.021 | 0.023 | 0.037 | 0.036 | 0.022 | 0.022 | 0.023 | 0.027 |
| 5 | 0.37 | 0.25 | 0.22 | 0.25 | 0.43 | 0.37 | 0.24 | 0.23 | 0.24 | 0.27 |

Table 48: Provided are the values of each of the parameters (as described above) measured in Sorghum accessions (Seed ID) under 14° C. and high light (250 μE m$^{-2}$ sec$^{-1}$).

TABLE 49

Correlation between the expression level of selected genes of some embodiments of the invention in various tissues and the phenotypic performance under combinations of temperature and light conditions treatments (14° C. or 30° C. ; high light (250 μE m$^{-2}$ sec$^{-1}$) or low light (100 μE m$^{-2}$ sec$^{-1}$) across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY148 | 0.70 | 3.50E−02 | 2 | 3 | LBY150 | 0.87 | 2.55E−02 | 3 | 5 |
| LBY150 | 0.90 | 1.32E−02 | 3 | 4 | LBY150 | 0.77 | 7.42E−02 | 3 | 1 |
| LBY151 | 0.78 | 6.98E−02 | 3 | 3 | LBY152 | 0.88 | 7.21E−04 | 4 | 2 |

TABLE 49-continued

Correlation between the expression level of selected genes of some embodiments of the invention in various tissues and the phenotypic performance under combinations of temperature and light conditions treatments (14° C. or 30° C. ; high light (250 µE m$^{-2}$ sec$^{-1}$) or low light (100 µE m$^{-2}$ sec$^{-1}$) across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY157 | 0.73 | 1.66E−02 | 1 | 5 | LBY157 | 0.71 | 2.03E−02 | 1 | 4 |
| LBY158 | 0.72 | 1.84E−02 | 4 | 4 | LBY158 | 0.72 | 1.94E−02 | 2 | 5 |
| LBY158 | 0.80 | 1.04E−02 | 2 | 3 | LBY158 | 0.77 | 7.20E−02 | 3 | 5 |
| LBY158 | 0.83 | 4.25E−02 | 3 | 4 | LBY159 | 0.77 | 8.88E−03 | 4 | 2 |
| LBY162 | 0.86 | 1.37E−03 | 2 | 5 | LBY162 | 0.79 | 1.17E−02 | 2 | 3 |
| LBY162 | 0.86 | 1.25E−03 | 2 | 4 | LBY164 | 0.77 | 9.28E−03 | 2 | 5 |
| LBY165 | 0.84 | 3.76E−02 | 3 | 3 | LBY168 | 0.74 | 1.34E−02 | 1 | 5 |
| LBY168 | 0.70 | 2.40E−02 | 1 | 4 | LBY168 | 0.73 | 1.68E−02 | 4 | 1 |
| LBY170 | 0.72 | 1.77E−02 | 2 | 5 | LBY170 | 0.91 | 6.12E−04 | 2 | 3 |
| LBY171 | 0.75 | 1.32E−02 | 4 | 3 | LBY173 | 0.75 | 1.17E−02 | 4 | 2 |
| LBY173 | 0.72 | 1.07E−01 | 3 | 4 | LBY174 | 0.74 | 9.02E−02 | 3 | 3 |
| LBY175 | 0.75 | 8.56E−02 | 3 | 5 | LBY175 | 0.81 | 5.27E−02 | 3 | 4 |
| LBY177 | 0.77 | 1.60E−02 | 2 | 3 | LBY177 | 0.88 | 2.20E−02 | 3 | 5 |
| LBY177 | 0.90 | 1.47E−02 | 3 | 4 | LBY177 | 0.75 | 8.33E−02 | 3 | 1 |
| LBY178 | 0.76 | 1.07E−02 | 2 | 5 | LBY178 | 0.79 | 6.08E−02 | 3 | 5 |
| LBY178 | 0.81 | 5.07E−02 | 3 | 4 | LBY178 | 0.81 | 5.15E−02 | 3 | 1 |
| LBY180 | 0.72 | 2.82E−02 | 2 | 3 | LBY180 | 0.74 | 9.20E−02 | 3 | 5 |
| LBY180 | 0.79 | 6.04E−02 | 3 | 4 | LBY183 | 0.74 | 2.19E−02 | 2 | 3 |
| LBY187 | 0.71 | 1.15E−01 | 3 | 3 | LBY187 | 0.71 | 1.16E−01 | 3 | 4 |
| LBY190 | 0.71 | 2.27E−02 | 4 | 2 | LBY192 | 0.75 | 1.33E−02 | 2 | 5 |
| LBY192 | 0.81 | 4.58E−03 | 2 | 4 | LGN5 | 0.85 | 4.01E−03 | 2 | 3 |
| LGN5 | 0.79 | 6.00E−02 | 3 | 3 | LGN54 | 0.93 | 7.13E−03 | 3 | 3 |
| LGN7 | 0.93 | 6.90E−03 | 3 | 5 | LGN7 | 0.96 | 2.94E−03 | 3 | 4 |
| LGN7 | 0.93 | 7.34E−03 | 3 | 1 | | | | | |

Table 49. Provided are the correlations (R) between the genes expression levels in various tissues and the phenotypic performance. "Corr. ID"—correlation set ID according to the correlated parameters specified in Table 44. "Exp. Set"—Expression set specified in Table 43. "R" = Pearson correlation coefficient; "P" = p value.

Example 8

Production of Sorghum Transcriptome and High Throughput Correlation Analysis with Yield and Drought Related Parameters Measured in Fields Using 65K Sorghum Oligonucleotide Micro-Arrays In order to produce a high throughput correlation analysis between plant phenotype and gene expression level, the present inventors utilized a sorghum oligonucleotide microarray, produced by Agilent Technologies [chem. (dot) agilent (dot) com/Scripts/PDS (dot) asp?1Page=50879]. The array oligonucleotide represents about 65,000 sorghum genes and transcripts. In order to define correlations between the levels of RNA expression with ABST, drought and yield components or vigor related parameters, various plant characteristics of 12 different sorghum hybrids were analyzed. Among them, 8 hybrids encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

12 Sorghum varieties were grown in 6 repetitive plots, in field. Briefly, the growing protocol was as follows:

1. Regular growth conditions: sorghum plants were grown in the field using commercial fertilization and irrigation protocols, which include 452 m$^3$ water per dunam (1000 square meters) per entire growth period and fertilization of 14 units nitrogen per dunam per entire growth period (normal conditions). The nitrogen can be obtained using URAN® 21% (Nitrogen Fertilizer Solution; PCS Sales, Northbrook, Ill., USA).

2. Drought conditions: sorghum seeds were sown in soil and grown under normal condition until flowering stage (59 days from sowing), drought treatment was imposed by irrigating plants with 50% water relative to the normal treatment from this stage [309 m$^3$ water per dunam (1000 square meters) per the entire growth period)], with normal fertilization (i.e., 14 units nitrogen per dunam).

Analyzed Sorghum tissues—All 12 selected Sorghum hybrids were sampled per each treatment. Tissues [Flag leaf, upper stem, lower stem, flower, grain] representing different plant characteristics, from plants growing under normal conditions and drought stress conditions were sampled and RNA was extracted as described above. Each micro-array expression information tissue type has received a Set ID as summarized in Table 50 below.

TABLE 50

Sorghum transcriptome expression sets in field experiment under normal conditions

| Expression Set | Set ID |
|---|---|
| Basal head at grain filling stage under normal conditions | 1 |
| Distal head at grain filling stage under normal conditions | 2 |
| Flag leaf at flowering stage under normal conditions | 3 |
| Flag leaf at grain filling stage under normal conditions | 4 |
| Up stem at flowering stage under normal conditions | 5 |
| Up stem at grain filling stage under normal conditions | 6 |

Table 50: Provided are the sorghum transcriptome expression sets. Flag leaf = the leaf below the flower.

TABLE 51

Sorghum transcriptome expression sets in field experiment under drought conditions

| Expression Set | Set ID |
|---|---|
| Basal head at grain filling stage under drought conditions | 1 |
| Distal head at grain filling stage under drought conditions | 2 |
| Flag leaf at flowering stage under drought conditions | 3 |
| Flag leaf at grain filling stage under drought conditions | 4 |
| Up stem at flowering stage under drought conditions | 5 |
| Up stem at grain filling stage under drought conditions | 6 |

Table 51: Provided are the sorghum transcriptome expression sets under drought conditions. Flag leaf = the leaf below the flower.

Sorghum yield components and vigor related parameters assessment—Plants were phenotyped as shown in Tables 53-56 below. Some of the following parameters were collected using digital imaging system:

Grains yield per plant (gr)—At the end of the growing period heads were collected (harvest stage). Selected heads were separately threshed and grains were weighted. The average grain weight per plant was calculated by dividing the total grain weight by the number of selected plants.

Heads weight per plant (RP) (kg)—At the end of the growing period heads of selected plants were collected (harvest stage) from the rest of the plants in the plot. Heads were weighted after oven dry (dry weight), and average head weight per plant was calculated.

Grains num (SP) (num)—was calculated by dividing seed yield from selected plants by a single seed weight.

1000 grain (seed) weight (gr)—was calculated based on Formula XIV.

Grain area (cm$^2$)—At the end of the growing period the grains were separated from the Plant 'Head'. A sample of ~200 grains were weighted, photographed and images were processed using the below described image processing system. The grain area was measured from those images and was divided by the number of grains.

Grain Circularity—The circularity of the grains was calculated based on Formula XIX.

Main Head Area (cm$^2$)—At the end of the growing period selected "Main Heads" were photographed and images were processed using the below described image processing system. The "Main Head" area was measured from those images and was divided by the number of "Main Heads".

Main Head length (cm)—At the end of the growing period selected "Main Heads" were photographed and images were processed using the below described image processing system. The "Main Head" length (longest axis) was measured from those images and was divided by the number of "Main Heads".

Main Head Width (cm)—At the end of the growing period selected "Main Heads" were photographed and images were processed using the below described image processing system. The "Main Head" width (longest axis) was measured from those images and was divided by the number of "Main Heads".

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling selected plants in a plot or by measuring the parameter across all the plants within the plot.

All Heads Area (cm$^2$)—At the end of the growing period (harvest) selected plants main and secondary heads were photographed and images were processed using the above described image processing system. All heads area was measured from those images and was divided by the number of plants.

All Heads length (cm)—At the end of the growing period (harvest) selected plants main and secondary heads were photographed and images were processed using the above described image processing system. All heads length (longest axis) was measured from those images and was divided by the number of plants.

All Heads Width (cm)—At the end of the growing period main and secondary heads were photographed and images were processed using the above described image processing system. All heads width (longest axis) was measured from those images and was divided by the number of plants.

Head weight per plant (RP)/water until maturity (gr./lit)—At the end of the growing period heads were collected (harvest stage) from the rest of the plants in the plot. Heads were weighted after oven dry (dry weight), and average head weight per plant was calculated. Head weight per plant was then divided by the average water volume used for irrigation until maturity.

Harvest index (SP)—was calculated based on Formula XVI above.

Heads index (RP)—was calculated based on Formula XXXXVI above.

Head dry weight (GF) (gr.)—selected heads per plot were collected at the grain filling stage (R2-R3) and weighted after oven dry (dry weight).

Heads per plant (RP) (num)—At the end of the growing period total number of rest of plot heads were counted and divided by the total number of rest of plot plants.

Leaves temperature 2 (° C.)—leaf temperature was measured using Fluke IR thermometer 568 device. Measurements were done on opened leaves at grain filling stage.

Leaves temperature 6 (° C.)—leaf temperature was measured using Fluke IR thermometer 568 device. Measurements were done on opened leaves at late grain filling stage.

Stomatal conductance (F) (mmol m$^2$ s$^{-1}$)—plants were evaluated for their stomata conductance using SC-1 Leaf Porometer (Decagon devices) at flowering (F) stage. Stomata conductance readings were done on fully developed leaf, for 2 leaves and 2 plants per plot.

Stomatal conductance (GF) (mmol m$^2$ s$^{-1}$)—plants were evaluated for their stomata conductance using SC-1 Leaf Porometer (Decagon devices) at grain filling (GF) stage. Stomata conductance readings were done on fully developed leaf, for 2 leaves and 2 plants per plot.

Relative water content 2 (RWC, %)—was calculated based on Formula I at grain filling.

Specific leaf area (SLA) (GF)—was calculated based on Formula XXXVII above.

Waxy leaf blade—was defined by view of leaf blades % of Normal and % of grayish (powdered coating/frosted appearance). Plants were scored for their waxiness according to the scale 0=normal, 1=intermediate, 2=grayish.

SPAD 2 (SPAD unit)—Chlorophyll content was determined using a Minolta SPAD 502 chlorophyll meter and measurement was performed at flowering. SPAD meter readings were done on fully developed leaf. Three measurements per leaf were taken per plant.

SPAD 3 (SPAD unit)—Chlorophyll content was determined using a Minolta SPAD 502 chlorophyll meter and measurement was performed at grain filling. SPAD meter readings were done on fully developed leaf. Three measurements per leaf were taken per plant.

% yellow leaves number (F) (percentage)—At flowering stage, leaves of selected plants were collected. Yellow and green leaves were separately counted. Percent of yellow leaves at flowering was calculated for each plant by dividing yellow leaves number per plant by the overall number of leaves per plant and multiplying by 100.

% yellow leaves number (H) (percentage)—At harvest stage, leaves of selected plants were collected. Yellow and green leaves were separately counted. Percent of yellow leaves at flowering was calculated for each plant by dividing yellow leaves number per plant by the overall number of leaves per plant and multiplying by 100.

% Canopy coverage (GF)—was calculated based on Formula XXXII above.

LAI LP-80 (GF)—Leaf area index values were determined using an AccuPAR Centrometer Model LP-80 and measurements were performed at grain filling stage with three measurements per plot.

Leaves area per plant (GF) (cm$^2$)—total leaf area of selected plants in a plot. This parameter was measured using a Leaf area-meter at the grain filling period (GF).

Plant height (H) (cm)—Plants were characterized for height at harvest. Plants were measured for their height using a measuring tape. Height was measured from ground level to top of the longest leaf.

Relative growth rate of Plant height (cm/day)—was calculated based on Formula III above.

Number days to Heading (num)—Calculated as the number of days from sowing till 50% of the plot arrives to heading.

Number days to Maturity (num)—Calculated as the number of days from sowing till 50% of the plot arrives to seed maturation.

Vegetative DW per plant (gr.)—At the end of the growing period all vegetative material (excluding roots) from plots were collected and weighted after oven dry (dry weight). The biomass per plant was calculated by dividing total biomass by the number of plants.

Lower Stem dry density (F) (gr/cm$^3$)—measured at flowering. Lower internodes from selected plants per plot were separated from the plants and weighted (dry weight). To obtain stem density, internode dry weight was divided by the internode volume.

Lower Stem dry density (H) (gr/cm$^3$)—measured at harvest. Lower internodes from selected plants per plot were separated from the plant and weighted (dry weight). To obtain stem density, internode dry weight was divided by the internode volume.

Lower Stem fresh density (F) (gr/cm$^3$)—measured at flowering. Lower internodes from selected plants per plot were separated from the plants and weighted (fresh weight). To obtain stem density, internodes fresh weight was divided by the stem volume.

Lower Stem fresh density (H) (gr/cm$^3$)—measured at harvest. Lower internodes from selected plants per plot were separated from the plants and weighted (fresh weight). To obtain stem density, internodes fresh weight was divided by the stem volume.

Lower Stem length (F) (cm)—Lower internodes from selected plants per plot were separated from the plants at flowering (F). Internodes were measured for their length using a ruler.

Lower Stem length (H) (cm)—Lower internodes from selected plants per plot were separated from the plant at harvest (H). Internodes were measured for their length using a ruler.

Lower Stem width (F) (cm)—Lower internodes from selected plants per plot were separated from the plant at flowering (F). Internodes were measured for their width using a caliber.

Lower Stem width (GF) (cm)—Lower internodes from selected plants per plot were separated from the plant at grain filling (GF). Internodes were measured for their width using a caliber.

Lower Stem width (H) (cm)—Lower internodes from selected plants per plot were separated from the plant at harvest (H). Internodes were measured for their width using a caliber.

Upper Stem dry density (F) (gr/cm$^3$)—measured at flowering (F). Upper internodes from selected plants per plot were separated from the plant and weighted (dry weight). To obtain stem density, stem dry weight was divided by the stem volume.

Upper Stem dry density (H) (gr/cm$^3$)—measured at harvest (H). Upper stems from selected plants per plot were separated from the plant and weighted (dry weight). To obtain stem density, stem dry weight was divided by the stem volume.

Upper Stem fresh density (F) (gr/cm$^3$)—measured at flowering (F). Upper stems from selected plants per plot were separated from the plant and weighted (fresh weight). To obtain stem density, stem fresh weight was divided by the stem volume.

Upper Stem fresh density (H) (gr/cm$^3$)—measured at harvest (H). Upper stems from selected plants per plot were separated from the plant and weighted (fresh weight). To obtain stem density, stem fresh weight was divided by the stem volume.

Upper Stem length (F) (cm)—Upper stems from selected plants per plot were separated from the plant at flowering (F). Stems were measured for their length using a ruler.

Upper Stem length (H) (cm)—Upper stems from selected plants per plot were separated from the plant at harvest (H). Stems were measured for their length using a ruler.

Upper Stem width (F) (cm)—Upper stems from selected plants per plot were separated from the plant at flowering (F). Stems were measured for their width using a caliber.

Upper Stem width (H) (cm)—Upper stems from selected plants per plot were separated from the plant at harvest (H). Stems were measured for their width using a caliber.

Upper Stem volume (H)—was calculated based on Formula L above.

Data parameters collected are summarized in Table 52, herein below.

TABLE 52

Sorghum correlated parameters under normal and drought growth conditions (vectors)

| Correlated parameter with | Correlation ID |
|---|---|
| % Canopy coverage (GF) [%] | 1 |
| % yellow leaves number (F) [%] | 2 |
| % yellow leaves number (H) [%] | 3 |
| 1000 grain weight [gr.] | 4 |

TABLE 52-continued

Sorghum correlated parameters under normal and drought growth conditions (vectors)

| Correlated parameter with | Correlation ID |
|---|---|
| All Heads Area [cm$^2$] | 5 |
| All Heads Width [cm] | 6 |
| All Heads length [cm] | 7 |
| Grain Circularity [cm$^2$/cm$^2$] | 8 |
| Grain area [cm$^2$] | 9 |
| Grains num (SP) [num] | 10 |
| Grains yield per plant [gr.] | 11 |
| Harvest index (SP) | 12 |
| Head DW (GF) [gr.] | 13 |
| Head weight per plant (RP)/water until maturity [gr./lit] | 14 |
| Heads index (RP) | 15 |
| Heads per plant (RP) [num] | 16 |
| Heads weight per plant (RP) [kg] | 17 |
| LAI LP-80 (GF) | 18 |
| Leaves area per plant (GF) [cm$^2$] | 19 |
| Leaves temperature_2 [° C.] | 20 |
| Leaves temperature_6 [° C.] | 21 |
| Lower Stem dry density (F) [gr./cm$^3$] | 22 |
| Lower Stem dry density (H) [gr./cm$^3$] | 23 |
| Lower Stem fresh density (F) [gr./cm$^3$] | 24 |
| Lower Stem fresh density (H) [gr./cm$^3$] | 25 |
| Lower Stem length (F) [cm] | 26 |
| Lower Stem length (H) [cm] | 27 |
| Lower Stem width (F) [cm] | 28 |
| Lower Stem width (GF) [cm] | 29 |
| Lower Stem width (H) [cm] | 30 |
| Main Head Area [cm$^2$] | 31 |
| Main Head Width [cm] | 32 |
| Main Head length [cm] | 33 |
| Num days to Heading [num] | 34 |
| Num days to Maturity [num] | 35 |
| Plant height (H) [cm] | 36 |
| Plant height growth [cm/day] | 37 |
| RWC 2 [%] | 38 |
| SPAD 2 [SPAD unit] | 39 |
| SPAD 3 [SPAD unit] | 40 |
| Specific leaf area (GF) [cm$^2$/gr] | 41 |
| Stomatal conductance (F) [mmol m$^{-2}$ s$^{-1}$] | 42 |
| Stomatal conductance (GF) [mmol m$^{-2}$ s$^{-1}$] | 43 |
| Upper Stem dry density (F) [gr/cm$^3$] | 44 |
| Upper Stem dry density (H) [gr/cm$^3$] | 45 |
| Upper Stem fresh density (F) [gr/cm$^3$] | 46 |
| Upper Stem fresh density (H) [gr/cm$^3$] | 47 |
| Upper Stem length (F) [cm] | 48 |
| Upper Stem length (H) [cm] | 49 |
| Upper Stem volume (H) [cm$^3$] | 50 |
| Upper Stem width (F) [cm] | 51 |
| Upper Stem width (H) [cm] | 52 |
| Vegetative DW per plant [gr] | 53 |
| Waxy leaf blade [scoring 0-2] | 54 |

Table 52. Provided are the Sorghum correlated parameters (vectors). "gr." = grams; "kg" = kilograms"; "RP" = Rest of plot; "SP" = Selected plants; "num" = Number; "lit" = Liter; "SPAD" = chlorophyll levels; "FW" = Plant Fresh weight; "DW" = Plant Dry weight; "GF" = Grain filling growth stage; "F" = Flowering stage; "H" = Harvest stage; "cm" = Centimeter; "mmol" = millimole.

Experimental Results

Twelve different sorghum hybrids were grown and characterized for different parameters (Table 52). The average for each of the measured parameter was calculated using the JMP software (Tables 53-56) and a subsequent correlation analysis was performed (Tables 57-58). Results were then integrated to the database.

TABLE 53

Measured parameters in Sorghum accessions under normal conditions

| Line/Corr. ID | Line-1 | Line-2 | Line-3 | Line-4 | Line-5 | Line-6 |
|---|---|---|---|---|---|---|
| 1 | 94.985 | 69.219 | 97.525 | 83.591 | 92.773 | 84.341 |
| 2 | 0.611 | 0.853 | 0.548 | 0.314 | 0.713 | 0.573 |
| 3 | 0.406 | 0.111 | 0.370 | 0.126 | 0.485 | 0.149 |
| 4 | 27.623 | 22.819 | 14.876 | 18.467 | 28.471 | 27.138 |
| 5 | 114.483 | 79.685 | 77.873 | 79.688 | 218.954 | 100.146 |
| 6 | 5.536 | 4.925 | 6.197 | 4.558 | 9.988 | 6.545 |
| 7 | 27.738 | 21.360 | 17.811 | 23.739 | 32.185 | 19.449 |
| 8 | 0.8722 | 0.8653 | 0.8714 | 0.8821 | 0.8682 | 0.8856 |
| 9 | 0.154 | 0.119 | 0.098 | 0.122 | 0.154 | 0.149 |
| 10 | 12730.1 | 6281.9 | 4599.5 | 15182.6 | 12628.1 | 17505.0 |
| 11 | 43.867 | 18.013 | 8.536 | 33.168 | 44.326 | 60.190 |
| 12 | 0.218 | 0.185 | 0.054 | 0.253 | 0.261 | 0.375 |
| 13 | 29.307 | 12.924 | 27.947 | 41.320 | 38.867 | 15.243 |
| 14 | 0.248 | 0.163 | 0.136 | 0.197 | 0.178 | 0.285 |
| 15 | 0.343 | 0.402 | 0.241 | 0.338 | 0.361 | 0.532 |
| 16 | NA | 1.420 | 1.742 | 1.296 | 0.974 | 1.727 |
| 17 | 0.0569 | 0.0374 | 0.0312 | 0.0452 | 0.0409 | 0.0655 |
| 18 | 6.272 | NA | 6.111 | 5.422 | 5.432 | NA |
| 19 | 2825.8 | 1911.2 | 2030.0 | 2866.8 | 1554.7 | 2342.6 |
| 20 | 32.4397 | 32.1479 | 33.1993 | 32.3472 | 32.4000 | 31.0687 |
| 21 | 33.3486 | 33.9333 | 33.2315 | 33.3292 | 33.6167 | 33.8037 |
| 22 | 1.572 | 1.371 | 2.811 | 2.171 | 2.349 | 1.404 |
| 23 | 1.832 | 2.027 | 3.476 | 2.527 | 3.048 | 1.801 |
| 24 | 10.4667 | 10.6380 | 8.5509 | 10.8515 | 11.3170 | 10.0379 |
| 25 | 9.791 | 10.382 | 10.521 | 10.490 | 11.283 | 7.286 |
| 26 | 7.787 | 3.500 | 14.900 | 3.413 | 11.121 | 8.158 |
| 27 | 7.992 | 4.830 | 12.873 | 3.117 | 10.760 | 8.302 |
| 28 | 19.489 | 16.718 | 14.703 | 17.942 | 14.826 | 15.979 |
| 29 | 20.041 | 20.885 | 14.661 | 18.797 | 15.291 | 15.874 |
| 30 | 19.124 | 15.508 | 14.368 | 20.277 | 15.150 | 15.143 |
| 31 | 114.483 | 80.837 | 77.873 | 79.688 | 218.954 | 112.095 |
| 32 | 5.536 | 4.988 | 6.197 | 4.558 | 9.988 | 7.191 |
| 33 | 27.738 | 21.610 | 17.811 | 23.739 | 32.185 | 20.663 |

TABLE 53-continued

Measured parameters in Sorghum accessions under normal conditions

| Line/Corr. ID | Line-1 | Line-2 | Line-3 | Line-4 | Line-5 | Line-6 |
|---|---|---|---|---|---|---|
| 34 | 89.400 | 65.667 | 88.167 | 74.000 | 84.000 | 71.500 |
| 35 | 126 | 107 | 115 | 107 | 107 | 92 |
| 36 | 182.125 | 104.563 | 143.792 | 99.010 | 173.550 | 170.063 |
| 37 | 2.865 | 1.852 | 2.551 | 1.653 | 3.124 | 2.733 |
| 38 | 72.075 | 91.721 | 79.533 | 86.664 | 74.009 | 90.557 |
| 39 | 47.804 | 49.275 | 44.667 | 49.080 | 41.689 | 47.181 |
| 40 | 47.650 | 35.422 | 45.782 | 42.122 | 41.449 | 33.393 |
| 41 | 80.187 | 170.318 | 54.259 | 76.900 | 51.450 | 163.058 |
| 42 | 670.381 | 1017.614 | 584.437 | 640.600 | 349.994 | 553.500 |
| 43 | 382.950 | 809.436 | 468.742 | 486.858 | 421.500 | 633.092 |
| 44 | NA | 1.238 | NA | NA | 2.109 | 1.230 |
| 45 | 2.047 | 1.767 | 2.363 | 1.834 | 1.730 | 1.859 |
| 46 | NA | 9.790 | NA | NA | 10.444 | 9.383 |
| 47 | 6.605 | 8.924 | 6.425 | 8.250 | 7.243 | 4.635 |
| 48 | NA | 42.625 | NA | NA | NA | 9.208 |
| 49 | 38.783 | 45.049 | 24.530 | 52.492 | 38.385 | 34.019 |
| 50 | 2352.483 | 2169.089 | 968.809 | 2452.559 | 1997.708 | 2767.520 |
| 51 | 8.226 | 8.978 | 7.113 | 7.125 | 6.815 | 10.421 |
| 52 | 8.742 | 7.459 | 6.985 | 7.677 | 7.833 | 10.072 |
| 53 | 0.1255 | 0.0503 | 0.1223 | 0.0760 | 0.0966 | 0.0619 |
| 54 | NA | 2.000 | NA | NA | NA | 1.063 |

Table 53: Provided are the values of each of the parameters (as described above) measured in Sorghum accessions (Line) under normal conditions. Growth conditions are specified in the experimental procedure section. "NA" = not available.

TABLE 54

Measured parameters in additional Sorghum accessions under normal growth conditions

| Line/Corr. ID | Line-7 | Line-8 | Line-9 | Line-10 | Line-11 | Line-12 |
|---|---|---|---|---|---|---|
| 1 | 80.617 | 75.681 | 80.171 | 79.658 | 65.915 | 89.644 |
| 2 | 0.584 | 0.544 | 0.208 | 0.484 | 0.351 | 0.574 |
| 3 | 0.076 | 0.022 | 0.018 | 0.129 | 0.096 | 0.424 |
| 4 | 18.470 | 18.457 | 23.479 | 25.937 | 24.294 | 20.366 |
| 5 | 85.403 | 138.989 | 70.043 | 78.551 | 152.012 | 145.250 |
| 6 | 5.453 | 6.371 | 4.479 | 4.573 | 7.408 | 6.316 |
| 7 | 21.298 | 30.863 | 19.174 | 21.016 | 27.845 | 29.966 |
| 8 | 0.8879 | 0.8842 | 0.8895 | 0.8974 | 0.8873 | 0.8982 |
| 9 | 0.117 | 0.121 | 0.122 | 0.129 | 0.123 | 0.125 |
| 10 | 13887.9 | 21509.8 | 13138.7 | 16910.0 | 18205.2 | 24801.2 |
| 11 | 32.051 | 49.629 | 38.998 | 54.808 | 55.265 | 64.740 |
| 12 | 0.309 | 0.409 | 0.343 | 0.360 | 0.314 | 0.318 |
| 13 | 10.235 | 27.607 | 31.563 | 25.847 | 21.326 | 74.493 |
| 14 | 0.249 | 0.271 | 0.284 | 0.315 | 0.216 | 0.325 |
| 15 | 0.477 | 0.554 | 0.538 | 0.502 | 0.471 | 0.478 |
| 16 | 1.372 | 1.081 | 2.200 | 1.523 | 1.168 | 1.015 |
| 17 | 0.0571 | 0.0621 | 0.0652 | 0.0724 | 0.0495 | 0.0746 |
| 18 | NA | NA | NA | NA | NA | 5.790 |
| 19 | 2008.9 | 2212.0 | 1495.5 | 1997.8 | 2692.1 | 2647.7 |
| 20 | 32.8562 | 33.0333 | 31.5844 | 32.4083 | 32.7021 | 32.7500 |
| 21 | 33.5694 | 33.8926 | 32.2764 | 32.9255 | 32.3765 | 33.3296 |
| 22 | 1.975 | 2.049 | 2.293 | 1.871 | 1.708 | 2.138 |
| 23 | 2.933 | 2.471 | 2.557 | 2.476 | 2.744 | 1.640 |
| 24 | 10.7072 | 10.8184 | 10.8381 | 10.8360 | 10.7013 | 10.5546 |
| 25 | 10.089 | 10.853 | 11.003 | 11.199 | 7.357 | 8.622 |
| 26 | 2.833 | 3.217 | 4.017 | 4.882 | 2.818 | 8.786 |
| 27 | 2.973 | 3.719 | 5.903 | 5.069 | 3.783 | 9.979 |
| 28 | 17.752 | 18.677 | 13.543 | 14.999 | 14.675 | 16.371 |
| 29 | 21.451 | 21.037 | 19.488 | 16.473 | 19.939 | 19.413 |
| 30 | 17.382 | 16.334 | 13.313 | 14.982 | 16.360 | 18.739 |
| 31 | 85.403 | 138.989 | 98.915 | 114.696 | 154.742 | 147.871 |
| 32 | 5.453 | 6.371 | 5.897 | 6.274 | 7.497 | 6.404 |
| 33 | 21.298 | 30.863 | 22.503 | 24.722 | 28.256 | 30.450 |
| 34 | 67.667 | 63.667 | 56.000 | 59.000 | 56.000 | 75.333 |
| 35 | 107 | 92 | 107 | 107 | 107 | 107 |
| 36 | 54.938 | 94.771 | 101.604 | 112.979 | 88.326 | 163.792 |
| 37 | 0.881 | 1.566 | 1.733 | 1.911 | 1.593 | 2.865 |
| 38 | 88.841 | 90.211 | 90.765 | 88.475 | 86.674 | 82.031 |
| 39 | 52.089 | 53.727 | 52.567 | 53.862 | 51.777 | 44.129 |
| 40 | 50.174 | 41.898 | 46.828 | 46.796 | 48.597 | 40.065 |
| 41 | 194.138 | 213.658 | 212.049 | 214.648 | 157.440 | 67.729 |

TABLE 54-continued

Measured parameters in additional Sorghum accessions under normal growth conditions

| Line/Corr. ID | Line-7 | Line-8 | Line-9 | Line-10 | Line-11 | Line-12 |
|---|---|---|---|---|---|---|
| 42 | 473.775 | 796.950 | 879.000 | 810.325 | 889.012 | 607.200 |
| 43 | 485.718 | 886.017 | 730.573 | 886.550 | 784.958 | 384.530 |
| 44 | 1.261 | 1.501 | 1.938 | 1.924 | 1.956 | NA |
| 45 | 1.756 | 1.747 | 1.788 | 1.663 | 1.868 | 1.674 |
| 46 | 10.215 | 9.687 | 9.981 | 10.737 | 10.326 | NA |
| 47 | 7.234 | 7.311 | 7.923 | 7.055 | 5.396 | 4.820 |
| 48 | 26.583 | 60.364 | 53.600 | 55.000 | 44.583 | NA |
| 49 | 28.808 | 59.663 | 51.983 | 54.794 | 45.548 | 48.496 |
| 50 | 1607.665 | 3510.662 | 2907.809 | 3639.453 | 3045.637 | 3301.794 |
| 51 | 9.430 | 9.537 | 8.043 | 8.853 | 7.913 | 8.071 |
| 52 | 8.417 | 8.607 | 8.513 | 9.187 | 9.136 | 9.311 |
| 53 | 0.0446 | 0.0446 | 0.0461 | 0.0626 | 0.0861 | 0.0991 |
| 54 | 1.125 | 1.438 | 1.000 | 1.750 | 1.000 | NA |

Table 54: Provided are the values of each of the parameters (as described above) measured in Sorghum accessions (Seed ID) under normal conditions. Growth conditions are specified in the experimental procedure section. "NA" = not available.

TABLE 55

Measured parameters in Sorghum accessions under drought growth conditions

| Line/Corr. ID | Line-1 | Line-2 | Line-3 | Line-4 | Line-5 | Line-6 |
|---|---|---|---|---|---|---|
| 1 | 86.887 | 61.338 | 75.023 | 77.781 | 75.524 | 80.375 |
| 2 | 0.371 | 0.728 | 0.407 | 0.695 | 0.425 | 0.878 |
| 3 | 0.286 | 0.424 | 0.256 | 0.478 | 0.366 | 0.394 |
| 4 | 24.160 | 19.803 | 14.209 | 14.639 | 25.540 | 20.829 |
| 5 | 72.386 | 93.839 | 30.770 | 55.311 | 131.242 | 76.546 |
| 6 | 4.272 | 5.395 | 3.511 | 3.722 | 6.999 | 5.270 |
| 7 | 22.325 | 24.388 | 12.159 | 19.926 | 27.603 | 18.164 |
| 8 | 0.8734 | 0.8718 | 0.8626 | 0.8754 | 0.8708 | 0.8866 |
| 9 | 0.1422 | 0.1143 | 0.0946 | 0.1115 | 0.1442 | 0.1309 |
| 10 | 6968 | 5452 | 3960 | 9839 | 6482 | 12403 |
| 11 | 23.833 | 13.673 | 6.991 | 18.234 | 20.717 | 34.426 |
| 12 | 0.135 | 0.158 | 0.065 | 0.187 | 0.255 | 0.291 |
| 13 | NA | 12.103 | 24.831 | 37.040 | 23.293 | 11.722 |
| 14 | 0.110 | 0.094 | 0.030 | 0.094 | 0.056 | 0.116 |
| 15 | 0.157 | 0.359 | 0.071 | 0.244 | 0.056 | 0.511 |
| 16 | NA | 2.017 | 1.000 | 1.041 | NA | 1.058 |
| 17 | 0.0227 | 0.0194 | 0.0063 | 0.0195 | 0.0115 | 0.0239 |
| 18 | 3.582 | NA | 2.642 | 3.428 | 2.805 | NA |
| 19 | 3308.1 | 1206.0 | 2464.6 | 1142.9 | 2116.3 | 1550.0 |
| 20 | 36.085 | 35.833 | 35.464 | 36.576 | 35.868 | 33.764 |
| 21 | 35.847 | 36.030 | 36.526 | 38.399 | 35.915 | 36.452 |
| 22 | 1.758 | 1.458 | 2.267 | 2.784 | 2.393 | 1.276 |
| 23 | 1.958 | 1.605 | 2.271 | 2.494 | 3.555 | 1.253 |
| 24 | 9.617 | 10.459 | 7.487 | 10.787 | 10.250 | 9.660 |
| 25 | 9.676 | 8.315 | 7.384 | 10.106 | 10.721 | 5.513 |
| 26 | 7.787 | 4.027 | 16.460 | 3.287 | 10.829 | 10.818 |
| 27 | 7.064 | 4.509 | 16.228 | 3.305 | 9.885 | 10.500 |
| 28 | 19.206 | 16.627 | 14.929 | 18.353 | 15.795 | 13.963 |
| 29 | 18.979 | 18.365 | 16.017 | 19.125 | 15.487 | 14.340 |
| 30 | 20.086 | 16.099 | 14.439 | 18.471 | 15.469 | 14.061 |
| 31 | 72.386 | 96.616 | 32.820 | 55.311 | 131.242 | 85.867 |
| 32 | 4.272 | 5.526 | 3.696 | 3.722 | 6.999 | 5.806 |
| 33 | 22.325 | 24.787 | 12.396 | 19.926 | 27.603 | 19.408 |
| 34 | 91.500 | 66.333 | 88.000 | 74.667 | 90.000 | 71.000 |
| 35 | 115.0 | 92.0 | 115.0 | 107.0 | 107.0 | 107.0 |
| 36 | 104.646 | 83.240 | 113.031 | 69.036 | 104.200 | 133.542 |
| 37 | 1.586 | 1.556 | 1.831 | 1.279 | 1.798 | 2.024 |
| 38 | 65.594 | 78.509 | 83.840 | 54.860 | 69.741 | 74.513 |
| 39 | 45.787 | 46.967 | 38.775 | 38.188 | 35.907 | 43.352 |
| 40 | 43.458 | 26.980 | 36.000 | 34.140 | 27.291 | 25.840 |
| 41 | 75.917 | 143.323 | 62.928 | 44.434 | 61.434 | 106.055 |
| 42 | 30.407 | 774.842 | 61.788 | 68.263 | 31.208 | 330.458 |
| 43 | 135.117 | 561.183 | 94.442 | 276.217 | 64.117 | 217.192 |
| 44 | NA | 1.436 | NA | NA | NA | 1.376 |
| 45 | 2.328 | 1.432 | 2.169 | 1.923 | 1.848 | 1.660 |
| 46 | 0.860 | 9.887 | NA | NA | NA | 8.097 |
| 47 | 9.451 | 5.717 | 7.258 | 8.602 | 6.533 | 3.604 |
| 48 | 25.000 | 40.000 | NA | NA | NA | 15.909 |
| 49 | 26.609 | 39.567 | 15.492 | 31.055 | 31.100 | 20.723 |

TABLE 55-continued

Measured parameters in Sorghum accessions under drought growth conditions

| Line/Corr. ID | Line-1 | Line-2 | Line-3 | Line-4 | Line-5 | Line-6 |
|---|---|---|---|---|---|---|
| 50 | 1288.2 | 2524.3 | 468.4 | 1128.6 | 1370.3 | 1724.9 |
| 51 | 10.083 | 9.422 | 6.421 | 6.773 | 7.809 | 9.702 |
| 52 | 7.788 | 8.919 | 5.873 | 6.628 | 7.453 | 10.203 |
| 53 | 0.0820 | 0.0392 | 0.0857 | 0.0623 | 0.0172 | 0.0475 |
| 54 | NA | 2.000 | NA | NA | NA | 1.000 |

Table 55: Provided are the values of each of the parameters (as described above) measured in Sorghum accessions (Seed ID) under drought conditions. Growth conditions are specified in the experimental procedure section.

TABLE 56

Measured parameters in additional Sorghum accessions under drought growth conditions

| Line/Corr. ID | Line-7 | Line-8 | Line-9 | Line-10 | Line-11 | Line-12 |
|---|---|---|---|---|---|---|
| 1 | 64.246 | 70.802 | 64.110 | 75.677 | 72.095 | 87.168 |
| 2 | 0.678 | 0.807 | 0.788 | 0.731 | 0.741 | 0.831 |
| 3 | 0.326 | 0.329 | 0.364 | 0.377 | 0.469 | 0.625 |
| 4 | 15.432 | 13.299 | 17.877 | 20.239 | 18.706 | 17.951 |
| 5 | 67.460 | 112.580 | 82.793 | 100.459 | 122.877 | 86.267 |
| 6 | 4.570 | 4.959 | 4.994 | 5.560 | 7.292 | 4.721 |
| 7 | 19.614 | 30.763 | 20.985 | 23.992 | 24.820 | 24.418 |
| 8 | 0.8898 | 0.8835 | 0.8952 | 0.8974 | 0.8989 | 0.8889 |
| 9 | 0.1094 | 0.1019 | 0.1067 | 0.1162 | 0.1112 | 0.1205 |
| 10 | 9980 | 17494 | 14526 | 15729 | 10949 | 13808 |
| 11 | 19.098 | 29.216 | 31.744 | 40.213 | 25.228 | 29.520 |
| 12 | 0.235 | 0.325 | 0.335 | 0.342 | 0.222 | 0.223 |
| 13 | 9.324 | 19.286 | 33.147 | 27.315 | 24.680 | 50.380 |
| 14 | 0.127 | 0.171 | 0.203 | 0.244 | 0.160 | 0.151 |
| 15 | 0.445 | 0.480 | 0.544 | 0.524 | 0.462 | 0.348 |
| 16 | 1.139 | 1.002 | 1.181 | 1.113 | 1.294 | 0.851 |
| 17 | 0.0262 | 0.0353 | 0.0420 | 0.0503 | 0.0330 | 0.0312 |
| 18 | NA | NA | NA | NA | NA | 3.941 |
| 19 | 1476.2 | 1773.1 | 1052.7 | 1408.5 | 417.2 | 1247.1 |
| 20 | 37.469 | 41.242 | 36.471 | 36.994 | 36.767 | 35.942 |
| 21 | 36.248 | 36.507 | 35.011 | 36.304 | 35.798 | 36.509 |
| 22 | 1.748 | 1.691 | 2.375 | 1.615 | 1.516 | 2.031 |
| 23 | 2.381 | 1.705 | 1.660 | 1.641 | 2.362 | 1.598 |
| 24 | 10.872 | 10.357 | 11.277 | 10.702 | 10.715 | 9.678 |
| 25 | 7.507 | 7.544 | 8.754 | 8.340 | 4.525 | 7.762 |
| 26 | 2.818 | 4.038 | 4.750 | 4.725 | 3.292 | 7.664 |
| 27 | 3.115 | 4.123 | 4.313 | 5.742 | 3.530 | 5.896 |
| 28 | 17.195 | 14.904 | 13.322 | 14.525 | 13.772 | 17.270 |
| 29 | 17.228 | 20.037 | 15.979 | 16.879 | 16.951 | 19.561 |
| 30 | 17.001 | 16.372 | 13.722 | 14.666 | 14.041 | 19.479 |
| 31 | 68.685 | 114.581 | 94.240 | 104.215 | 125.804 | 87.375 |
| 32 | 4.624 | 5.019 | 5.571 | 5.702 | 7.385 | 4.774 |
| 33 | 19.901 | 31.121 | 22.157 | 24.362 | 25.333 | 24.757 |
| 34 | 68.333 | 63.000 | 56.000 | 59.667 | 56.000 | 76.667 |
| 35 | 92.0 | 92.0 | 92.0 | 92.0 | 92.0 | 107.0 |
| 36 | 47.823 | 80.917 | 93.427 | 104.146 | 75.804 | 105.625 |
| 37 | 0.924 | 1.441 | 1.598 | 1.869 | 1.328 | 1.895 |
| 38 | 71.703 | 66.866 | 68.615 | 68.248 | 70.701 | 76.334 |
| 39 | 47.579 | 44.665 | 51.921 | 48.835 | 40.021 | 37.598 |
| 40 | 42.919 | 30.929 | 43.686 | 37.805 | 38.415 | 32.486 |
| 41 | 128.668 | 132.895 | 138.516 | 133.257 | 78.293 | 47.343 |
| 42 | 387.650 | 582.067 | 985.592 | 834.958 | 753.417 | 54.162 |
| 43 | 81.209 | 129.775 | 241.650 | 322.917 | 257.033 | 127.167 |
| 44 | 1.471 | 1.806 | 2.118 | 1.792 | 2.073 | NA |
| 45 | 1.550 | 1.654 | 1.621 | 1.634 | 1.712 | 1.759 |
| 46 | 10.693 | 10.122 | 10.486 | 10.012 | 10.557 | NA |
| 47 | 4.609 | 5.182 | 5.392 | 5.399 | 2.975 | 5.529 |
| 48 | 25.773 | 50.091 | 46.845 | 46.875 | 44.250 | NA |
| 49 | 24.072 | 48.602 | 48.781 | 48.731 | 38.213 | 26.050 |
| 50 | 1507.8 | 2865.3 | 2857.9 | 2956.0 | 1964.3 | 1288.5 |
| 51 | 9.066 | 7.925 | 8.170 | 8.543 | 7.672 | 7.365 |
| 52 | 8.878 | 8.605 | 8.586 | 8.727 | 8.126 | 7.850 |
| 53 | 0.0378 | 0.0328 | 0.0326 | 0.0435 | 0.0613 | 0.0761 |
| 54 | 1.250 | 1.688 | 1.125 | 1.750 | 1.375 | NA |

Table 56: Provided are the values of each of the parameters (as described above) measured in Sorghum accessions (Seed ID) under drought conditions. Growth conditions are specified in the experimental procedure section.

TABLE 57

Correlation between the expression level of selected genes of some embodiments of the invention in various tissues and the phenotypic performance under normal conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY14 | 0.79 | 3.45E−02 | 2 | 51 | LBY14 | 0.72 | 1.09E−01 | 2 | 16 |
| LBY14 | 0.72 | 1.21E−02 | 5 | 17 | LBY14 | 0.72 | 1.21E−02 | 5 | 14 |
| LBY14 | 0.79 | 7.04E−03 | 4 | 52 | LBY14 | 0.81 | 2.75E−03 | 3 | 51 |
| LBY14 | 0.73 | 1.00E−02 | 3 | 38 | LBY14 | 0.84 | 1.73E−02 | 1 | 45 |
| LBY148 | 0.73 | 6.17E−02 | 2 | 9 | LBY148 | 0.84 | 1.81E−02 | 2 | 45 |
| LBY148 | 0.70 | 1.18E−01 | 5 | 54 | LBY148 | 0.74 | 9.43E−03 | 5 | 42 |
| LBY148 | 0.77 | 9.16E−03 | 6 | 45 | LBY148 | 0.83 | 2.82E−03 | 4 | 4 |
| LBY148 | 0.77 | 9.25E−03 | 4 | 32 | LBY148 | 0.80 | 5.26E−03 | 4 | 9 |
| LBY148 | 0.72 | 1.23E−02 | 3 | 2 | LBY148 | 0.73 | 6.24E−02 | 1 | 4 |
| LBY148 | 0.84 | 1.89E−02 | 1 | 9 | LBY148 | 0.84 | 1.94E−02 | 1 | 45 |
| LBY148 | 0.73 | 6.03E−02 | 1 | 34 | LBY149 | 0.83 | 2.09E−02 | 2 | 15 |
| LBY149 | 0.80 | 3.08E−02 | 2 | 51 | LBY149 | 0.83 | 2.09E−02 | 2 | 12 |
| LBY149 | 0.84 | 1.70E−02 | 2 | 38 | LBY149 | 0.79 | 3.43E−02 | 2 | 43 |
| LBY149 | 0.90 | 5.93E−03 | 2 | 41 | LBY149 | 0.81 | 2.58E−02 | 2 | 39 |
| LBY149 | 0.84 | 2.23E−03 | 6 | 6 | LBY149 | 0.75 | 1.26E−02 | 6 | 31 |
| LBY149 | 0.72 | 1.94E−02 | 6 | 39 | LBY149 | 0.77 | 8.48E−03 | 6 | 32 |
| LBY149 | 0.82 | 4.60E−02 | 6 | 54 | LBY149 | 0.78 | 8.19E−03 | 6 | 5 |
| LBY149 | 0.71 | 2.06E−02 | 4 | 12 | LBY149 | 0.80 | 5.32E−03 | 4 | 32 |
| LBY149 | 0.81 | 2.70E−02 | 1 | 43 | LBY149 | 0.79 | 6.40E−02 | 1 | 16 |
| LBY149 | 0.91 | 4.03E−03 | 1 | 41 | LBY149 | 0.96 | 6.80E−04 | 1 | 39 |
| LBY150 | 0.76 | 4.76E−02 | 2 | 4 | LBY150 | 0.73 | 1.76E−02 | 4 | 51 |
| LBY150 | 0.75 | 5.00E−02 | 1 | 22 | LBY150 | 0.83 | 2.00E−02 | 1 | 49 |
| LBY151 | 0.71 | 2.22E−02 | 6 | 6 | LBY151 | 0.93 | 6.40E−03 | 4 | 54 |
| LBY151 | 0.75 | 7.89E−03 | 3 | 43 | LBY151 | 0.81 | 5.10E−02 | 3 | 48 |
| LBY151 | 0.77 | 5.55E−03 | 3 | 49 | LBY151 | 0.78 | 3.97E−02 | 1 | 6 |
| LBY151 | 0.92 | 3.41E−03 | 1 | 37 | LBY151 | 0.81 | 2.84E−02 | 1 | 7 |
| LBY151 | 0.78 | 4.06E−02 | 1 | 27 | LBY151 | 0.71 | 7.40E−02 | 1 | 31 |
| LBY151 | 0.70 | 7.73E−02 | 1 | 33 | LBY151 | 0.90 | 5.80E−03 | 1 | 3 |
| LBY151 | 0.86 | 1.20E−02 | 1 | 53 | LBY151 | 0.86 | 1.40E−02 | 1 | 9 |
| LBY151 | 0.87 | 1.02E−02 | 1 | 26 | LBY151 | 0.78 | 3.82E−02 | 1 | 1 |
| LBY151 | 0.81 | 2.58E−02 | 1 | 5 | LBY151 | 0.97 | 3.58E−04 | 1 | 34 |
| LBY151 | 0.90 | 6.47E−03 | 1 | 36 | LBY152 | 0.71 | 7.12E−02 | 2 | 10 |
| LBY152 | 0.75 | 5.14E−02 | 2 | 52 | LBY152 | 0.72 | 6.67E−02 | 2 | 11 |
| LBY152 | 0.73 | 1.75E−02 | 5 | 16 | LBY152 | 0.84 | 1.11E−03 | 5 | 42 |
| LBY152 | 0.73 | 1.63E−02 | 4 | 43 | LBY152 | 0.71 | 1.16E−01 | 4 | 54 |
| LBY152 | 0.78 | 6.47E−02 | 4 | 48 | LBY152 | 0.74 | 1.48E−02 | 4 | 49 |
| LBY152 | 0.82 | 1.99E−03 | 3 | 38 | LBY152 | 0.74 | 9.12E−03 | 3 | 43 |
| LBY152 | 0.73 | 9.73E−03 | 3 | 48 | LBY152 | 0.74 | 9.25E−03 | 3 | 49 |
| LBY152 | 0.75 | 8.01E−03 | 3 | 42 | LBY152 | 0.81 | 2.81E−02 | 1 | 28 |
| LBY152 | 0.77 | 4.11E−02 | 1 | 51 | LBY152 | 0.72 | 6.85E−02 | 1 | 45 |
| LBY152 | 0.83 | 2.14E−02 | 1 | 19 | LBY153 | 0.79 | 3.46E−02 | 2 | 20 |
| LBY153 | 0.75 | 5.15E−02 | 2 | 13 | LBY153 | 0.81 | 2.60E−03 | 5 | 51 |
| LBY153 | 0.72 | 1.18E−02 | 5 | 41 | LBY153 | 0.71 | 2.13E−02 | 6 | 45 |
| LBY153 | 0.74 | 9.69E−03 | 3 | 19 | LBY153 | 0.74 | 9.41E−03 | 3 | 30 |
| LBY153 | 0.71 | 7.40E−02 | 1 | 29 | LBY153 | 0.77 | 4.27E−02 | 1 | 40 |
| LBY153 | 0.73 | 6.24E−02 | 1 | 49 | LBY153 | 0.80 | 2.97E−02 | 1 | 35 |
| LBY154 | 0.80 | 3.07E−02 | 2 | 53 | LBY154 | 0.70 | 7.95E−02 | 2 | 9 |
| LBY154 | 0.92 | 3.33E−03 | 2 | 45 | LBY154 | 0.75 | 5.21E−02 | 2 | 1 |
| LBY154 | 0.83 | 2.20E−02 | 2 | 34 | LBY154 | 0.84 | 1.71E−02 | 2 | 35 |
| LBY154 | 0.70 | 1.57E−02 | 5 | 7 | LBY154 | 0.82 | 4.44E−02 | 6 | 54 |
| LBY154 | 0.77 | 4.28E−02 | 1 | 4 | LBY154 | 0.76 | 4.63E−02 | 1 | 53 |
| LBY154 | 0.84 | 1.72E−02 | 1 | 9 | LBY154 | 0.81 | 2.65E−02 | 1 | 45 |
| LBY154 | 0.75 | 5.01E−02 | 1 | 1 | LBY154 | 0.72 | 6.64E−02 | 1 | 34 |
| LBY155 | 0.78 | 3.65E−02 | 2 | 4 | LBY155 | 0.81 | 2.60E−02 | 2 | 37 |
| LBY155 | 0.78 | 3.78E−02 | 2 | 53 | LBY155 | 0.73 | 6.21E−02 | 2 | 9 |
| LBY155 | 0.82 | 2.44E−02 | 2 | 36 | LBY155 | 0.82 | 3.75E−03 | 6 | 51 |
| LBY155 | 0.74 | 1.52E−02 | 6 | 41 | LBY155 | 0.73 | 1.72E−02 | 4 | 51 |
| LBY155 | 0.74 | 1.36E−02 | 4 | 43 | LBY155 | 0.77 | 9.82E−03 | 4 | 41 |
| LBY155 | 0.72 | 6.56E−02 | 1 | 51 | LBY155 | 0.72 | 6.80E−02 | 2 | 9 |
| LBY156 | 0.75 | 5.15E−02 | 2 | 45 | LBY156 | 0.72 | 2.75E−02 | 6 | 16 |
| LBY156 | 0.76 | 6.94E−03 | 3 | 8 | LBY156 | 0.72 | 1.21E−02 | 3 | 10 |
| LBY156 | 0.73 | 1.06E−02 | 3 | 15 | LBY156 | 0.77 | 5.78E−03 | 3 | 51 |
| LBY156 | 0.74 | 8.75E−03 | 3 | 52 | LBY156 | 0.82 | 2.24E−03 | 3 | 12 |
| LBY156 | 0.82 | 1.85E−03 | 3 | 50 | LBY156 | 0.81 | 2.65E−03 | 3 | 17 |
| LBY156 | 0.81 | 2.65E−03 | 3 | 14 | LBY156 | 0.77 | 5.73E−03 | 3 | 11 |
| LBY156 | 0.77 | 4.30E−02 | 1 | 9 | LBY157 | 0.79 | 3.57E−02 | 2 | 51 |
| LBY157 | 0.83 | 1.51E−03 | 5 | 25 | LBY157 | 0.74 | 9.31E−03 | 5 | 54 |
| LBY157 | 0.95 | 3.83E−03 | 5 | 48 | LBY157 | 0.73 | 1.66E−02 | 4 | 39 |
| LBY157 | 0.74 | 9.24E−02 | 3 | 54 | LBY157 | 0.75 | 5.32E−02 | 1 | 28 |
| LBY157 | 0.84 | 1.72E−02 | 1 | 45 | LBY157 | 0.77 | 4.25E−02 | 1 | 35 |
| LBY158 | 0.79 | 3.57E−02 | 2 | 37 | LBY158 | 0.73 | 6.12E−02 | 2 | 27 |
| LBY158 | 0.76 | 4.82E−02 | 2 | 3 | LBY158 | 0.87 | 1.01E−02 | 2 | 53 |

TABLE 57-continued

Correlation between the expression level of selected genes of some embodiments of the invention in various tissues and the phenotypic performance under normal conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY158 | 0.77 | 4.26E−02 | 2 | 9 | LBY158 | 0.73 | 6.48E−02 | 2 | 26 |
| LBY158 | 0.79 | 3.30E−02 | 2 | 45 | LBY158 | 0.91 | 5.07E−03 | 2 | 1 |
| LBY158 | 0.91 | 4.37E−03 | 2 | 34 | LBY158 | 0.85 | 1.63E−02 | 2 | 36 |
| LBY158 | 0.76 | 7.10E−03 | 5 | 26 | LBY158 | 0.84 | 1.34E−03 | 5 | 45 |
| LBY158 | 0.74 | 1.38E−02 | 6 | 35 | LBY158 | 0.75 | 1.17E−02 | 4 | 28 |
| LBY158 | 0.82 | 3.80E−03 | 4 | 45 | LBY158 | 0.70 | 2.29E−02 | 4 | 35 |
| LBY158 | 0.73 | 6.29E−02 | 1 | 37 | LBY158 | 0.73 | 6.10E−02 | 1 | 7 |
| LBY158 | 0.80 | 3.08E−02 | 1 | 3 | LBY158 | 0.85 | 1.43E−02 | 1 | 53 |
| LBY158 | 0.84 | 1.87E−02 | 1 | 9 | LBY158 | 0.78 | 3.96E−02 | 1 | 1 |
| LBY158 | 0.89 | 7.84E−03 | 1 | 34 | LBY158 | 0.74 | 5.48E−02 | 1 | 36 |
| LBY159 | 0.78 | 6.79E−02 | 5 | 54 | LBY159 | 0.79 | 6.84E−03 | 4 | 29 |
| LBY159 | 0.92 | 2.86E−03 | 1 | 28 | LBY159 | 0.79 | 3.41E−02 | 1 | 45 |
| LBY159 | 0.76 | 4.70E−02 | 1 | 35 | LBY160 | 0.88 | 1.98E−02 | 5 | 48 |
| LBY160 | 0.91 | 2.08E−04 | 4 | 8 | LBY160 | 0.81 | 4.58E−03 | 4 | 15 |
| LBY160 | 0.85 | 1.72E−03 | 4 | 12 | LBY160 | 0.81 | 4.41E−03 | 4 | 17 |
| LBY160 | 0.81 | 4.41E−03 | 4 | 14 | LBY160 | 0.73 | 1.08E−02 | 3 | 8 |
| LBY160 | 0.73 | 1.14E−02 | 3 | 51 | LBY160 | 0.72 | 1.33E−02 | 3 | 52 |
| LBY160 | 0.73 | 6.32E−02 | 1 | 51 | LBY160 | 0.82 | 2.42E−02 | 1 | 21 |
| LBY161 | 0.72 | 6.60E−02 | 2 | 8 | LBY161 | 0.84 | 1.81E−02 | 2 | 10 |
| LBY161 | 0.81 | 2.58E−02 | 2 | 50 | LBY161 | 0.81 | 2.63E−02 | 2 | 17 |
| LBY161 | 0.81 | 2.63E−02 | 2 | 14 | LBY161 | 0.74 | 5.93E−02 | 2 | 11 |
| LBY161 | 0.73 | 6.38E−02 | 2 | 13 | LBY161 | 0.71 | 7.60E−02 | 2 | 49 |
| LBY161 | 0.89 | 7.83E−03 | 2 | 19 | LBY161 | 0.71 | 7.38E−02 | 2 | 42 |
| LBY161 | 0.79 | 3.80E−03 | 5 | 50 | LBY161 | 0.79 | 6.38E−02 | 5 | 48 |
| LBY161 | 0.85 | 1.00E−03 | 5 | 49 | LBY161 | 0.74 | 1.50E−02 | 6 | 50 |
| LBY161 | 0.78 | 5.06E−03 | 3 | 10 | LBY161 | 0.81 | 2.39E−03 | 3 | 50 |
| LBY161 | 0.79 | 3.97E−03 | 3 | 17 | LBY161 | 0.79 | 3.97E−03 | 3 | 14 |
| LBY161 | 0.75 | 8.35E−03 | 3 | 11 | LBY161 | 0.79 | 3.62E−02 | 1 | 8 |
| LBY161 | 0.74 | 5.73E−02 | 1 | 10 | LBY161 | 0.82 | 2.41E−02 | 1 | 17 |
| LBY161 | 0.82 | 2.41E−02 | 1 | 14 | LBY161 | 0.85 | 1.46E−02 | 1 | 19 |
| LBY162 | 0.85 | 1.56E−02 | 2 | 21 | LBY162 | 0.82 | 2.49E−02 | 2 | 9 |
| LBY162 | 0.90 | 6.36E−03 | 2 | 45 | LBY162 | 0.76 | 6.16E−03 | 5 | 25 |
| LBY162 | 0.70 | 7.76E−02 | 5 | 44 | LBY162 | 0.88 | 2.14E−02 | 5 | 54 |
| LBY162 | 0.91 | 1.21E−02 | 5 | 48 | LBY162 | 0.72 | 1.27E−02 | 5 | 49 |
| LBY162 | 0.73 | 1.03E−02 | 5 | 42 | LBY162 | 0.88 | 7.46E−04 | 6 | 6 |
| LBY162 | 0.83 | 2.81E−03 | 6 | 31 | LBY162 | 0.88 | 8.20E−04 | 6 | 32 |
| LBY162 | 0.82 | 3.57E−03 | 6 | 5 | LBY162 | 0.83 | 5.69E−03 | 4 | 16 |
| LBY162 | 0.74 | 1.40E−02 | 4 | 39 | LBY162 | 0.78 | 6.64E−03 | 4 | 54 |
| LBY162 | 0.80 | 5.39E−02 | 4 | 48 | LBY162 | 0.73 | 1.62E−02 | 4 | 42 |
| LBY162 | 0.77 | 5.57E−03 | 3 | 38 | LBY162 | 0.75 | 7.29E−03 | 3 | 41 |
| LBY162 | 0.70 | 1.55E−02 | 3 | 39 | LBY162 | 0.72 | 1.32E−02 | 3 | 45 |
| LBY162 | 0.78 | 4.29E−03 | 3 | 42 | LBY162 | 0.71 | 7.61E−02 | 1 | 4 |
| LBY162 | 0.72 | 6.91E−02 | 1 | 28 | LBY162 | 0.78 | 3.67E−02 | 1 | 53 |
| LBY162 | 0.90 | 6.08E−03 | 1 | 9 | LBY162 | 0.81 | 2.75E−02 | 1 | 45 |
| LBY162 | 0.81 | 2.60E−02 | 1 | 34 | LBY162 | 0.86 | 1.27E−02 | 1 | 35 |
| LBY162 | 0.81 | 2.76E−02 | 1 | 36 | LBY163 | 0.73 | 6.25E−02 | 2 | 8 |
| LBY163 | 0.80 | 3.06E−02 | 2 | 10 | LBY163 | 0.88 | 8.62E−03 | 2 | 22 |
| LBY163 | 0.84 | 1.85E−02 | 5 | 44 | LBY163 | 0.96 | 2.33E−03 | 5 | 48 |
| LBY163 | 0.76 | 8.10E−02 | 6 | 54 | LBY163 | 0.77 | 5.58E−03 | 3 | 50 |
| LBY163 | 0.94 | 5.88E−03 | 3 | 48 | LBY163 | 0.86 | 7.81E−04 | 3 | 49 |
| LBY163 | 0.74 | 5.82E−02 | 1 | 4 | LBY163 | 0.75 | 5.36E−02 | 1 | 6 |
| LBY163 | 0.81 | 2.67E−02 | 1 | 37 | LBY163 | 0.73 | 6.38E−02 | 1 | 27 |
| LBY163 | 0.72 | 7.01E−02 | 1 | 31 | LBY163 | 0.76 | 4.92E−02 | 1 | 3 |
| LBY163 | 0.76 | 4.88E−02 | 1 | 53 | LBY163 | 0.92 | 3.71E−03 | 1 | 9 |
| LBY163 | 0.81 | 2.56E−02 | 1 | 26 | LBY163 | 0.86 | 1.32E−02 | 1 | 1 |
| LBY163 | 0.75 | 5.01E−02 | 1 | 5 | LBY163 | 0.84 | 1.67E−02 | 1 | 34 |
| LBY163 | 0.81 | 2.68E−02 | 1 | 36 | LBY164 | 0.79 | 3.34E−02 | 2 | 10 |
| LBY164 | 0.93 | 2.48E−03 | 2 | 13 | LBY164 | 0.78 | 7.35E−03 | 4 | 47 |
| LBY164 | 0.72 | 1.08E−01 | 4 | 54 | LBY164 | 0.76 | 8.26E−03 | 4 | 48 |
| LBY164 | 0.73 | 1.63E−02 | 4 | 49 | LBY164 | 0.90 | 3.42E−04 | 4 | 42 |
| LBY164 | 0.79 | 4.01E−03 | 3 | 45 | LBY164 | 0.85 | 1.67E−02 | 1 | 13 |
| LBY165 | 0.83 | 2.14E−02 | 2 | 37 | LBY165 | 0.90 | 5.61E−03 | 2 | 27 |
| LBY165 | 0.79 | 3.28E−02 | 2 | 31 | LBY165 | 0.72 | 6.87E−02 | 2 | 33 |
| LBY165 | 0.94 | 1.75E−03 | 2 | 3 | LBY165 | 0.78 | 3.89E−02 | 2 | 53 |
| LBY165 | 0.87 | 1.06E−02 | 2 | 26 | LBY165 | 0.81 | 2.58E−02 | 2 | 13 |
| LBY165 | 0.79 | 3.57E−02 | 2 | 1 | LBY165 | 0.78 | 3.66E−02 | 2 | 5 |
| LBY165 | 0.74 | 5.53E−02 | 2 | 36 | LBY165 | 0.70 | 1.63E−02 | 5 | 50 |
| LBY165 | 0.80 | 5.60E−02 | 5 | 48 | LBY165 | 0.82 | 2.03E−03 | 5 | 49 |
| LBY165 | 0.74 | 9.17E−02 | 6 | 54 | LBY165 | 0.79 | 6.38E−03 | 4 | 15 |
| LBY165 | 0.70 | 2.35E−02 | 4 | 52 | LBY165 | 0.71 | 2.12E−02 | 4 | 12 |
| LBY165 | 0.85 | 1.78E−03 | 4 | 43 | LBY165 | 0.90 | 1.57E−02 | 4 | 54 |
| LBY165 | 0.84 | 2.31E−03 | 4 | 42 | LBY165 | 0.86 | 5.95E−04 | 3 | 15 |

TABLE 57-continued

Correlation between the expression level of selected genes of some embodiments of the invention in various tissues and the phenotypic performance under normal conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY165 | 0.74 | 8.72E−03 | 3 | 12 | LBY165 | 0.76 | 7.01E−03 | 3 | 50 |
| LBY165 | 0.77 | 6.06E−03 | 3 | 17 | LBY165 | 0.77 | 6.06E−03 | 3 | 14 |
| LBY165 | 0.77 | 4.35E−02 | 1 | 21 | LBY165 | 0.73 | 6.18E−02 | 1 | 2 |
| LBY166 | 0.72 | 6.53E−02 | 2 | 25 | LBY166 | 0.76 | 4.53E−02 | 2 | 47 |
| LBY166 | 0.80 | 3.26E−02 | 2 | 20 | LBY166 | 0.73 | 1.10E−02 | 3 | 10 |
| LBY166 | 0.81 | 2.29E−03 | 3 | 13 | LBY166 | 0.79 | 3.41E−02 | 1 | 22 |
| LBY166 | 0.78 | 3.69E−02 | 1 | 49 | LBY167 | 0.78 | 3.86E−02 | 2 | 53 |
| LBY167 | 0.76 | 4.67E−02 | 2 | 1 | LBY167 | 0.71 | 7.30E−02 | 2 | 36 |
| LBY167 | 0.87 | 1.15E−03 | 6 | 45 | LBY167 | 0.84 | 2.45E−03 | 4 | 45 |
| LBY167 | 0.78 | 5.01E−03 | 3 | 27 | LBY167 | 0.85 | 9.04E−04 | 3 | 26 |
| LBY167 | 0.75 | 8.05E−03 | 3 | 45 | LBY167 | 0.71 | 7.21E−02 | 1 | 20 |
| LBY167 | 0.72 | 6.98E−02 | 1 | 53 | LBY167 | 0.75 | 5.32E−02 | 1 | 40 |
| LBY167 | 0.92 | 3.22E−03 | 1 | 35 | LBY167 | 0.77 | 4.48E−02 | 2 | 25 |
| LBY168 | 0.86 | 1.25E−02 | 2 | 15 | LBY168 | 0.84 | 1.77E−02 | 2 | 51 |
| LBY168 | 0.84 | 1.81E−02 | 2 | 12 | LBY168 | 0.89 | 7.57E−03 | 2 | 38 |
| LBY168 | 0.82 | 2.43E−02 | 2 | 43 | LBY168 | 0.91 | 4.63E−03 | 2 | 41 |
| LBY168 | 0.85 | 1.43E−02 | 2 | 39 | LBY168 | 0.91 | 4.06E−03 | 2 | 49 |
| LBY168 | 0.91 | 1.24E−02 | 5 | 48 | LBY168 | 0.72 | 1.17E−02 | 5 | 45 |
| LBY168 | 0.80 | 5.29E−03 | 6 | 8 | LBY168 | 0.74 | 1.53E−02 | 6 | 10 |
| LBY168 | 0.95 | 1.17E−03 | 6 | 46 | LBY168 | 0.71 | 2.11E−02 | 6 | 50 |
| LBY168 | 0.71 | 2.12E−02 | 6 | 17 | LBY168 | 0.83 | 5.83E−03 | 6 | 16 |
| LBY168 | 0.71 | 2.12E−02 | 6 | 14 | LBY168 | 0.71 | 2.21E−02 | 4 | 15 |
| LBY168 | 0.75 | 1.20E−02 | 4 | 43 | LBY168 | 0.71 | 2.12E−02 | 4 | 41 |
| LBY168 | 0.82 | 4.70E−02 | 4 | 54 | LBY168 | 0.73 | 1.76E−02 | 4 | 9 |
| LBY168 | 0.74 | 9.26E−02 | 4 | 48 | LBY168 | 0.91 | 2.82E−04 | 4 | 42 |
| LBY168 | 0.74 | 5.69E−02 | 1 | 52 | LBY168 | 0.81 | 2.62E−02 | 1 | 22 |
| LBY168 | 0.70 | 7.84E−02 | 1 | 17 | LBY168 | 0.70 | 7.84E−02 | 1 | 14 |
| LBY168 | 0.74 | 5.60E−02 | 1 | 11 | LBY168 | 0.74 | 5.97E−02 | 1 | 40 |
| LBY168 | 0.87 | 1.14E−02 | 1 | 13 | LBY170 | 0.83 | 4.31E−02 | 2 | 16 |
| LBY170 | 0.89 | 6.78E−03 | 2 | 45 | LBY170 | 0.89 | 1.80E−03 | 5 | 48 |
| LBY170 | 0.73 | 6.33E−02 | 1 | 45 | LBY171 | 0.71 | 7.55E−02 | 2 | 53 |
| LBY171 | 0.73 | 6.33E−02 | 2 | 9 | LBY171 | 0.74 | 5.54E−02 | 2 | 45 |
| LBY171 | 0.79 | 3.33E−02 | 2 | 19 | LBY171 | 0.83 | 2.17E−02 | 2 | 34 |
| LBY171 | 0.85 | 3.15E−02 | 5 | 54 | LBY171 | 0.91 | 1.20E−02 | 6 | 48 |
| LBY171 | 0.83 | 3.20E−03 | 6 | 45 | LBY171 | 0.80 | 5.68E−03 | 4 | 6 |
| LBY171 | 0.70 | 2.33E−02 | 4 | 27 | LBY171 | 0.79 | 6.29E−03 | 4 | 31 |
| LBY171 | 0.79 | 7.12E−03 | 4 | 32 | LBY171 | 0.86 | 1.27E−03 | 4 | 3 |
| LBY171 | 0.79 | 6.66E−03 | 4 | 53 | LBY171 | 0.82 | 3.97E−03 | 4 | 26 |
| LBY171 | 0.79 | 6.41E−03 | 4 | 1 | LBY171 | 0.79 | 6.37E−03 | 4 | 34 |
| LBY171 | 0.78 | 8.24E−03 | 4 | 5 | LBY171 | 0.77 | 5.58E−03 | 3 | 3 |
| LBY171 | 0.83 | 1.63E−03 | 3 | 53 | LBY171 | 0.78 | 4.48E−03 | 3 | 26 |
| LBY171 | 0.92 | 4.61E−05 | 3 | 1 | LBY171 | 0.89 | 2.19E−04 | 3 | 34 |
| LBY171 | 0.79 | 3.28E−02 | 1 | 28 | LBY171 | 0.89 | 7.21E−03 | 1 | 53 |
| LBY171 | 0.78 | 4.03E−02 | 1 | 45 | LBY171 | 0.70 | 7.71E−02 | 1 | 1 |
| LBY171 | 0.82 | 2.47E−02 | 1 | 34 | LBY171 | 0.84 | 1.91E−02 | 1 | 35 |
| LBY171 | 0.74 | 5.82E−02 | 1 | 30 | LBY173 | 0.79 | 3.50E−02 | 2 | 10 |
| LBY173 | 0.73 | 6.26E−02 | 2 | 37 | LBY173 | 0.74 | 5.71E−02 | 2 | 3 |
| LBY173 | 0.89 | 7.12E−03 | 2 | 53 | LBY173 | 0.73 | 6.41E−02 | 2 | 13 |
| LBY173 | 0.74 | 5.50E−02 | 2 | 45 | LBY173 | 0.87 | 1.13E−02 | 2 | 1 |
| LBY173 | 0.78 | 3.66E−02 | 2 | 19 | LBY173 | 0.91 | 4.39E−03 | 2 | 34 |
| LBY173 | 0.79 | 3.44E−02 | 2 | 36 | LBY173 | 0.74 | 9.45E−03 | 5 | 3 |
| LBY173 | 0.75 | 8.59E−02 | 5 | 54 | LBY173 | 0.81 | 2.69E−03 | 5 | 13 |
| LBY173 | 0.73 | 6.22E−02 | 6 | 46 | LBY173 | 0.75 | 5.23E−02 | 6 | 44 |
| LBY173 | 0.92 | 1.28E−04 | 6 | 13 | LBY173 | 0.70 | 2.39E−02 | 6 | 19 |
| LBY173 | 0.80 | 5.24E−03 | 4 | 10 | LBY173 | 0.92 | 9.67E−03 | 4 | 54 |
| LBY173 | 0.73 | 1.66E−02 | 4 | 11 | LBY173 | 0.74 | 8.96E−03 | 3 | 27 |
| LBY173 | 0.91 | 4.82E−03 | 3 | 44 | LBY173 | 0.82 | 2.11E−03 | 3 | 26 |
| LBY173 | 0.84 | 1.11E−03 | 3 | 45 | LBY173 | 0.70 | 7.88E−02 | 1 | 10 |
| LBY173 | 0.83 | 2.05E−02 | 1 | 53 | LBY173 | 0.86 | 1.38E−02 | 1 | 13 |
| LBY173 | 0.90 | 6.35E−03 | 1 | 1 | LBY173 | 0.72 | 6.53E−02 | 1 | 34 |
| LBY174 | 0.84 | 1.77E−02 | 2 | 9 | LBY174 | 0.85 | 1.58E−02 | 5 | 44 |
| LBY174 | 0.79 | 4.08E−03 | 5 | 13 | LBY174 | 0.93 | 7.24E−03 | 5 | 48 |
| LBY175 | 0.78 | 3.77E−02 | 2 | 25 | LBY175 | 0.72 | 6.76E−02 | 2 | 47 |
| LBY175 | 0.71 | 7.52E−02 | 1 | 25 | LBY175 | 0.87 | 1.06E−02 | 1 | 47 |
| LBY176 | 0.79 | 3.49E−02 | 2 | 8 | LBY176 | 0.72 | 6.70E−02 | 2 | 17 |
| LBY176 | 0.72 | 6.70E−02 | 2 | 14 | LBY176 | 0.88 | 3.39E−04 | 5 | 3 |
| LBY176 | 0.82 | 1.93E−03 | 5 | 53 | LBY176 | 0.75 | 8.41E−03 | 5 | 1 |
| LBY176 | 0.82 | 2.16E−03 | 5 | 34 | LBY176 | 0.83 | 2.72E−03 | 6 | 53 |
| LBY176 | 0.72 | 2.01E−02 | 6 | 35 | LBY176 | 0.72 | 1.98E−02 | 4 | 43 |
| LBY176 | 0.73 | 1.12E−02 | 3 | 23 | LBY176 | 0.73 | 1.03E−02 | 3 | 27 |
| LBY176 | 0.83 | 1.50E−03 | 3 | 26 | LBY176 | 0.80 | 2.85E−03 | 3 | 45 |
| LBY176 | 0.90 | 5.27E−03 | 1 | 49 | LBY177 | 0.98 | 1.73E−04 | 2 | 10 |

TABLE 57-continued

Correlation between the expression level of selected genes of some embodiments of the invention in various tissues and the phenotypic performance under normal conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY177 | 0.72 | 6.61E−02 | 2 | 17 | LBY177 | 0.72 | 6.61E−02 | 2 | 14 |
| LBY177 | 0.76 | 4.59E−02 | 2 | 11 | LBY177 | 0.76 | 4.95E−02 | 2 | 13 |
| LBY177 | 0.90 | 8.34E−04 | 6 | 16 | LBY177 | 0.82 | 3.97E−03 | 6 | 41 |
| LBY177 | 0.73 | 1.58E−02 | 6 | 39 | LBY177 | 0.75 | 1.19E−02 | 6 | 45 |
| LBY177 | 0.81 | 8.80E−03 | 4 | 16 | LBY177 | 0.72 | 1.33E−02 | 3 | 8 |
| LBY177 | 0.87 | 4.54E−04 | 3 | 15 | LBY177 | 0.76 | 7.12E−03 | 3 | 12 |
| LBY177 | 0.84 | 1.25E−03 | 3 | 38 | LBY177 | 0.79 | 3.59E−03 | 3 | 50 |
| LBY177 | 0.71 | 1.50E−02 | 3 | 43 | LBY177 | 0.72 | 1.26E−02 | 3 | 17 |
| LBY177 | 0.74 | 8.65E−03 | 3 | 41 | LBY177 | 0.72 | 1.26E−02 | 3 | 14 |
| LBY177 | 0.74 | 9.72E−03 | 3 | 42 | LBY177 | 0.71 | 7.67E−02 | 1 | 28 |
| LBY177 | 0.84 | 1.90E−02 | 1 | 37 | LBY177 | 0.85 | 1.58E−02 | 1 | 27 |
| LBY177 | 0.77 | 4.41E−02 | 1 | 53 | LBY177 | 0.74 | 5.68E−02 | 1 | 9 |
| LBY177 | 0.84 | 1.90E−02 | 1 | 26 | LBY177 | 0.82 | 2.26E−02 | 1 | 45 |
| LBY177 | 0.76 | 4.76E−02 | 1 | 1 | LBY177 | 0.75 | 5.28E−02 | 1 | 19 |
| LBY177 | 0.73 | 6.50E−02 | 1 | 34 | LBY177 | 0.83 | 2.02E−02 | 1 | 36 |
| LBY178 | 0.73 | 6.28E−02 | 2 | 10 | LBY178 | 0.70 | 7.91E−02 | 2 | 28 |
| LBY178 | 0.70 | 7.91E−02 | 2 | 52 | LBY178 | 0.72 | 7.09E−02 | 2 | 50 |
| LBY178 | 0.80 | 5.34E−02 | 2 | 16 | LBY178 | 0.87 | 1.16E−02 | 2 | 45 |
| LBY178 | 0.90 | 5.62E−03 | 2 | 49 | LBY178 | 0.74 | 5.58E−02 | 2 | 19 |
| LBY178 | 0.80 | 3.24E−02 | 2 | 34 | LBY178 | 0.73 | 1.69E−02 | 6 | 8 |
| LBY178 | 0.78 | 8.29E−03 | 6 | 6 | LBY178 | 0.72 | 1.04E−01 | 6 | 48 |
| LBY178 | 0.71 | 2.11E−02 | 4 | 15 | LBY178 | 0.75 | 8.70E−02 | 4 | 48 |
| LBY178 | 0.71 | 2.06E−02 | 4 | 19 | LBY178 | 0.80 | 2.90E−03 | 3 | 8 |
| LBY178 | 0.71 | 1.53E−02 | 3 | 21 | LBY178 | 0.70 | 7.76E−02 | 1 | 8 |
| LBY178 | 0.81 | 2.62E−02 | 1 | 51 | LBY178 | 0.82 | 2.54E−02 | 1 | 49 |
| LBY179 | 0.81 | 2.78E−02 | 2 | 9 | LBY179 | 0.81 | 2.61E−02 | 2 | 45 |
| LBY179 | 0.71 | 1.49E−02 | 5 | 25 | LBY179 | 0.95 | 3.86E−03 | 5 | 48 |
| LBY179 | 0.82 | 4.62E−02 | 6 | 54 | LBY179 | 0.83 | 3.18E−03 | 4 | 3 |
| LBY179 | 0.79 | 6.71E−03 | 4 | 53 | LBY179 | 0.78 | 8.15E−03 | 4 | 1 |
| LBY179 | 0.91 | 2.64E−04 | 4 | 34 | LBY179 | 0.78 | 4.00E−02 | 1 | 45 |
| LBY180 | 0.80 | 3.07E−02 | 2 | 3 | LBY180 | 0.94 | 1.47E−03 | 2 | 53 |
| LBY180 | 0.86 | 1.31E−02 | 2 | 1 | LBY180 | 0.83 | 2.20E−02 | 2 | 34 |
| LBY180 | 0.80 | 3.14E−02 | 2 | 35 | LBY180 | 0.79 | 3.29E−02 | 2 | 30 |
| LBY180 | 0.79 | 4.15E−03 | 5 | 22 | LBY180 | 0.89 | 7.77E−03 | 5 | 44 |
| LBY180 | 0.82 | 4.70E−02 | 5 | 48 | LBY180 | 0.71 | 2.20E−02 | 6 | 23 |
| LBY180 | 0.71 | 2.18E−02 | 4 | 53 | LBY180 | 0.77 | 9.94E−03 | 4 | 13 |
| LBY180 | 0.76 | 7.82E−02 | 4 | 48 | LBY180 | 0.71 | 2.19E−02 | 4 | 19 |
| LBY180 | 0.81 | 2.73E−02 | 1 | 28 | LBY180 | 0.71 | 7.32E−02 | 1 | 3 |
| LBY180 | 0.92 | 3.78E−03 | 1 | 53 | LBY180 | 0.76 | 4.97E−02 | 1 | 1 |
| LBY180 | 0.81 | 2.64E−02 | 1 | 19 | LBY180 | 0.78 | 3.98E−02 | 1 | 34 |
| LBY180 | 0.76 | 4.67E−02 | 1 | 35 | LBY180 | 0.72 | 7.06E−02 | 1 | 36 |
| LBY180 | 0.92 | 3.03E−03 | 1 | 30 | LBY181 | 0.85 | 1.46E−02 | 2 | 8 |
| LBY181 | 0.70 | 7.92E−02 | 2 | 10 | LBY181 | 0.81 | 2.75E−02 | 2 | 17 |
| LBY181 | 0.81 | 2.75E−02 | 2 | 14 | LBY181 | 0.74 | 5.88E−02 | 2 | 13 |
| LBY181 | 0.73 | 1.09E−02 | 5 | 25 | LBY181 | 0.78 | 4.03E−02 | 5 | 46 |
| LBY181 | 0.71 | 2.12E−02 | 6 | 51 | LBY181 | 0.75 | 1.28E−02 | 3 | 16 |
| LBY181 | 0.75 | 5.00E−02 | 1 | 29 | LBY181 | 0.86 | 1.40E−02 | 1 | 40 |
| LBY181 | 0.75 | 5.04E−02 | 1 | 35 | LBY182 | 0.86 | 1.26E−02 | 2 | 28 |
| LBY182 | 0.76 | 4.55E−02 | 2 | 45 | LBY182 | 0.72 | 1.33E−02 | 5 | 20 |
| LBY182 | 0.70 | 1.62E−02 | 5 | 53 | LBY182 | 0.88 | 2.23E−02 | 5 | 48 |
| LBY182 | 0.72 | 1.28E−02 | 5 | 45 | LBY182 | 0.70 | 2.37E−02 | 6 | 37 |
| LBY182 | 0.78 | 8.00E−03 | 6 | 3 | LBY182 | 0.83 | 3.18E−03 | 6 | 53 |
| LBY182 | 0.72 | 1.92E−02 | 6 | 11 | LBY182 | 0.72 | 1.78E−02 | 6 | 26 |
| LBY182 | 0.73 | 1.69E−02 | 6 | 1 | LBY182 | 0.72 | 1.91E−02 | 6 | 36 |
| LBY182 | 0.78 | 7.96E−03 | 4 | 53 | LBY182 | 0.85 | 1.71E−03 | 4 | 9 |
| LBY182 | 0.76 | 1.03E−02 | 4 | 45 | LBY182 | 0.78 | 8.14E−03 | 4 | 1 |
| LBY182 | 0.81 | 4.83E−03 | 4 | 34 | LBY182 | 0.86 | 6.46E−04 | 3 | 45 |
| LBY182 | 0.75 | 5.34E−02 | 1 | 47 | LBY182 | 0.77 | 4.49E−02 | 1 | 20 |
| LBY182 | 0.93 | 2.43E−03 | 1 | 35 | LBY182 | 0.78 | 3.72E−02 | 2 | 6 |
| LBY183 | 0.71 | 7.13E−02 | 2 | 27 | LBY183 | 0.78 | 3.82E−02 | 2 | 31 |
| LBY183 | 0.75 | 5.05E−02 | 2 | 32 | LBY183 | 0.78 | 3.80E−02 | 2 | 5 |
| LBY183 | 0.72 | 1.24E−02 | 5 | 22 | LBY183 | 0.85 | 1.49E−02 | 5 | 44 |
| LBY183 | 0.71 | 1.43E−02 | 5 | 26 | LBY183 | 0.92 | 9.13E−03 | 5 | 48 |
| LBY183 | 0.76 | 1.11E−02 | 4 | 13 | LBY183 | 0.75 | 8.28E−02 | 4 | 48 |
| LBY183 | 0.74 | 1.42E−02 | 4 | 30 | LBY183 | 0.83 | 2.09E−02 | 1 | 4 |
| LBY183 | 0.77 | 4.31E−02 | 1 | 6 | LBY183 | 0.71 | 7.51E−02 | 1 | 37 |
| LBY183 | 0.84 | 1.78E−02 | 1 | 27 | LBY183 | 0.72 | 7.04E−02 | 1 | 32 |
| LBY183 | 0.85 | 1.57E−02 | 1 | 9 | LBY183 | 0.77 | 4.20E−02 | 1 | 26 |
| LBY183 | 0.83 | 2.07E−02 | 1 | 45 | LBY184 | 0.85 | 3.19E−02 | 2 | 16 |
| LBY184 | 0.76 | 1.71E−02 | 6 | 16 | LBY184 | 0.80 | 5.58E−03 | 4 | 19 |
| LBY185 | 0.79 | 3.32E−02 | 2 | 45 | LBY185 | 0.88 | 8.93E−04 | 5 | 16 |
| LBY185 | 0.78 | 7.22E−03 | 6 | 50 | LBY185 | 0.80 | 3.14E−03 | 3 | 42 |

TABLE 57-continued

Correlation between the expression level of selected genes of some embodiments of the invention in various tissues and the phenotypic performance under normal conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY185 | 0.77 | 4.49E−02 | 1 | 4 | LBY185 | 0.79 | 3.39E−02 | 1 | 9 |
| LBY185 | 0.87 | 1.15E−02 | 1 | 45 | LBY186 | 0.74 | 5.54E−02 | 2 | 45 |
| LBY186 | 0.77 | 9.01E−03 | 6 | 38 | LBY186 | 0.89 | 6.42E−04 | 6 | 6 |
| LBY186 | 0.84 | 2.59E−03 | 6 | 31 | LBY186 | 0.84 | 2.41E−03 | 6 | 32 |
| LBY186 | 0.85 | 2.04E−03 | 6 | 5 | LBY186 | 0.91 | 2.30E−04 | 4 | 15 |
| LBY186 | 0.84 | 2.54E−03 | 4 | 12 | LBY186 | 0.79 | 6.24E−03 | 4 | 38 |
| LBY186 | 0.78 | 3.89E−02 | 4 | 44 | LBY186 | 0.77 | 8.70E−03 | 4 | 43 |
| LBY186 | 0.83 | 2.69E−03 | 4 | 41 | LBY186 | 0.87 | 1.13E−03 | 4 | 39 |
| LBY186 | 0.87 | 2.30E−02 | 4 | 48 | LBY186 | 0.79 | 3.58E−02 | 3 | 15 |
| LBY186 | 0.73 | 1.05E−02 | 3 | 12 | LBY186 | 0.82 | 1.98E−03 | 3 | 43 |
| LBY186 | 0.75 | 8.13E−03 | 3 | 41 | LBY186 | 0.75 | 8.79E−02 | 3 | 48 |
| LBY187 | 0.84 | 1.84E−02 | 2 | 8 | LBY187 | 0.73 | 6.23E−02 | 2 | 10 |
| LBY187 | 0.72 | 6.53E−02 | 2 | 50 | LBY187 | 0.72 | 6.73E−02 | 2 | 17 |
| LBY187 | 0.72 | 6.73E−02 | 2 | 14 | LBY187 | 0.70 | 7.78E−02 | 2 | 49 |
| LBY187 | 0.89 | 6.64E−04 | 6 | 45 | LBY187 | 0.74 | 1.52E−02 | 6 | 34 |
| LBY187 | 0.72 | 1.23E−02 | 3 | 10 | LBY187 | 0.71 | 1.37E−02 | 3 | 15 |
| LBY187 | 0.76 | 6.71E−03 | 3 | 12 | LBY187 | 0.75 | 8.19E−03 | 3 | 50 |
| LBY187 | 0.78 | 3.90E−02 | 1 | 22 | LBY187 | 0.72 | 6.71E−02 | 1 | 49 |
| LBY188 | 0.77 | 4.42E−02 | 2 | 8 | LBY188 | 0.71 | 7.67E−02 | 2 | 39 |
| LBY188 | 0.74 | 9.31E−02 | 5 | 54 | LBY188 | 0.78 | 8.05E−03 | 6 | 8 |
| LBY188 | 0.81 | 4.46E−03 | 4 | 19 | LBY188 | 0.71 | 7.37E−02 | 1 | 8 |
| LBY188 | 0.71 | 7.13E−02 | 1 | 49 | LBY189 | 0.80 | 3.08E−02 | 2 | 8 |
| LBY189 | 0.74 | 1.37E−02 | 6 | 53 | LBY189 | 0.70 | 7.81E−02 | 3 | 46 |
| LBY189 | 0.71 | 7.23E−02 | 3 | 44 | LBY189 | 0.74 | 8.99E−03 | 3 | 13 |
| LBY189 | 0.83 | 2.06E−02 | 1 | 10 | LBY189 | 0.72 | 6.91E−02 | 1 | 22 |
| LBY189 | 0.87 | 1.16E−02 | 1 | 13 | LBY189 | 0.73 | 6.03E−02 | 1 | 30 |
| LBY190 | 0.72 | 7.04E−02 | 2 | 27 | LBY190 | 0.75 | 5.10E−02 | 2 | 3 |
| LBY190 | 0.92 | 3.14E−03 | 2 | 13 | LBY190 | 0.76 | 8.00E−02 | 5 | 54 |
| LBY190 | 0.78 | 7.15E−03 | 4 | 28 | LBY190 | 0.84 | 2.55E−03 | 4 | 45 |
| LBY190 | 0.91 | 1.10E−04 | 3 | 6 | LBY190 | 0.74 | 9.33E−03 | 3 | 31 |
| LBY190 | 0.90 | 1.88E−04 | 3 | 32 | LBY190 | 0.75 | 7.88E−03 | 3 | 5 |
| LBY191 | 0.79 | 3.64E−02 | 2 | 52 | LBY191 | 0.75 | 5.26E−02 | 5 | 44 |
| LBY191 | 0.82 | 4.57E−02 | 5 | 48 | LBY191 | 0.76 | 1.05E−02 | 4 | 8 |
| LBY191 | 0.71 | 2.10E−02 | 4 | 15 | LBY191 | 0.83 | 2.70E−03 | 4 | 52 |
| LBY191 | 0.82 | 4.02E−03 | 4 | 17 | LBY191 | 0.82 | 4.02E−03 | 4 | 14 |
| LBY191 | 0.74 | 1.45E−02 | 4 | 11 | LBY191 | 0.84 | 1.32E−03 | 3 | 52 |
| LBY191 | 0.70 | 1.64E−02 | 3 | 17 | LBY191 | 0.70 | 1.64E−02 | 3 | 14 |
| LBY191 | 0.79 | 3.51E−02 | 1 | 51 | LBY191 | 0.70 | 7.84E−02 | 2 | 10 |
| LBY192 | 0.92 | 3.39E−03 | 2 | 13 | LBY192 | 0.74 | 1.46E−02 | 5 | 16 |
| LBY192 | 0.88 | 2.24E−02 | 5 | 48 | LBY192 | 0.73 | 1.56E−02 | 6 | 45 |
| LBY192 | 0.82 | 3.39E−03 | 4 | 8 | LBY192 | 0.73 | 1.71E−02 | 4 | 6 |
| LBY192 | 0.74 | 1.52E−02 | 4 | 37 | LBY192 | 0.84 | 2.11E−03 | 4 | 27 |
| LBY192 | 0.80 | 5.58E−03 | 4 | 17 | LBY192 | 0.71 | 2.15E−02 | 4 | 31 |
| LBY192 | 0.80 | 5.58E−03 | 4 | 14 | LBY192 | 0.84 | 2.15E−03 | 4 | 32 |
| LBY192 | 0.71 | 2.07E−02 | 4 | 11 | LBY192 | 0.82 | 3.34E−03 | 4 | 26 |
| LBY192 | 0.76 | 4.59E−02 | 1 | 10 | LBY192 | 0.86 | 1.20E−02 | 1 | 38 |
| LBY192 | 0.89 | 7.81E−03 | 1 | 37 | LBY192 | 0.88 | 9.35E−03 | 1 | 27 |
| LBY192 | 0.70 | 7.91E−02 | 1 | 3 | LBY192 | 0.79 | 3.63E−02 | 1 | 11 |
| LBY192 | 0.86 | 1.27E−02 | 1 | 26 | LBY192 | 0.86 | 1.38E−02 | 1 | 36 |
| LGN3 | 0.85 | 1.46E−02 | 2 | 51 | LGN3 | 0.71 | 7.59E−02 | 2 | 52 |
| LGN3 | 0.77 | 4.49E−02 | 2 | 45 | LGN3 | 0.80 | 2.94E−02 | 5 | 46 |
| LGN3 | 0.79 | 3.59E−02 | 5 | 44 | LGN3 | 0.79 | 3.65E−03 | 5 | 40 |
| LGN3 | 0.73 | 1.62E−02 | 6 | 51 | LGN3 | 0.73 | 1.57E−02 | 4 | 45 |
| LGN3 | 0.74 | 8.56E−03 | 3 | 43 | LGN3 | 0.73 | 1.01E−02 | 3 | 41 |
| LGN3 | 0.72 | 1.33E−02 | 3 | 39 | LGN3 | 0.71 | 7.45E−02 | 1 | 4 |
| LGN3 | 0.74 | 5.94E−02 | 1 | 28 | LGN3 | 0.92 | 3.11E−03 | 1 | 45 |
| LGN3 | 0.74 | 5.53E−02 | 1 | 35 | LGN5 | 0.93 | 2.78E−03 | 2 | 10 |
| LGN5 | 0.77 | 4.43E−02 | 2 | 50 | LGN5 | 0.71 | 7.23E−02 | 2 | 43 |
| LGN5 | 0.70 | 7.72E−02 | 2 | 11 | LGN5 | 0.77 | 4.41E−02 | 2 | 13 |
| LGN5 | 0.73 | 6.33E−02 | 2 | 49 | LGN5 | 0.72 | 6.68E−02 | 2 | 42 |
| LGN5 | 0.70 | 1.59E−02 | 5 | 53 | LGN5 | 0.79 | 3.68E−03 | 5 | 35 |
| LGN5 | 0.83 | 5.88E−03 | 6 | 16 | LGN5 | 0.82 | 3.90E−03 | 6 | 45 |
| LGN5 | 0.70 | 2.32E−02 | 6 | 35 | LGN5 | 0.81 | 4.78E−03 | 4 | 43 |
| LGN5 | 0.76 | 1.08E−02 | 4 | 41 | LGN5 | 0.78 | 8.41E−03 | 4 | 39 |
| LGN5 | 0.94 | 5.85E−03 | 4 | 48 | LGN5 | 0.79 | 6.58E−03 | 4 | 42 |
| LGN5 | 0.93 | 2.31E−03 | 3 | 44 | LGN5 | 0.72 | 1.06E−01 | 3 | 48 |
| LGN5 | 0.76 | 4.70E−02 | 1 | 17 | LGN5 | 0.76 | 4.70E−02 | 1 | 14 |
| LGN5 | 0.85 | 1.65E−02 | 1 | 45 | LGN54 | 0.71 | 7.25E−02 | 2 | 45 |
| LGN54 | 0.89 | 7.01E−03 | 5 | 44 | LGN54 | 0.90 | 1.48E−02 | 5 | 48 |
| LGN54 | 0.72 | 1.97E−02 | 6 | 6 | LGN54 | 0.70 | 2.35E−02 | 6 | 7 |
| LGN54 | 0.74 | 1.46E−02 | 6 | 31 | LGN54 | 0.81 | 4.71E−03 | 6 | 3 |
| LGN54 | 0.78 | 7.66E−03 | 6 | 1 | LGN54 | 0.78 | 7.88E−03 | 6 | 5 |

TABLE 57-continued

Correlation between the expression level of selected genes of some embodiments of the invention in various tissues and the phenotypic performance under normal conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LGN54 | 0.74 | 1.54E−02 | 4 | 22 | LGN54 | 0.77 | 4.38E−02 | 3 | 46 |
| LGN54 | 0.76 | 4.60E−02 | 1 | 28 | LGN54 | 0.75 | 5.05E−02 | 1 | 9 |
| LGN54 | 0.94 | 1.97E−03 | 1 | 45 | LGN57 | 0.76 | 4.91E−02 | 2 | 27 |
| LGN57 | 0.91 | 4.02E−03 | 2 | 13 | LGN57 | 0.81 | 2.57E−03 | 5 | 43 |
| LGN57 | 0.77 | 7.17E−02 | 5 | 54 | LGN57 | 0.86 | 6.84E−04 | 5 | 42 |
| LGN57 | 0.71 | 2.10E−02 | 6 | 23 | LGN57 | 0.80 | 3.07E−02 | 6 | 46 |
| LGN57 | 0.96 | 5.21E−04 | 6 | 44 | LGN57 | 0.74 | 1.53E−02 | 6 | 31 |
| LGN57 | 0.73 | 1.61E−02 | 6 | 32 | LGN57 | 0.71 | 2.23E−02 | 6 | 5 |
| LGN57 | 0.77 | 8.75E−03 | 6 | 24 | LGN57 | 0.74 | 1.44E−02 | 4 | 47 |
| LGN57 | 0.82 | 3.66E−03 | 4 | 42 | LGN57 | 0.71 | 1.38E−02 | 3 | 10 |
| LGN57 | 0.72 | 6.92E−02 | 3 | 44 | LGN57 | 0.79 | 3.43E−02 | 1 | 10 |
| LGN57 | 0.70 | 7.71E−02 | 1 | 37 | LGN57 | 0.89 | 6.48E−03 | 1 | 7 |
| LGN57 | 0.85 | 1.66E−02 | 1 | 27 | LGN57 | 0.74 | 5.98E−02 | 1 | 31 |
| LGN57 | 0.88 | 8.19E−03 | 1 | 33 | LGN57 | 0.84 | 1.87E−02 | 1 | 3 |
| LGN57 | 0.73 | 6.36E−02 | 1 | 26 | LGN57 | 0.90 | 6.07E−03 | 1 | 13 |
| LGN57 | 0.80 | 3.20E−02 | 1 | 5 | LGN6 | 0.73 | 6.12E−02 | 2 | 21 |
| LGN6 | 0.85 | 1.56E−02 | 5 | 44 | LGN6 | 0.77 | 7.16E−02 | 5 | 48 |
| LGN6 | 0.81 | 4.23E−03 | 6 | 43 | LGN6 | 0.87 | 1.18E−03 | 6 | 41 |
| LGN6 | 0.85 | 1.80E−03 | 6 | 39 | LGN7 | 0.81 | 2.74E−02 | 2 | 8 |
| LGN7 | 0.85 | 1.62E−02 | 2 | 10 | LGN7 | 0.90 | 6.27E−03 | 2 | 43 |
| LGN7 | 0.72 | 7.05E−02 | 2 | 17 | LGN7 | 0.79 | 3.27E−02 | 2 | 41 |
| LGN7 | 0.72 | 7.05E−02 | 2 | 14 | LGN7 | 0.83 | 2.21E−02 | 2 | 39 |
| LGN7 | 0.79 | 3.46E−02 | 2 | 49 | LGN7 | 0.75 | 5.45E−02 | 2 | 42 |
| LGN7 | 0.77 | 4.32E−02 | 5 | 46 | LGN7 | 0.77 | 5.71E−03 | 5 | 22 |
| LGN7 | 0.80 | 3.06E−02 | 5 | 44 | LGN7 | 0.76 | 7.11E−03 | 5 | 13 |
| LGN7 | 0.74 | 1.43E−02 | 6 | 23 | LGN7 | 0.74 | 5.48E−02 | 6 | 44 |
| LGN7 | 0.86 | 2.80E−02 | 6 | 48 | LGN7 | 0.81 | 4.33E−03 | 6 | 24 |
| LGN7 | 0.79 | 3.43E−02 | 4 | 44 | LGN7 | 0.73 | 1.73E−02 | 4 | 13 |
| LGN7 | 0.83 | 2.03E−02 | 1 | 8 | LGN7 | 0.72 | 6.67E−02 | 1 | 10 |
| LGN7 | 0.76 | 4.84E−02 | 1 | 15 | LGN7 | 0.79 | 3.54E−02 | 1 | 12 |
| LGN7 | 0.81 | 2.65E−02 | 1 | 38 | LGN7 | 0.71 | 7.46E−02 | 1 | 22 |
| LGN7 | 0.73 | 6.20E−02 | 1 | 50 | LGN7 | 0.79 | 3.61E−02 | 1 | 43 |
| LGN7 | 0.79 | 3.40E−02 | 1 | 17 | LGN7 | 0.87 | 2.55E−02 | 1 | 16 |
| LGN7 | 0.88 | 8.71E−03 | 1 | 41 | LGN7 | 0.79 | 3.40E−02 | 1 | 14 |
| LGN7 | 0.79 | 3.44E−02 | 1 | 39 | LGN7 | 0.71 | 7.11E−02 | 1 | 11 |
| LGN7 | 0.72 | 7.08E−02 | 1 | 49 | | | | | |

Table 57. Provided are the correlations (R) between the genes expression levels in various tissues and the phenotypic performance. "Corr. ID"—correlation set ID according to the correlated parameters specified in Table 52. "Exp. Set"—Expression set specified in Table 50. "R" = Pearson correlation coefficient; "P" = p value

TABLE 58

Correlation between the expression level of selected genes of some embodiments of the invention in various tissues and the phenotypic performance under drought conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY14 | 0.71 | 1.52E−02 | 3 | 51 | LBY14 | 0.79 | 3.46E−03 | 3 | 39 |
| LBY148 | 0.74 | 2.31E−02 | 6 | 51 | LBY148 | 0.70 | 1.59E−02 | 5 | 52 |
| LBY148 | 0.79 | 3.60E−03 | 3 | 15 | LBY148 | 0.85 | 9.14E−04 | 3 | 52 |
| LBY148 | 0.74 | 5.49E−02 | 3 | 46 | LBY148 | 0.90 | 1.75E−04 | 3 | 41 |
| LBY148 | 0.79 | 3.64E−03 | 3 | 39 | LBY148 | 0.83 | 1.64E−03 | 3 | 42 |
| LBY149 | 0.86 | 5.63E−03 | 1 | 52 | LBY149 | 0.70 | 5.27E−02 | 1 | 2 |
| LBY149 | 0.70 | 7.96E−02 | 5 | 46 | LBY149 | 0.75 | 7.97E−03 | 5 | 7 |
| LBY149 | 0.73 | 1.00E−02 | 5 | 31 | LBY149 | 0.76 | 6.35E−03 | 5 | 33 |
| LBY149 | 0.72 | 1.04E−01 | 5 | 54 | LBY149 | 0.80 | 3.07E−02 | 5 | 48 |
| LBY149 | 0.74 | 9.12E−03 | 5 | 5 | LBY149 | 0.70 | 1.62E−02 | 5 | 2 |
| LBY149 | 0.90 | 1.57E−02 | 4 | 44 | LBY149 | 0.89 | 6.65E−03 | 4 | 48 |
| LBY149 | 0.71 | 1.52E−02 | 4 | 49 | LBY149 | 0.83 | 1.63E−03 | 3 | 4 |
| LBY149 | 0.77 | 5.98E−03 | 3 | 6 | LBY149 | 0.74 | 8.55E−03 | 3 | 32 |
| LBY149 | 0.75 | 8.22E−03 | 3 | 9 | LBY149 | 0.71 | 1.39E−02 | 3 | 5 |
| LBY150 | 0.93 | 7.82E−04 | 1 | 7 | LBY150 | 0.78 | 2.38E−02 | 1 | 20 |
| LBY150 | 0.92 | 1.25E−03 | 1 | 33 | LBY150 | 0.72 | 1.04E−01 | 1 | 54 |
| LBY150 | 0.83 | 2.08E−02 | 1 | 48 | LBY150 | 0.77 | 2.63E−02 | 1 | 5 |
| LBY150 | 0.79 | 2.09E−02 | 1 | 24 | LBY150 | 0.83 | 5.40E−03 | 6 | 47 |
| LBY150 | 0.84 | 3.86E−02 | 6 | 44 | LBY150 | 0.82 | 6.19E−03 | 6 | 45 |
| LBY150 | 0.85 | 4.09E−03 | 6 | 19 | LBY150 | 0.76 | 6.94E−03 | 4 | 27 |

TABLE 58-continued

Correlation between the expression level of selected genes of some embodiments of the invention in various tissues and the phenotypic performance under drought conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY150 | 0.79 | 3.79E−03 | 4 | 26 | LBY150 | 0.72 | 1.33E−02 | 4 | 19 |
| LBY150 | 0.75 | 7.61E−03 | 4 | 34 | LBY150 | 0.77 | 5.56E−03 | 4 | 35 |
| LBY150 | 0.86 | 7.81E−04 | 3 | 47 | LBY150 | 0.72 | 1.16E−02 | 3 | 53 |
| LBY150 | 0.95 | 6.42E−06 | 3 | 45 | LBY150 | 0.74 | 9.71E−03 | 3 | 1 |
| LBY150 | 0.71 | 1.39E−02 | 3 | 19 | LBY150 | 0.89 | 2.72E−04 | 3 | 34 |
| LBY150 | 0.90 | 1.79E−04 | 3 | 35 | LBY150 | 0.70 | 5.30E−02 | 2 | 21 |
| LBY151 | 0.79 | 1.06E−02 | 6 | 50 | LBY151 | 0.72 | 2.86E−02 | 6 | 17 |
| LBY151 | 0.73 | 2.50E−02 | 6 | 31 | LBY151 | 0.72 | 2.86E−02 | 6 | 14 |
| LBY151 | 0.72 | 6.74E−02 | 6 | 48 | LBY151 | 0.82 | 6.38E−03 | 6 | 49 |
| LBY151 | 0.76 | 1.77E−02 | 6 | 5 | LBY151 | 0.77 | 5.18E−03 | 3 | 50 |
| LBY151 | 0.72 | 4.23E−02 | 2 | 4 | LBY151 | 0.77 | 2.52E−02 | 2 | 23 |
| LBY151 | 0.78 | 2.13E−02 | 2 | 6 | LBY151 | 0.77 | 2.46E−02 | 2 | 32 |
| LBY152 | 0.80 | 1.81E−02 | 1 | 52 | LBY152 | 0.78 | 4.74E−03 | 5 | 6 |
| LBY152 | 0.78 | 4.49E−03 | 5 | 32 | LBY152 | 0.79 | 4.08E−03 | 4 | 21 |
| LBY152 | 0.71 | 1.53E−02 | 3 | 21 | LBY152 | 0.70 | 1.20E−01 | 3 | 54 |
| LBY153 | 0.86 | 6.38E−03 | 1 | 7 | LBY153 | 0.75 | 8.41E−02 | 1 | 44 |
| LBY153 | 0.80 | 1.66E−02 | 1 | 20 | LBY153 | 0.86 | 5.86E−03 | 1 | 33 |
| LBY153 | 0.70 | 1.20E−01 | 1 | 54 | LBY153 | 0.92 | 3.37E−03 | 1 | 48 |
| LBY153 | 0.85 | 7.37E−03 | 1 | 49 | LBY153 | 0.71 | 3.35E−02 | 6 | 22 |
| LBY153 | 0.76 | 1.65E−02 | 6 | 27 | LBY153 | 0.91 | 7.69E−04 | 6 | 53 |
| LBY153 | 0.80 | 9.94E−03 | 6 | 26 | LBY153 | 0.81 | 8.80E−03 | 6 | 45 |
| LBY153 | 0.77 | 1.44E−02 | 6 | 34 | LBY153 | 0.80 | 1.02E−02 | 6 | 35 |
| LBY153 | 0.77 | 5.75E−03 | 4 | 53 | LBY153 | 0.80 | 3.38E−03 | 3 | 21 |
| LBY153 | 0.70 | 1.65E−02 | 3 | 53 | LBY153 | 0.74 | 9.35E−02 | 3 | 54 |
| LBY154 | 0.70 | 5.19E−02 | 1 | 45 | LBY154 | 0.76 | 2.87E−02 | 1 | 19 |
| LBY154 | 0.72 | 6.79E−02 | 6 | 46 | LBY154 | 0.75 | 2.09E−02 | 6 | 6 |
| LBY154 | 0.86 | 2.74E−03 | 6 | 50 | LBY154 | 0.80 | 9.86E−03 | 6 | 43 |
| LBY154 | 0.71 | 3.36E−02 | 6 | 31 | LBY154 | 0.76 | 3.02E−02 | 6 | 16 |
| LBY154 | 0.83 | 6.19E−03 | 6 | 41 | LBY154 | 0.89 | 1.83E−02 | 6 | 54 |
| LBY154 | 0.75 | 5.08E−02 | 6 | 48 | LBY154 | 0.81 | 8.74E−03 | 6 | 49 |
| LBY154 | 0.89 | 1.34E−03 | 6 | 42 | LBY154 | 0.77 | 5.15E−03 | 5 | 43 |
| LBY154 | 0.88 | 1.78E−03 | 5 | 16 | LBY154 | 0.71 | 1.13E−01 | 4 | 44 |
| LBY154 | 0.71 | 1.47E−02 | 4 | 20 | LBY154 | 0.70 | 1.59E−02 | 3 | 21 |
| LBY154 | 0.74 | 9.32E−02 | 3 | 54 | LBY154 | 0.79 | 3.47E−02 | 3 | 48 |
| LBY154 | 0.72 | 4.46E−02 | 2 | 4 | LBY154 | 0.71 | 4.64E−02 | 2 | 47 |
| LBY154 | 0.87 | 2.44E−02 | 2 | 16 | LBY154 | 0.75 | 3.04E−02 | 2 | 9 |
| LBY154 | 0.82 | 1.34E−02 | 2 | 19 | LBY155 | 0.72 | 4.33E−02 | 1 | 51 |
| LBY155 | 0.71 | 4.71E−02 | 1 | 27 | LBY155 | 0.70 | 5.09E−02 | 1 | 26 |
| LBY155 | 0.72 | 4.61E−02 | 1 | 35 | LBY155 | 0.73 | 1.01E−02 | 5 | 38 |
| LBY155 | 0.76 | 6.13E−03 | 4 | 52 | LBY155 | 0.80 | 3.32E−03 | 3 | 19 |
| LBY155 | 0.86 | 6.10E−03 | 2 | 4 | LBY155 | 0.75 | 3.27E−02 | 2 | 6 |
| LBY155 | 0.81 | 1.45E−02 | 2 | 32 | LBY155 | 0.85 | 8.02E−03 | 2 | 9 |
| LBY156 | 0.71 | 4.81E−02 | 1 | 52 | LBY156 | 0.78 | 6.65E−02 | 4 | 44 |
| LBY156 | 0.73 | 1.07E−02 | 4 | 2 | LBY156 | 0.83 | 1.52E−03 | 3 | 15 |
| LBY156 | 0.88 | 3.52E−04 | 3 | 52 | LBY156 | 0.76 | 6.98E−03 | 3 | 41 |
| LBY156 | 0.71 | 1.53E−02 | 3 | 2 | LBY157 | 0.75 | 3.22E−02 | 1 | 29 |
| LBY157 | 0.80 | 1.65E−02 | 1 | 20 | LBY157 | 0.78 | 1.40E−02 | 6 | 50 |
| LBY157 | 0.86 | 2.84E−02 | 6 | 44 | LBY157 | 0.71 | 3.25E−02 | 6 | 17 |
| LBY157 | 0.71 | 3.13E−02 | 6 | 41 | LBY157 | 0.71 | 3.25E−02 | 6 | 14 |
| LBY157 | 0.92 | 4.22E−04 | 6 | 39 | LBY157 | 0.76 | 1.66E−02 | 6 | 49 |
| LBY157 | 0.84 | 4.78E−03 | 6 | 42 | LBY157 | 0.74 | 2.14E−02 | 6 | 24 |
| LBY157 | 0.79 | 3.75E−03 | 4 | 50 | LBY157 | 0.93 | 6.34E−03 | 4 | 44 |
| LBY157 | 0.70 | 1.64E−02 | 4 | 41 | LBY157 | 0.89 | 7.85E−03 | 4 | 48 |
| LBY157 | 0.77 | 6.06E−03 | 4 | 49 | LBY157 | 0.78 | 5.00E−03 | 4 | 42 |
| LBY157 | 0.75 | 7.51E−03 | 3 | 15 | LBY157 | 0.70 | 7.92E−02 | 3 | 46 |
| LBY157 | 0.80 | 3.36E−03 | 3 | 41 | LBY157 | 0.78 | 4.69E−03 | 3 | 39 |
| LBY157 | 0.85 | 9.19E−04 | 3 | 42 | LBY157 | 0.74 | 3.67E−02 | 2 | 51 |
| LBY157 | 0.96 | 2.56E−03 | 2 | 16 | LBY157 | 0.75 | 3.28E−02 | 2 | 40 |
| LBY158 | 0.77 | 2.63E−02 | 1 | 28 | LBY158 | 0.78 | 2.12E−02 | 1 | 9 |
| LBY158 | 0.84 | 9.79E−03 | 1 | 45 | LBY158 | 0.89 | 3.13E−03 | 1 | 19 |
| LBY158 | 0.93 | 8.62E−04 | 1 | 34 | LBY158 | 0.79 | 1.85E−02 | 1 | 35 |

TABLE 58-continued

Correlation between the expression level of selected genes of some embodiments of the invention in various tissues and the phenotypic performance under drought conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY158 | 0.76 | 2.93E−02 | 1 | 30 | LBY158 | 0.81 | 7.60E−03 | 6 | 47 |
| LBY158 | 0.78 | 1.23E−02 | 6 | 45 | LBY158 | 0.88 | 1.77E−03 | 6 | 19 |
| LBY158 | 0.96 | 2.70E−03 | 5 | 54 | LBY158 | 0.78 | 4.82E−03 | 5 | 45 |
| LBY158 | 0.95 | 6.52E−06 | 5 | 19 | LBY158 | 0.75 | 8.13E−03 | 5 | 34 |
| LBY158 | 0.74 | 9.14E−02 | 4 | 44 | LBY158 | 0.76 | 6.79E−03 | 3 | 47 |
| LBY158 | 0.75 | 8.15E−03 | 3 | 45 | LBY158 | 0.75 | 7.84E−03 | 3 | 19 |
| LBY158 | 0.70 | 5.14E−02 | 2 | 53 | LBY158 | 0.77 | 4.22E−02 | 2 | 13 |
| LBY158 | 0.91 | 1.66E−03 | 2 | 1 | LBY159 | 0.72 | 4.28E−02 | 1 | 28 |
| LBY159 | 0.74 | 3.65E−02 | 1 | 9 | LBY159 | 0.83 | 1.00E−02 | 1 | 34 |
| LBY159 | 0.75 | 2.07E−02 | 6 | 6 | LBY159 | 0.70 | 3.41E−02 | 6 | 43 |
| LBY159 | 0.71 | 3.08E−02 | 6 | 32 | LBY159 | 0.79 | 1.07E−02 | 5 | 16 |
| LBY159 | 0.80 | 5.50E−02 | 3 | 54 | LBY159 | 0.71 | 2.27E−02 | 3 | 13 |
| LBY159 | 0.88 | 3.91E−03 | 2 | 23 | LBY159 | 0.86 | 3.19E−02 | 6 | 15 |
| LBY160 | 0.76 | 1.81E−02 | 6 | 52 | LBY160 | 0.78 | 1.41E−02 | 6 | 12 |
| LBY160 | 0.91 | 4.47E−03 | 6 | 46 | LBY160 | 0.73 | 2.60E−02 | 6 | 6 |
| LBY160 | 0.88 | 1.54E−03 | 6 | 50 | LBY160 | 0.76 | 7.73E−02 | 6 | 44 |
| LBY160 | 0.79 | 1.21E−02 | 6 | 31 | LBY160 | 0.86 | 3.16E−02 | 6 | 41 |
| LBY160 | 0.73 | 2.41E−02 | 6 | 32 | LBY160 | 0.75 | 5.26E−02 | 6 | 48 |
| LBY160 | 0.81 | 7.85E−03 | 6 | 49 | LBY160 | 0.74 | 2.13E−02 | 6 | 5 |
| LBY160 | 0.86 | 3.01E−03 | 6 | 42 | LBY160 | 0.71 | 3.12E−02 | 6 | 2 |
| LBY160 | 0.89 | 1.15E−03 | 6 | 24 | LBY160 | 0.82 | 1.90E−03 | 4 | 10 |
| LBY160 | 0.75 | 8.22E−03 | 4 | 12 | LBY160 | 0.72 | 1.29E−02 | 3 | 22 |
| LBY160 | 0.76 | 6.75E−03 | 3 | 21 | LBY161 | 0.80 | 1.67E−02 | 1 | 10 |
| LBY161 | 0.81 | 4.97E−02 | 1 | 44 | LBY161 | 0.75 | 3.29E−02 | 1 | 1 |
| LBY161 | 0.80 | 9.86E−03 | 6 | 1 | LBY161 | 0.78 | 4.29E−03 | 4 | 10 |
| LBY161 | 0.82 | 2.08E−03 | 3 | 10 | LBY161 | 0.73 | 1.00E−02 | 3 | 17 |
| LBY161 | 0.73 | 1.00E−02 | 3 | 14 | LBY161 | 0.71 | 1.40E−02 | 3 | 11 |
| LBY161 | 0.86 | 5.58E−03 | 2 | 10 | LBY161 | 0.77 | 2.60E−02 | 2 | 51 |
| LBY161 | 0.73 | 4.15E−02 | 2 | 12 | LBY161 | 0.71 | 4.85E−02 | 2 | 7 |
| LBY161 | 0.71 | 4.73E−02 | 2 | 50 | LBY161 | 0.78 | 2.20E−02 | 2 | 17 |
| LBY161 | 0.78 | 2.20E−02 | 2 | 14 | LBY161 | 0.74 | 3.69E−02 | 2 | 33 |
| LBY161 | 0.87 | 4.65E−03 | 2 | 11 | LBY162 | 0.78 | 2.33E−02 | 1 | 7 |
| LBY162 | 0.76 | 2.83E−02 | 1 | 27 | LBY162 | 0.77 | 2.46E−02 | 1 | 33 |
| LBY162 | 0.83 | 4.12E−02 | 1 | 54 | LBY162 | 0.71 | 4.83E−02 | 1 | 26 |
| LBY162 | 0.74 | 5.97E−02 | 1 | 48 | LBY162 | 0.77 | 2.55E−02 | 1 | 35 |
| LBY162 | 0.83 | 1.72E−03 | 5 | 38 | LBY162 | 0.75 | 8.05E−03 | 4 | 38 |
| LBY162 | 0.75 | 7.85E−03 | 3 | 15 | LBY162 | 0.74 | 9.60E−03 | 3 | 52 |
| LBY162 | 0.84 | 1.81E−02 | 3 | 46 | LBY162 | 0.86 | 7.16E−04 | 3 | 41 |
| LBY163 | 0.78 | 3.70E−02 | 1 | 48 | LBY163 | 0.75 | 2.12E−02 | 6 | 15 |
| LBY163 | 0.91 | 5.00E−03 | 6 | 46 | LBY163 | 0.71 | 3.13E−02 | 6 | 6 |
| LBY163 | 0.84 | 4.85E−03 | 6 | 50 | LBY163 | 0.71 | 4.79E−02 | 6 | 16 |
| LBY163 | 0.85 | 3.56E−03 | 6 | 41 | LBY163 | 0.71 | 1.13E−01 | 6 | 54 |
| LBY163 | 0.72 | 6.67E−02 | 6 | 48 | LBY163 | 0.77 | 1.45E−02 | 6 | 49 |
| LBY163 | 0.91 | 6.26E−04 | 6 | 42 | LBY163 | 0.70 | 3.52E−02 | 6 | 24 |
| LBY163 | 0.73 | 1.01E−02 | 5 | 40 | LBY163 | 0.74 | 9.03E−02 | 4 | 54 |
| LBY163 | 0.84 | 1.70E−02 | 4 | 48 | LBY163 | 0.85 | 8.21E−03 | 3 | 3 |
| LBY163 | 0.88 | 8.95E−04 | 3 | 13 | LBY163 | 0.83 | 1.12E−02 | 2 | 7 |
| LBY163 | 0.91 | 1.55E−03 | 2 | 20 | LBY163 | 0.81 | 1.46E−02 | 2 | 33 |
| LBY163 | 0.82 | 1.33E−02 | 2 | 49 | LBY164 | 0.79 | 2.02E−02 | 1 | 50 |
| LBY164 | 0.80 | 5.36E−02 | 1 | 44 | LBY164 | 0.81 | 2.84E−02 | 1 | 13 |
| LBY164 | 0.87 | 1.07E−02 | 1 | 48 | LBY164 | 0.88 | 4.30E−03 | 1 | 49 |
| LBY164 | 0.80 | 1.60E−02 | 1 | 42 | LBY164 | 0.74 | 3.44E−02 | 1 | 24 |
| LBY164 | 0.79 | 1.07E−02 | 6 | 20 | LBY164 | 0.71 | 3.32E−02 | 6 | 49 |
| LBY164 | 0.85 | 8.49E−04 | 5 | 20 | LBY164 | 0.73 | 1.05E−02 | 4 | 21 |
| LBY164 | 0.71 | 1.38E−02 | 3 | 25 | LBY164 | 0.72 | 1.17E−02 | 3 | 23 |
| LBY164 | 0.75 | 7.75E−03 | 3 | 47 | LBY164 | 0.74 | 9.12E−03 | 3 | 22 |
| LBY164 | 0.73 | 1.12E−02 | 3 | 45 | LBY164 | 0.84 | 8.80E−03 | 2 | 3 |
| LBY164 | 0.93 | 2.70E−03 | 2 | 13 | LBY165 | 0.78 | 1.28E−02 | 6 | 41 |
| LBY165 | 0.72 | 2.97E−02 | 6 | 39 | LBY165 | 0.75 | 2.04E−02 | 6 | 42 |
| LBY165 | 0.82 | 6.80E−03 | 6 | 24 | LBY165 | 0.74 | 8.66E−03 | 5 | 43 |
| LBY165 | 0.79 | 3.82E−03 | 4 | 21 | LBY165 | 0.73 | 1.11E−02 | 3 | 25 |
| LBY165 | 0.80 | 3.33E−03 | 3 | 23 | LBY165 | 0.78 | 2.34E−02 | 2 | 4 |
| LBY165 | 0.77 | 2.46E−02 | 2 | 9 | LBY165 | 0.76 | 2.71E−02 | 1 | 50 |
| LBY166 | 0.91 | 1.27E−02 | 1 | 44 | LBY166 | 0.91 | 4.69E−03 | 1 | 13 |
| LBY166 | 0.98 | 1.43E−04 | 1 | 48 | LBY166 | 0.93 | 7.15E−04 | 1 | 49 |
| LBY166 | 0.72 | 1.98E−02 | 4 | 13 | LBY166 | 0.74 | 8.67E−03 | 4 | 1 |
| LBY166 | 0.71 | 1.50E−02 | 4 | 30 | LBY166 | 0.79 | 3.99E−03 | 3 | 3 |
| LBY166 | 0.78 | 7.39E−03 | 3 | 13 | LBY166 | 0.74 | 3.56E−02 | 2 | 10 |
| LBY166 | 0.74 | 3.39E−02 | 2 | 17 | LBY166 | 0.72 | 4.46E−02 | 2 | 41 |
| LBY166 | 0.74 | 3.39E−02 | 2 | 14 | LBY166 | 0.88 | 3.74E−03 | 2 | 20 |
| LBY166 | 0.74 | 3.62E−02 | 2 | 42 | LBY167 | 0.76 | 1.76E−02 | 6 | 28 |
| LBY167 | 0.81 | 7.70E−03 | 6 | 9 | LBY167 | 0.75 | 2.09E−02 | 6 | 1 |

TABLE 58-continued

Correlation between the expression level of selected genes of some embodiments of the invention in various tissues and the phenotypic performance under drought conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY167 | 0.85 | 3.55E−03 | 6 | 30 | LBY167 | 0.76 | 6.88E−03 | 4 | 23 |
| LBY167 | 0.78 | 4.35E−03 | 3 | 9 | LBY167 | 0.81 | 2.53E−03 | 3 | 1 |
| LBY167 | 0.79 | 3.94E−03 | 3 | 34 | LBY167 | 0.72 | 1.29E−02 | 3 | 35 |
| LBY167 | 0.94 | 5.26E−04 | 2 | 51 | LBY167 | 0.90 | 2.25E−03 | 2 | 52 |
| LBY167 | 0.70 | 5.23E−02 | 2 | 11 | LBY168 | 0.80 | 1.75E−02 | 1 | 10 |
| LBY168 | 0.77 | 2.66E−02 | 1 | 50 | LBY168 | 0.96 | 2.74E−03 | 1 | 44 |
| LBY168 | 0.74 | 3.49E−02 | 1 | 43 | LBY168 | 0.79 | 2.08E−02 | 1 | 17 |
| LBY168 | 0.79 | 2.08E−02 | 1 | 14 | LBY168 | 0.75 | 5.19E−02 | 1 | 13 |
| LBY168 | 0.74 | 5.62E−02 | 1 | 48 | LBY168 | 0.78 | 2.17E−02 | 1 | 49 |
| LBY168 | 0.81 | 1.37E−02 | 1 | 42 | LBY168 | 0.75 | 3.11E−02 | 1 | 24 |
| LBY168 | 0.77 | 1.58E−02 | 6 | 38 | LBY168 | 0.71 | 3.30E−02 | 6 | 7 |
| LBY168 | 0.84 | 4.64E−03 | 6 | 20 | LBY168 | 0.72 | 2.89E−02 | 6 | 33 |
| LBY168 | 0.90 | 8.49E−04 | 6 | 3 | LBY168 | 0.79 | 1.20E−02 | 6 | 9 |
| LBY168 | 0.72 | 2.99E−02 | 6 | 30 | LBY168 | 0.73 | 1.13E−02 | 5 | 8 |
| LBY168 | 0.78 | 4.38E−03 | 5 | 47 | LBY168 | 0.74 | 9.46E−03 | 5 | 22 |
| LBY168 | 0.91 | 1.10E−02 | 5 | 44 | LBY168 | 0.81 | 2.70E−03 | 5 | 17 |
| LBY168 | 0.81 | 2.70E−03 | 5 | 14 | LBY168 | 0.74 | 8.90E−03 | 5 | 53 |
| LBY168 | 0.85 | 9.11E−04 | 5 | 45 | LBY168 | 0.71 | 1.34E−02 | 5 | 49 |
| LBY168 | 0.86 | 7.91E−04 | 4 | 21 | LBY168 | 0.79 | 3.80E−03 | 3 | 20 |
| LBY168 | 0.74 | 3.67E−02 | 2 | 41 | LBY168 | 0.72 | 4.24E−02 | 2 | 39 |
| LBY168 | 0.80 | 1.65E−02 | 2 | 53 | LBY170 | 0.81 | 5.27E−02 | 2 | 16 |
| LBY170 | 0.79 | 1.96E−02 | 2 | 19 | LBY171 | 0.74 | 2.27E−02 | 5 | 16 |
| LBY171 | 0.85 | 3.40E−02 | 4 | 44 | LBY171 | 0.74 | 9.57E−03 | 3 | 41 |
| LBY171 | 0.75 | 8.36E−02 | 2 | 16 | LBY171 | 0.79 | 2.08E−02 | 2 | 19 |
| LBY173 | 0.70 | 5.32E−02 | 1 | 27 | LBY173 | 0.79 | 2.04E−02 | 1 | 26 |
| LBY173 | 0.72 | 2.81E−02 | 6 | 25 | LBY173 | 0.70 | 3.45E−02 | 6 | 17 |
| LBY173 | 0.70 | 3.45E−02 | 6 | 14 | LBY173 | 0.73 | 2.49E−02 | 6 | 39 |
| LBY173 | 0.81 | 8.66E−03 | 6 | 20 | LBY173 | 0.73 | 2.62E−02 | 6 | 24 |
| LBY173 | 0.81 | 2.64E−03 | 5 | 43 | LBY173 | 0.71 | 3.09E−02 | 5 | 16 |
| LBY173 | 0.85 | 3.23E−02 | 5 | 54 | LBY173 | 0.79 | 3.26E−02 | 4 | 46 |
| LBY173 | 0.76 | 6.57E−03 | 4 | 27 | LBY173 | 0.74 | 9.24E−03 | 4 | 20 |
| LBY173 | 0.71 | 1.48E−02 | 4 | 26 | LBY173 | 0.82 | 2.09E−03 | 3 | 53 |
| LBY173 | 0.85 | 3.03E−02 | 3 | 54 | LBY173 | 0.79 | 4.04E−03 | 3 | 35 |
| LBY173 | 0.81 | 1.51E−02 | 2 | 4 | LBY173 | 0.88 | 4.23E−03 | 2 | 6 |
| LBY173 | 0.83 | 1.00E−02 | 2 | 31 | LBY173 | 0.89 | 2.78E−03 | 2 | 32 |
| LBY173 | 0.83 | 9.92E−03 | 2 | 9 | LBY173 | 0.71 | 4.80E−02 | 2 | 1 |
| LBY173 | 0.81 | 1.59E−02 | 2 | 5 | LBY173 | 0.78 | 2.20E−02 | 2 | 34 |
| LBY173 | 0.72 | 4.30E−02 | 2 | 35 | LBY174 | 0.78 | 1.36E−02 | 6 | 2 |
| LBY174 | 0.74 | 2.28E−02 | 5 | 16 | LBY174 | 0.72 | 1.25E−02 | 3 | 8 |
| LBY174 | 0.72 | 1.29E−02 | 3 | 15 | LBY174 | 0.71 | 1.51E−02 | 3 | 52 |
| LBY174 | 0.73 | 1.09E−02 | 3 | 50 | LBY174 | 0.73 | 1.12E−02 | 3 | 41 |
| LBY174 | 0.74 | 9.56E−03 | 3 | 42 | LBY174 | 0.76 | 7.16E−03 | 3 | 24 |
| LBY175 | 0.95 | 4.42E−03 | 1 | 54 | LBY175 | 0.77 | 4.23E−02 | 1 | 48 |
| LBY175 | 0.72 | 4.37E−02 | 1 | 49 | LBY175 | 0.76 | 2.87E−02 | 2 | 47 |
| LBY175 | 0.74 | 3.75E−02 | 2 | 19 | LBY176 | 0.78 | 1.41E−02 | 6 | 28 |
| LBY176 | 0.78 | 1.40E−02 | 6 | 47 | LBY176 | 0.74 | 2.29E−02 | 6 | 45 |
| LBY176 | 0.80 | 9.86E−03 | 6 | 19 | LBY176 | 0.76 | 1.80E−02 | 6 | 30 |
| LBY176 | 0.72 | 1.17E−02 | 5 | 38 | LBY176 | 0.77 | 5.31E−03 | 4 | 27 |
| LBY176 | 0.79 | 3.71E−03 | 4 | 26 | LBY176 | 0.77 | 6.07E−03 | 4 | 45 |
| LBY176 | 0.72 | 1.23E−02 | 4 | 19 | LBY176 | 0.86 | 7.70E−04 | 4 | 34 |
| LBY176 | 0.79 | 4.03E−03 | 4 | 35 | LBY176 | 0.88 | 3.94E−04 | 3 | 53 |
| LBY176 | 0.71 | 2.02E−02 | 3 | 13 | LBY176 | 0.88 | 3.40E−04 | 3 | 45 |
| LBY176 | 0.75 | 7.40E−03 | 3 | 1 | LBY176 | 0.80 | 3.01E−03 | 3 | 34 |
| LBY176 | 0.86 | 6.68E−04 | 3 | 35 | LBY176 | 0.74 | 3.52E−02 | 2 | 3 |
| LBY176 | 0.84 | 1.93E−02 | 2 | 13 | LBY176 | 0.76 | 7.95E−02 | 1 | 16 |
| LBY177 | 0.76 | 2.84E−02 | 1 | 53 | LBY177 | 0.78 | 2.13E−02 | 6 | 16 |
| LBY177 | 0.73 | 2.50E−02 | 6 | 34 | LBY177 | 0.75 | 2.03E−02 | 6 | 35 |
| LBY177 | 0.76 | 6.48E−03 | 4 | 43 | LBY177 | 0.75 | 2.03E−02 | 4 | 16 |
| LBY177 | 0.79 | 6.23E−02 | 4 | 54 | LBY177 | 0.71 | 1.36E−02 | 3 | 29 |
| LBY177 | 0.71 | 1.15E−01 | 3 | 54 | LBY177 | 0.71 | 1.36E−02 | 3 | 2 |
| LBY177 | 0.84 | 9.30E−03 | 2 | 21 | LBY178 | 0.71 | 4.93E−02 | 1 | 53 |
| LBY178 | 0.97 | 1.45E−03 | 6 | 44 | LBY178 | 0.71 | 7.45E−02 | 6 | 48 |
| LBY178 | 0.75 | 1.99E−02 | 6 | 49 | LBY178 | 0.71 | 1.45E−02 | 5 | 29 |
| LBY178 | 0.86 | 7.32E−04 | 5 | 20 | LBY178 | 0.77 | 6.02E−03 | 5 | 21 |
| LBY178 | 0.71 | 1.47E−02 | 4 | 40 | LBY178 | 0.77 | 5.39E−03 | 3 | 10 |
| LBY178 | 0.72 | 1.31E−02 | 3 | 22 | LBY178 | 0.72 | 1.16E−02 | 3 | 17 |
| LBY178 | 0.72 | 1.16E−02 | 3 | 14 | LBY178 | 0.73 | 1.04E−02 | 3 | 39 |
| LBY178 | 0.93 | 7.82E−03 | 3 | 54 | LBY178 | 0.74 | 3.62E−02 | 2 | 51 |
| LBY178 | 0.71 | 1.12E−01 | 2 | 16 | LBY178 | 0.78 | 2.28E−02 | 2 | 53 |
| LBY179 | 0.76 | 2.74E−02 | 1 | 9 | LBY179 | 0.71 | 4.72E−02 | 1 | 26 |
| LBY179 | 0.88 | 4.38E−03 | 1 | 45 | LBY179 | 0.86 | 5.68E−03 | 1 | 1 |
| LBY179 | 0.87 | 4.58E−03 | 1 | 19 | LBY179 | 0.78 | 2.23E−02 | 1 | 34 |

TABLE 58-continued

Correlation between the expression level of selected genes of some embodiments of the invention in various tissues and the phenotypic performance under drought conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY179 | 0.93 | 9.05E−04 | 1 | 35 | LBY179 | 0.93 | 7.16E−03 | 3 | 44 |
| LBY179 | 0.72 | 1.32E−02 | 3 | 11 | LBY180 | 0.73 | 3.81E−02 | 1 | 4 |
| LBY180 | 0.71 | 5.04E−02 | 1 | 47 | LBY180 | 0.89 | 3.21E−03 | 1 | 9 |
| LBY180 | 0.91 | 1.98E−03 | 1 | 45 | LBY180 | 0.81 | 1.56E−02 | 1 | 1 |
| LBY180 | 0.90 | 2.61E−03 | 1 | 19 | LBY180 | 0.92 | 1.07E−03 | 1 | 34 |
| LBY180 | 0.97 | 4.05E−05 | 1 | 35 | LBY180 | 0.89 | 1.44E−03 | 6 | 38 |
| LBY180 | 0.71 | 3.31E−02 | 6 | 27 | LBY180 | 0.71 | 1.38E−02 | 4 | 12 |
| LBY180 | 0.73 | 1.05E−02 | 4 | 7 | LBY180 | 0.74 | 9.68E−03 | 4 | 31 |
| LBY180 | 0.71 | 1.44E−02 | 4 | 20 | LBY180 | 0.74 | 9.69E−03 | 4 | 33 |
| LBY180 | 0.82 | 2.35E−02 | 4 | 48 | LBY180 | 0.77 | 5.53E−03 | 4 | 49 |
| LBY180 | 0.74 | 8.82E−03 | 4 | 5 | LBY180 | 0.71 | 1.45E−02 | 3 | 25 |
| LBY180 | 0.80 | 3.30E−03 | 3 | 23 | LBY180 | 0.71 | 1.39E−02 | 3 | 9 |
| LBY180 | 0.75 | 3.22E−02 | 2 | 4 | LBY180 | 0.76 | 2.98E−02 | 2 | 25 |
| LBY180 | 0.75 | 3.33E−02 | 2 | 23 | LBY180 | 0.74 | 3.66E−02 | 2 | 9 |
| LBY180 | 0.84 | 8.94E−03 | 2 | 34 | LBY181 | 0.71 | 4.92E−02 | 1 | 39 |
| LBY181 | 0.96 | 1.36E−04 | 1 | 40 | LBY181 | 0.83 | 1.65E−03 | 5 | 53 |
| LBY181 | 0.73 | 1.14E−02 | 5 | 45 | LBY181 | 0.72 | 1.25E−02 | 5 | 1 |
| LBY181 | 0.71 | 1.47E−02 | 5 | 35 | LBY181 | 0.71 | 1.39E−02 | 3 | 45 |
| LBY181 | 0.83 | 1.64E−03 | 3 | 19 | LBY181 | 0.79 | 3.65E−03 | 3 | 34 |
| LBY181 | 0.85 | 7.30E−03 | 2 | 28 | LBY181 | 0.86 | 6.00E−03 | 2 | 40 |
| LBY181 | 0.74 | 3.62E−02 | 2 | 30 | LBY182 | 0.95 | 3.69E−04 | 1 | 29 |
| LBY182 | 0.85 | 7.75E−03 | 1 | 20 | LBY182 | 0.86 | 2.69E−02 | 1 | 54 |
| LBY182 | 0.85 | 3.96E−03 | 6 | 47 | LBY182 | 0.76 | 1.87E−02 | 6 | 27 |
| LBY182 | 0.89 | 1.78E−02 | 6 | 44 | LBY182 | 0.79 | 1.17E−02 | 6 | 53 |
| LBY182 | 0.74 | 2.14E−02 | 6 | 26 | LBY182 | 0.92 | 5.34E−04 | 6 | 45 |
| LBY182 | 0.84 | 4.27E−03 | 6 | 19 | LBY182 | 0.76 | 1.81E−02 | 6 | 34 |
| LBY182 | 0.74 | 2.16E−02 | 6 | 35 | LBY182 | 0.79 | 3.95E−03 | 4 | 19 |
| LBY182 | 0.74 | 9.19E−02 | 3 | 44 | LBY183 | 0.78 | 2.33E−02 | 1 | 27 |
| LBY183 | 0.78 | 2.21E−02 | 1 | 26 | LBY183 | 0.82 | 6.89E−03 | 6 | 38 |
| LBY183 | 0.79 | 1.04E−02 | 6 | 27 | LBY183 | 0.82 | 7.05E−03 | 6 | 26 |
| LBY183 | 0.73 | 6.06E−02 | 3 | 46 | LBY183 | 0.80 | 3.43E−03 | 3 | 41 |
| LBY183 | 0.82 | 1.25E−02 | 2 | 27 | LBY183 | 0.86 | 6.42E−03 | 2 | 26 |
| LBY183 | 0.78 | 2.19E−02 | 2 | 34 | LBY183 | 0.71 | 4.92E−02 | 2 | 35 |
| LBY184 | 0.87 | 5.19E−03 | 1 | 53 | LBY184 | 0.72 | 1.25E−02 | 5 | 42 |
| LBY184 | 0.80 | 3.29E−03 | 4 | 53 | LBY184 | 0.83 | 1.56E−03 | 3 | 15 |
| LBY184 | 0.86 | 1.41E−02 | 3 | 46 | LBY184 | 0.85 | 9.88E−04 | 3 | 50 |
| LBY184 | 0.92 | 5.33E−05 | 3 | 41 | LBY184 | 0.79 | 4.00E−03 | 3 | 39 |
| LBY184 | 0.73 | 6.43E−02 | 3 | 48 | LBY184 | 0.90 | 1.80E−04 | 3 | 42 |
| LBY185 | 0.72 | 4.42E−02 | 1 | 45 | LBY185 | 0.79 | 1.86E−02 | 1 | 19 |
| LBY185 | 0.75 | 3.12E−02 | 1 | 35 | LBY185 | 0.77 | 4.10E−02 | 6 | 46 |
| LBY185 | 0.76 | 1.86E−02 | 6 | 38 | LBY185 | 0.70 | 1.56E−02 | 5 | 20 |
| LBY185 | 0.78 | 4.72E−03 | 4 | 20 | LBY186 | 0.79 | 1.98E−02 | 1 | 53 |
| LBY186 | 0.83 | 9.91E−03 | 1 | 45 | LBY186 | 0.83 | 1.12E−02 | 1 | 1 |
| LBY186 | 0.78 | 2.38E−02 | 1 | 19 | LBY186 | 0.88 | 4.41E−03 | 1 | 35 |
| LBY186 | 0.72 | 2.76E−02 | 6 | 36 | LBY186 | 0.77 | 1.49E−02 | 3 | 16 |
| LBY186 | 0.73 | 4.02E−02 | 2 | 34 | LBY186 | 0.77 | 2.69E−02 | 2 | 35 |
| LBY187 | 0.74 | 3.55E−02 | 1 | 50 | LBY187 | 0.70 | 7.74E−02 | 1 | 48 |
| LBY187 | 0.74 | 3.64E−02 | 1 | 49 | LBY187 | 0.76 | 2.81E−02 | 1 | 42 |
| LBY187 | 0.72 | 2.76E−02 | 6 | 26 | LBY187 | 0.75 | 1.92E−02 | 6 | 35 |
| LBY187 | 0.72 | 1.20E−02 | 4 | 23 | LBY187 | 0.72 | 1.28E−02 | 3 | 4 |
| LBY187 | 0.72 | 1.30E−02 | 3 | 6 | LBY187 | 0.73 | 1.15E−02 | 3 | 32 |
| LBY188 | 0.88 | 3.94E−03 | 1 | 8 | LBY188 | 0.73 | 4.02E−02 | 1 | 10 |
| LBY188 | 0.80 | 5.36E−02 | 1 | 44 | LBY188 | 0.87 | 4.68E−03 | 1 | 17 |
| LBY188 | 0.87 | 4.68E−03 | 1 | 14 | LBY188 | 0.72 | 4.43E−02 | 1 | 40 |
| LBY188 | 0.73 | 6.05E−02 | 1 | 13 | LBY188 | 0.86 | 5.58E−03 | 1 | 24 |
| LBY188 | 0.71 | 3.33E−02 | 6 | 45 | LBY188 | 0.76 | 1.75E−02 | 6 | 1 |
| LBY188 | 0.72 | 2.77E−02 | 6 | 19 | LBY188 | 0.80 | 5.69E−02 | 4 | 44 |
| LBY188 | 0.83 | 2.13E−02 | 4 | 48 | LBY188 | 0.74 | 9.54E−03 | 3 | 3 |
| LBY188 | 0.77 | 8.80E−03 | 3 | 13 | LBY188 | 0.79 | 4.11E−03 | 3 | 30 |
| LBY188 | 0.75 | 3.34E−02 | 2 | 3 | LBY188 | 0.77 | 4.33E−02 | 2 | 13 |
| LBY189 | 0.74 | 2.17E−02 | 6 | 4 | LBY189 | 0.83 | 5.86E−03 | 6 | 9 |
| LBY189 | 0.75 | 8.77E−02 | 5 | 54 | LBY189 | 0.77 | 5.62E−03 | 4 | 8 |
| LBY189 | 0.78 | 8.05E−03 | 3 | 13 | LBY189 | 0.71 | 4.78E−02 | 2 | 3 |
| LBY189 | 0.85 | 1.56E−02 | 2 | 13 | LBY190 | 0.71 | 5.07E−02 | 1 | 23 |
| LBY190 | 0.96 | 1.10E−04 | 1 | 6 | LBY190 | 0.83 | 1.15E−02 | 1 | 31 |
| LBY190 | 0.89 | 3.09E−03 | 1 | 32 | LBY190 | 0.84 | 9.33E−03 | 1 | 5 |
| LBY190 | 0.75 | 1.97E−02 | 6 | 28 | LBY190 | 0.82 | 7.39E−03 | 6 | 9 |
| LBY190 | 0.75 | 2.02E−02 | 6 | 1 | LBY190 | 0.80 | 9.52E−03 | 6 | 30 |
| LBY190 | 0.72 | 1.23E−02 | 3 | 28 | LBY190 | 0.79 | 3.98E−03 | 3 | 3 |
| LBY190 | 0.81 | 4.78E−03 | 3 | 13 | LBY190 | 0.78 | 4.59E−03 | 3 | 30 |
| LBY190 | 0.87 | 4.70E−03 | 2 | 3 | LBY190 | 0.98 | 5.75E−05 | 2 | 13 |
| LBY191 | 0.75 | 3.13E−02 | 1 | 51 | LBY191 | 0.82 | 1.34E−02 | 1 | 53 |

TABLE 58-continued

Correlation between the expression level of selected genes of some embodiments of the invention in various tissues and the phenotypic performance under drought conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LBY191 | 0.72 | 4.31E−02 | 1 | 45 | LBY191 | 0.79 | 1.87E−02 | 1 | 1 |
| LBY191 | 0.84 | 8.80E−03 | 1 | 35 | LBY191 | 0.82 | 6.53E−03 | 6 | 38 |
| LBY191 | 0.74 | 8.59E−03 | 4 | 10 | LBY191 | 0.78 | 4.93E−03 | 4 | 20 |
| LBY191 | 0.82 | 2.10E−03 | 3 | 52 | LBY191 | 0.74 | 3.41E−02 | 2 | 4 |
| LBY191 | 0.77 | 2.65E−02 | 2 | 9 | LBY192 | 0.73 | 4.05E−02 | 1 | 43 |
| LBY192 | 0.73 | 1.00E−01 | 1 | 54 | LBY192 | 0.90 | 1.07E−03 | 6 | 38 |
| LBY192 | 0.80 | 9.14E−03 | 6 | 27 | LBY192 | 0.82 | 7.34E−03 | 6 | 26 |
| LBY192 | 0.71 | 1.13E−01 | 5 | 44 | LBY192 | 0.76 | 6.75E−03 | 3 | 52 |
| LBY192 | 0.82 | 1.99E−03 | 3 | 41 | LBY192 | 0.74 | 8.87E−03 | 3 | 39 |
| LBY192 | 0.74 | 3.75E−02 | 2 | 51 | LGN3 | 0.88 | 3.72E−03 | 1 | 28 |
| LGN3 | 0.73 | 4.03E−02 | 1 | 51 | LGN3 | 0.86 | 6.27E−03 | 1 | 30 |
| LGN3 | 0.76 | 1.64E−02 | 6 | 38 | LGN3 | 0.88 | 1.52E−03 | 6 | 27 |
| LGN3 | 0.82 | 6.21E−03 | 6 | 26 | LGN3 | 0.72 | 1.30E−02 | 3 | 8 |
| LGN3 | 0.75 | 8.03E−03 | 3 | 15 | LGN3 | 0.71 | 1.50E−02 | 3 | 12 |
| LGN3 | 0.76 | 7.20E−03 | 3 | 50 | LGN3 | 0.89 | 1.72E−02 | 3 | 44 |
| LGN3 | 0.73 | 1.09E−02 | 3 | 17 | LGN3 | 0.80 | 3.06E−03 | 3 | 41 |
| LGN3 | 0.73 | 1.09E−02 | 3 | 14 | LGN3 | 0.82 | 1.88E−03 | 3 | 39 |
| LGN3 | 0.85 | 8.72E−04 | 3 | 42 | LGN3 | 0.77 | 2.55E−02 | 2 | 51 |
| LGN4 | 0.71 | 4.97E−02 | 1 | 28 | LGN4 | 0.71 | 1.50E−02 | 5 | 7 |
| LGN4 | 0.70 | 1.56E−02 | 5 | 20 | LGN4 | 0.70 | 1.62E−02 | 5 | 33 |
| LGN4 | 0.70 | 1.62E−02 | 3 | 12 | LGN4 | 0.77 | 5.28E−03 | 3 | 50 |
| LGN4 | 0.99 | 1.78E−04 | 3 | 44 | LGN4 | 0.75 | 7.88E−03 | 3 | 17 |
| LGN4 | 0.75 | 7.88E−03 | 3 | 14 | LGN4 | 0.79 | 3.56E−03 | 3 | 48 |
| LGN4 | 0.81 | 2.41E−03 | 3 | 49 | LGN4 | 0.76 | 6.50E−03 | 3 | 42 |
| LGN4 | 0.85 | 7.50E−03 | 2 | 51 | LGN5 | 0.71 | 1.43E−02 | 5 | 9 |
| LGN5 | 0.76 | 6.50E−03 | 3 | 25 | LGN5 | 0.73 | 1.14E−02 | 3 | 23 |
| LGN5 | 0.79 | 4.19E−03 | 3 | 47 | LGN5 | 0.74 | 9.07E−02 | 3 | 54 |
| LGN5 | 0.73 | 1.11E−02 | 3 | 34 | LGN5 | 0.76 | 2.98E−02 | 2 | 53 |
| LGN5 | 0.75 | 5.24E−02 | 2 | 13 | LGN54 | 0.80 | 1.78E−02 | 1 | 28 |
| LGN54 | 0.76 | 2.84E−02 | 1 | 47 | LGN54 | 0.85 | 7.90E−03 | 1 | 45 |
| LGN54 | 0.87 | 5.22E−03 | 1 | 19 | LGN54 | 0.73 | 3.90E−02 | 1 | 34 |
| LGN54 | 0.86 | 6.68E−03 | 1 | 30 | LGN54 | 0.85 | 9.63E−04 | 4 | 40 |
| LGN54 | 0.77 | 5.29E−03 | 3 | 25 | LGN54 | 0.84 | 1.26E−03 | 3 | 23 |
| LGN54 | 0.77 | 2.62E−02 | 2 | 23 | LGN57 | 0.92 | 1.15E−03 | 1 | 20 |
| LGN57 | 0.76 | 4.97E−02 | 6 | 46 | LGN57 | 0.74 | 2.31E−02 | 6 | 50 |
| LGN57 | 0.74 | 2.25E−02 | 6 | 43 | LGN57 | 0.92 | 1.16E−03 | 6 | 16 |
| LGN57 | 0.86 | 2.78E−02 | 6 | 54 | LGN57 | 0.72 | 6.69E−02 | 6 | 48 |
| LGN57 | 0.72 | 3.02E−02 | 6 | 49 | LGN57 | 0.83 | 5.69E−03 | 5 | 16 |
| LGN57 | 0.71 | 1.53E−02 | 4 | 21 | LGN57 | 0.78 | 4.74E−03 | 3 | 10 |
| LGN57 | 0.73 | 1.06E−02 | 3 | 15 | LGN57 | 0.82 | 2.25E−02 | 3 | 46 |
| LGN57 | 0.73 | 1.16E−02 | 3 | 7 | LGN57 | 0.74 | 9.12E−03 | 3 | 33 |
| LGN57 | 0.71 | 1.36E−02 | 3 | 21 | LGN57 | 0.93 | 2.55E−05 | 3 | 2 |
| LGN57 | 0.76 | 2.80E−02 | 2 | 6 | LGN57 | 0.77 | 2.55E−02 | 2 | 32 |
| LGN57 | 0.74 | 3.57E−02 | 2 | 3 | LGN6 | 0.82 | 4.74E−02 | 1 | 16 |
| LGN6 | 0.75 | 8.38E−02 | 6 | 44 | LGN6 | 0.83 | 1.16E−02 | 6 | 13 |
| LGN6 | 0.79 | 4.21E−03 | 4 | 50 | LGN6 | 0.79 | 6.37E−02 | 4 | 44 |
| LGN6 | 0.85 | 9.65E−04 | 4 | 41 | LGN6 | 0.84 | 1.36E−03 | 4 | 39 |
| LGN6 | 0.73 | 6.14E−02 | 4 | 48 | LGN6 | 0.73 | 1.03E−02 | 4 | 49 |
| LGN6 | 0.89 | 2.77E−04 | 4 | 42 | LGN6 | 0.76 | 6.16E−03 | 3 | 41 |
| LGN6 | 0.78 | 4.71E−03 | 3 | 39 | LGN6 | 0.84 | 1.32E−03 | 3 | 42 |
| LGN7 | 0.80 | 1.72E−02 | 1 | 8 | LGN7 | 0.94 | 5.46E−04 | 1 | 10 |
| LGN7 | 0.83 | 1.16E−02 | 1 | 12 | LGN7 | 0.76 | 2.78E−02 | 1 | 50 |
| LGN7 | 0.87 | 2.36E−02 | 1 | 44 | LGN7 | 0.84 | 8.42E−03 | 1 | 17 |
| LGN7 | 0.84 | 8.42E−03 | 1 | 14 | LGN7 | 0.73 | 3.82E−02 | 1 | 20 |
| LGN7 | 0.75 | 5.39E−02 | 1 | 48 | LGN7 | 0.76 | 2.92E−02 | 1 | 49 |
| LGN7 | 0.79 | 3.47E−02 | 6 | 46 | LGN7 | 0.78 | 6.89E−02 | 6 | 44 |
| LGN7 | 0.73 | 2.60E−02 | 6 | 17 | LGN7 | 0.73 | 2.60E−02 | 6 | 14 |
| LGN7 | 0.72 | 2.84E−02 | 6 | 42 | LGN7 | 0.74 | 9.91E−02 | 5 | 28 |
| LGN7 | 0.72 | 1.29E−02 | 5 | 25 | LGN7 | 0.75 | 8.48E−02 | 5 | 54 |
| LGN7 | 0.72 | 1.97E−02 | 5 | 13 | LGN7 | 0.73 | 1.11E−02 | 5 | 1 |
| LGN7 | 0.88 | 3.35E−04 | 5 | 30 | LGN7 | 0.74 | 9.26E−03 | 4 | 22 |
| LGN7 | 0.71 | 1.40E−02 | 3 | 4 | LGN7 | 0.72 | 1.29E−02 | 3 | 25 |
| LGN7 | 0.72 | 1.23E−02 | 3 | 47 | | | | | |

Table 58. Provided are the correlations (R) between the genes expression levels in various tissues and the phenotypic performance. "Corr. ID"—correlation set ID according to the correlated parameters specified in Table 52. "Exp. Set"—Expression set specified in Table 51. "R" = Pearson correlation coefficient; "P" = p value.

Example 9

Production of Sorghum Transcriptome and High Throughput Correlation Analysis with Yield, Drought and Lown Related Parameters Measured in Fields Using 65K Sorghum Oligonucleotide Micro-Arrays In order to produce a high throughput correlation analysis between plant phenotype and gene expression level, the present inventors utilized a sorghum oligonucleotide micro-array, produced by Agilent Technologies [World Wide Web (dot) chem. (dot) agilent (dot) com/Scripts/PDS (dot) asp?1Page=50879]. The array oligonucleotide represents about 65,000 sorghum genes and transcripts. In order to define correlations between the levels of RNA expression with ABST, drought, low N and yield components or vigor related parameters, various plant characteristics of 36 different sorghum inbreds and hybrids were analyzed under normal (regular) conditions, 35 sorghum lines were analyzed under drought conditions and 34 sorghum lines were analyzed under low N (nitrogen) conditions. All the lines were sent for RNA expression analysis. The correlation between the RNA levels and the characterized parameters was analyzed using Pearson correlation test [World Wide Web (dot) davidmlane (dot) com/hyperstat/A34739 (dot) html].

Experimental Procedures

36 Sorghum varieties were grown in 5 repetitive plots, in field. Briefly, the growing protocol was as follows:

1. Regular growth conditions: sorghum plants were grown in the field using commercial fertilization and irrigation protocols, which include 549 $m^3$ water per dunam (1000 square meters) per entire growth period and fertilization of 16 units of URAN® 21% (Nitrogen Fertilizer Solution; PCS Sales, Northbrook, Ill., USA) (normal growth conditions).

2. Drought conditions: sorghum seeds were sown in soil and grown under normal condition until vegetative stage (49 days from sowing), drought treatment was imposed by irrigating plants with approximately 60% of the water applied for the normal treatment [315 $m^3$ water per dunam (1000 square meters) per entire growth period].

3. Low Nitrogen fertilization conditions: sorghum plants were sown in soil and irrigated with as the normal conditions (549 $m^3$ water per dunam (1000 square meters) per entire growth period). No fertilization of nitrogen was applied, whereas other elements were fertilized as in the normal conditions.

Analyzed Sorghum tissues—All 36 Sorghum inbreds and hybrids were sample per each of the treatments. Tissues [Flag leaf and root] representing different plant characteristics, were sampled and RNA was extracted as described above. Each micro-array expression information tissue type has received a Set ID as summarized in Table 59 below.

TABLE 59

Sorghum transcriptome expression sets in field experiment

| Expression Set | Set ID |
|---|---|
| Flag leaf at grain filling stage under normal conditions | 1 |
| Root at seedling stage under normal conditions | 2 |
| Flag leaf at grain filling stage under drought conditions | 3 |
| Flag leaf at grain filling stage under low nitrogen conditions | 4 |

Table 59: Provided are the sorghum transcriptome expression sets. Flag leaf = the leaf below the flower.

Sorghum yield components and vigor related parameters assessment—Plants were phenotyped as shown in Tables 60-61 below. Some of the following parameters were collected using digital imaging system:

Grains yield per dunam (kg)—At the end of the growing period all heads were collected (harvest). Heads were separately threshed and grains were weighted (grain yield). Grains yield per dunam was calculated by multiplying grain yield per $m^2$ by 1000 (dunam is 1000 $m^2$).

Grains yield per plant (plot) (gr)—At the end of the growing period all heads were collected (harvest). Heads were separately threshed and grains were weighted (grain yield). The average grain weight per plant was calculated by dividing the grain yield by the number of plants per plot.

Grains yield per head (gr)—At the end of the growing period all heads were collected (harvest). Heads were separately threshed and grains were weighted (grain yield. Grains yield per head was calculated by dividing the grain yield by the number of heads.

Main head grains yield per plant (gr)—At the end of the growing period all plants were collected (harvest). Main heads were threshed and grains were weighted. Main head grains yield per plant was calculated by dividing the grain yield of the main heads by the number of plants.

Secondary heads grains yield per plant (gr)—At the end of the growing period all plants were collected (harvest). Secondary heads were threshed and grains were weighted. Secondary heads grain yield per plant was calculated by dividing the grain yield of the secondary heads by the number of plants.

Heads dry weight per dunam (kg)—At the end of the growing period heads of all plants were collected (harvest). Heads were weighted after oven dry (dry weight).

Heads dry weight per dunam was calculated by multiplying grain yield per $m^2$ by 1000 (dunam is 1000 $m^2$).

Average heads weight per plant at flowering (gr)—At flowering stage heads of 4 plants per plot were collected. Heads were weighted after oven dry (dry weight), and divided by the number of plants.

Leaf carbon isotope discrimination at harvest (%)—isotopic ratio of $^{13}C$ to $^{12}C$ in plant tissue was compared to the isotopic ratio of $^{13}C$ to $^{12}C$ in the atmosphere Yield per dunam/water until maturity (kg/lit)—was calculated according to Formula XXXXII (above).

Vegetative dry weight per plant/water until maturity (gr/lit)—was calculated according to Formula XXXXIII above.

Total dry matter per plant at harvest/water until maturity (gr/lit)—was calculated according to Formula XXXXIV above.

Yield/SPAD at grain filling (kg/SPAD units) was calculated according to Formula XXXXVII above.

Grains number per dunam (num)—Grains yield per dunam divided by the average 1000 grain weight.

Grains per plant (num)—Grains yield per plant divided by the average 1000 grain weight.

Main head grains num per plant (num)—main head grain yield divided by the number of plants.

1000 grain weight (gr)—was calculated according to Formula XIV above.

Grain area (cm$^2$)—At the end of the growing period the grains were separated from the head (harvest). A sample of ~200 grains were weighted, photographed and images were processed using the below described image processing system. The grain area was measured from those images and was divided by the number of grains.

Grain fill duration (num)—Duration of grain filling period was calculated by subtracting the number of days to flowering from the number of days to maturity.

Grain fill duration (GDD)—Duration of grain filling period according to the growing degree units (GDD) method. The accumulated GDD during the grain filling period was calculated by subtracting the Num days to Anthesis (GDD) from Num days to Maturity (GDD).

Yield per dunam filling rate (kg/day)—was calculated according to Formula XXXIX (using grain yield per dunam).

Yield per plant filling rate (gr/day)—was calculated according to Formula XXXIX (using grain yield per plant).

Head area (cm$^2$)—At the end of the growing period (harvest) 6 plants main heads were photographed and images were processed using the below described image processing system. The head area was measured from those images and was divided by the number of plants.

Number days to flag leaf senescence (num)—the number of days from sowing till 50% of the plot arrives to Flag leaf senescence (above half of the leaves are yellow).

Number days to flag leaf senescence (GDD)—Number days to flag leaf senescence according to the growing degree units method. The accumulated GDD from sowing until flag leaf senescence.

% yellow leaves number at flowering (percentage)—At flowering stage, leaves of 4 plants per plot were collected. Yellow and green leaves were separately counted. Percent of yellow leaves at flowering was calculated for each plant by dividing yellow leaves number per plant by the overall number of leaves per plant and multiplying by 100.

% yellow leaves number at harvest (percentage)—At the end of the growing period (harvest) yellow and green leaves from 6 plants per plot were separately counted. Percent of the yellow leaves was calculated per each plant by dividing yellow leaves number per plant by the overall number of leaves per plant and multiplying by 100.

Leaf temperature at flowering (° celsius)—Leaf temperature was measured at flowering stage using Fluke IR thermometer 568 device. Measurements were done on 4 plants per plot on an open flag leaf.

Specific leaf area at flowering (cm$^2$/gr)—was calculated according to Formula XXXVII above.

Flag leaf thickness at flowering (mm)—At the flowering stage, flag leaf thickness was measured for 4 plants per plot. Micrometer was used to measure the thickness of a flag leaf at an intermediate position between the border and the midrib.

Relative water content at flowering (percentage)—was calculated based on Formula I above.

Leaf water content at flowering (percentage)—was calculated based on Formula XXXXIX above.

Stem water content at flowering (percentage)—was calculated based on Formula XXXXVIII above.

Total heads per dunam at harvest (number)—At the end of the growing period the total number of heads per plot was counted (harvest). Total heads per dunam was calculated by multiplying heads number per m$^2$ by 1000 (dunam is 1000 m$^2$).

Heads per plant (num)—At the end of the growing period total number of heads were counted and divided by the total number plants.

Tillering per plant (num)—Tillers of 6 plants per plot were counted at harvest stage and divided by the number of plants.

Harvest index (plot) (ratio)—The harvest index was calculated using Formula LVIII above.

Heads index (ratio)—Heads index was calculated using Formula XXXXVI above.

Total dry matter per plant at flowering (gr)—Total dry matter per plant was calculated at flowering. The vegetative portion above ground and all the heads dry weight of 4 plants per plot were summed and divided by the number of plants.

Total dry matter per plant (kg)—Total dry matter per plant at harvest was calculated by summing the average head dry weight and the average vegetative dry weight of 6 plants per plot.

Vegetative dry weight per plant at flowering (gr)—At the flowering stage, vegetative material (excluding roots) of 4 plants per plot were collected and weighted after (dry weight) oven dry. The biomass per plant was calculated by dividing total biomass by the number of plants.

Vegetative dry weight per plant (kg)—At the harvest stage, all vegetative material (excluding roots) were collected and weighted after (dry weight) oven dry.

Vegetative dry weight per plant was calculated by dividing the total biomass by the number of plants.

Plant height growth (cm/day)—The relative growth rate (RGR) of plant height was calculated based on Formula III above.

% Canopy coverage at flowering (percentage)—The % Canopy coverage at flowering was calculated based on Formula XXXII above.

PAR_LAI (Photosynthetic active radiance—Leaf area index)—Leaf area index values were determined using an AccuPAR Ceptometer Model LP-80 and measurements were performed at flowering stage with three measurements per plot.

Leaves area at flowering (cm$^2$)—Green leaves area of 4 plants per plot was measured at flowering stage. Measurement was performed using a Leaf area-meter.

SPAD at vegetative stage (SPAD unit)—Chlorophyll content was determined using a Minolta SPAD 502 chlorophyll meter and measurement was performed at vegetative stage. SPAD meter readings were done on fully developed leaves of 4 plants per plot by performing three measurements per leaf per plant.

SPAD at flowering (SPAD unit)—Chlorophyll content was determined using a Minolta SPAD 502 chlorophyll meter and measurement was performed at flowering stage. SPAD meter readings were done on fully developed leaves of 4 plants per plot by performing three measurements per leaf per plant.

SPAD at grain filling (SPAD unit)—Chlorophyll content was determined using a Minolta SPAD 502 chlorophyll meter and measurement was performed at grain filling stage. SPAD meter readings were done on fully developed leaves of 4 plants per plot by performing three measurements per leaf per plant.

RUE (Radiation use efficiency)—(gr/% canopy coverage)—Total dry matter produced per intercepted PAR at flowering stage was calculated by dividing the average total dry matter per plant at flowering by the percent of canopy coverage.

Lower stem width at flowering (mm)—Lower stem width was measured at the flowering stage. Lower internodes from 4 plants per plot were separated from the plant and their diameter was measured using a caliber.

Upper stem width at flowering (mm)—Upper stem width was measured at flowering stage. Upper internodes from 4 plants per plot were separated from the plant and their diameter was measured using a caliber.

All stem volume at flowering ($cm^3$)—was calculated based on Formula L above.

Number days to heading (num)—Number of days to heading was calculated as the number of days from sowing till 50% of the plot arrive heading.

Number days to heading (GDD)—Number days to heading according to the growing degree units method. The accumulated GDD from sowing until heading stage.

Number days to anthesis (num)—Number of days to flowering was calculated as the number of days from sowing till 50% of the plot arrive anthesis.

Number days to anthesis (GDD)—Number days to anthesis according to the growing degree units method. The accumulated GDD from sowing until anthesis stage.

Number days to maturity (GDD)—Number days to maturity according to the growing degree units method. The accumulated GDD from sowing until maturity stage.

N (Nitrogen) use efficiency (kg/kg)—was calculated based on Formula LI above.

Total NUtE—was calculated based on Formula LIII above.

Grain NUtE—was calculated based on Formula LV above.

NUpE (kg/kg)—was calculated based on Formula LII above.

N (Nitrogen) harvest index (Ratio)—was calculated based on Formula LVI above.

% N (Nitrogen) in shoot at flowering—% N content of dry matter in the shoot at flowering.

% N (Nitrogen) in head at flowering—% N content of dry matter in the head at flowering.

% N in (Nitrogen) shoot at harvest—% N content of dry matter in the shoot at harvest.

% N (Nitrogen) in grain at harvest—% N content of dry matter in the grain at harvest.

Data parameters collected are summarized in Tables 60-61 herein below.

TABLE 60

Sorghum correlated parameters under normal and low N conditions (vectors)

| Correlated parameter with | Correlation ID |
| --- | --- |
| % Canopy coverage (F) [%] | 1 |
| % yellow leaves number (F) [%] | 2 |
| % yellow leaves number (H) [%] | 3 |
| % N in grain (H) [%] | 4 |
| % N in head (F) [%] | 5 |
| % N in shoot (F) [%] | 6 |
| % N in shoot (H) [%] | 7 |
| 1000 grain weight [gr.] | 8 |
| All stem volume (F) [$cm^3$] | 9 |
| Average heads weight per plant (F) [gr.] | 10 |
| Flag Leaf thickness (F) [mm] | 11 |
| Grain N utilization efficiency [ratio] | 12 |
| Grain area [$cm^2$] | 13 |
| Grain fill duration [num] | 14 |
| Grain fill duration (GDD) | 15 |
| Grains yield per dunam [kg] | 16 |
| Grains yield per head (RP) [gr.] | 17 |

TABLE 60-continued

Sorghum correlated parameters under normal and low N conditions (vectors)

| Correlated parameter with | Correlation ID |
| --- | --- |
| Grains number per dunam [num] | 18 |
| Grains per plant (plot) [num] | 19 |
| Grains yield per plant (plot) [gr.] | 20 |
| Harvest index (plot) [ratio] | 21 |
| Head Area [$cm^2$] | 22 |
| Heads dry weight per dunam [kg] | 23 |
| Heads index (SP) [Ratio] | 24 |
| Heads per plant (RP) [num] | 25 |
| Leaf carbon isotope discrimination (H) (%) | 26 |
| Leaf temperature (F) [° C.] | 27 |
| Leaf water content (F) [%] | 28 |
| Leaves area (F) [$cm^2$] | 29 |
| Lower Stem width (F) [mm] | 30 |
| Main head grains num per plant [num] | 31 |
| Main head grains yield per plant [gr] | 32 |
| N harvest index [ratio] | 33 |
| N use efficiency [ratio] | 34 |
| Number days to Anthesis [num] | 35 |
| Number days to Anthesis (GDD) | 36 |
| Number days to Flag leaf senescence [num] | 37 |
| Number days to Flag leaf senescence (GDD) | 38 |
| Number days to Heading (GDD) | 39 |
| Number days to Maturity (GDD) | 40 |
| NupE (H) [ratio] | 41 |
| PAR_LAI (F) [$\mu mol\ m^{-2}\ S^{-1}$] | 42 |
| Plant height growth [cm/day] | 43 |
| RUE [gr./% canopy coverage] | 44 |
| RWC (F) [%] | 45 |
| SPAD (F) [SPAD unit] | 46 |
| SPAD (GF) [SPAD unit] | 47 |
| SPAD_(veg) [SPAD unit] | 48 |
| Secondary heads grains yield per plant [gr.] | 49 |
| Specific leaf area (F) [$cm^2/gr$] | 50 |
| Stem water content (F) [%] | 51 |
| TDM (F)/water until flowering [gr./lit] | 52 |
| TDM (SP)/water until maturity [kg/lit] | 53 |
| Tillering per plant (SP) [number] | 54 |
| Total Heads per dunam (H) [number] | 55 |
| Total N utilization efficiency (H) [ratio] | 56 |
| Total dry matter per plant (F) [gr.] | 57 |
| Total dry matter per plant (SP) [kg] | 58 |
| Upper Stem width (F) [mm] | 59 |
| VDW (F)/water until flowering [gr./lit] | 60 |
| VDW (SP)/water until maturity [gr./lit] | 61 |
| Vegetative DW per plant (F) [gr.] | 62 |
| Vegetative DW per plant (RP) [kg] | 63 |
| Yield per dunam filling rate [kg/day] | 64 |
| Yield per dunam/water until maturity [kg/ml] | 65 |
| Yield per plant filling rate [gr./day] | 66 |
| Yield/SPAD (GF) [ratio] | 67 |

Table 60. Provided are the Sorghum correlated parameters (vectors). "kg" = kilograms; "gr." = grams; "RP" = Rest of plot; "SP" = Selected plants; "lit" = liter; "ml" milliliter; "cm" = centimeter; "num" = number; "GDD" Growing degree day; "SPAD" = chlorophyll levels; "FW" = Plant Fresh weight; "DW" = Plant Dry weight; "GF" = grain filling growth stage; "F" = flowering stage; "H" = harvest stage; "N"—Nitrogen; "NupE"—Nitrogen uptake efficiency; "VDW" = vegetative dry weight; "TDM" = Total dry matter. "RUE" = radiation use efficiency; "RWC" relative water content; "veg" = vegetative stage.

TABLE 61

Sorghum correlated parameters under drought conditions (vectors)

| Correlated parameter with | Correlation ID |
| --- | --- |
| % Canopy coverage (F) [%] | 1 |
| % yellow leaves number (F) [%] | 2 |
| % yellow leaves number (H) [%] | 3 |
| 1000 grain weight [gr.] | 4 |
| All stem volume (F) [$cm^3$] | 5 |
| Average heads weight per plant (F) [gr.] | 6 |
| Flag Leaf thickness (F) [mm] | 7 |
| Grain area [$cm^2$] | 8 |
| Grain fill duration [number] | 9 |

TABLE 61-continued

Sorghum correlated parameters under drought conditions (vectors)

| Correlated parameter with | Correlation ID |
|---|---|
| Grain fill duration (GDD) | 10 |
| Grains yield per dunam [kg] | 11 |
| Grains yield per head (RP) [gr.] | 12 |
| Grains number per dunam [number] | 13 |
| Grains per plant (plot) [number] | 14 |
| Grains yield per plant (plot) [gr.] | 15 |
| Harvest index (plot) [ratio] | 16 |
| Head Area [cm$^2$] | 17 |
| Heads dry weight per dunam [kg] | 18 |
| Heads index (SP) [ratio] | 19 |
| Heads per plant (RP) [number] | 20 |
| Leaf carbon isotope discrimination (H) (%) | 21 |
| Leaf temperature (F) [° C.] | 22 |
| Leaf water content (F) [%] | 23 |
| Leaves area (F) [cm$^2$] | 24 |
| Lower Stem width (F) [mm] | 25 |
| Main head grains num per plant [num] | 26 |
| Main head grains yield per plant [gr.] | 27 |
| Number days to Anthesis [number] | 28 |
| Number days to Anthesis (GDD) | 29 |
| Number days to Flag leaf senescence [number] | 30 |
| Number days to Flag leaf senescence (GDD) | 31 |
| Number days to Heading (GDD) | 32 |
| Number days to Maturity (GDD) | 33 |
| PAR_LAI (F) [μmol m$^{-2}$ S$^{-1}$] | 34 |
| Plant height growth [cm/day] | 35 |
| RUE [gr./% canopy coverage] | 36 |
| RWC (F) [%] | 37 |
| SPAD (F) [SPAD unit] | 38 |
| SPAD (GF) [SPAD unit] | 39 |
| SPAD_(veg) [SPAD unit] | 40 |
| Secondary heads grains yield per plant [gr.] | 41 |
| Specific leaf area (F) [cm$^2$/gr.] | 42 |

TABLE 61-continued

Sorghum correlated parameters under drought conditions (vectors)

| Correlated parameter with | Correlation ID |
|---|---|
| Stem water content (F) [%] | 43 |
| TDM (F)/water until flowering [gr./lit] | 44 |
| TDM (SP)/water until maturity [kg/lit] | 45 |
| Tillering per plant (SP) [number] | 46 |
| Total Heads per dunam (H) [number] | 47 |
| Total dry matter per plant (F) [gr.] | 48 |
| Total dry matter per plant (SP) [kg] | 49 |
| Upper Stem width (F) [mm] | 50 |
| VDW (F)/water until flowering [gr./lit] | 51 |
| VDW (SP)/water until maturity [gr./lit] | 52 |
| Vegetative DW per plant (F) [gr.] | 53 |
| Vegetative DW per plant (RP) [kg] | 54 |
| Yield per dunam filling rate [kg/day] | 55 |
| Yield per dunam/water until maturity [kg/ml] | 56 |
| Yield per plant filling rate [gr./day] | 57 |
| Yield/SPAD (GF) [ratio] | 58 |

Table 61. Provided are the Sorghum correlated parameters (vectors). "kg" = kilograms; "gr." = grams; "RP" = Rest of plot; "SP" = Selected plants; "lit" = liter; "ml"—milliliter; "cm" = centimeter; "num" = number; "GDD"—Growing degree day; "SPAD" = chlorophyll levels; "FW" = Plant Fresh weight; "DW" = Plant Dry weight; "GF" = grain filling growth stage; "F" = flowering stage; "H" = harvest stage; "N"—Nitrogen; "NupE"—Nitrogen uptake efficiency; "VDW" = vegetative dry weight; "TDM" = Total dry matter. "RUE" = radiation use efficiency; "RWC" relative water content; "veg" = vegetative stage.

Experimental Results

Thirty-six different sorghum inbreds and hybrids lines were grown and characterized for different parameters (Tables 60-61). The average for each of the measured parameter was calculated using the JMP software (Tables 62-76) and a subsequent correlation analysis was performed (Tables 77-79). Results were then integrated to the database.

TABLE 62

Measured parameters in Sorghum accessions under normal conditions

| L/Corr. ID | L-1 | L-2 | L-3 | L-4 | L-5 | L-6 | L-7 |
|---|---|---|---|---|---|---|---|
| 1 | 87.281 | 90.111 | 75.670 | 75.599 | 76.138 | 69.928 | 84.375 |
| 2 | 0.144 | 0.244 | 0.080 | 0.134 | 0.274 | 0.132 | 0.101 |
| 3 | 0.265 | 0.157 | 0.323 | 0.389 | 0.323 | 0.095 | 0.139 |
| 4 | 1.910 | NA | 1.621 | 2.086 | NA | 1.594 | NA |
| 5 | 2.315 | NA | 2.722 | 1.844 | NA | 1.970 | NA |
| 6 | 1.729 | NA | 1.414 | 1.303 | NA | 1.602 | NA |
| 7 | 1.080 | NA | 0.559 | 0.722 | NA | 1.112 | NA |
| 8 | 29.796 | 32.044 | 33.782 | 31.335 | 29.964 | 24.146 | 18.356 |
| 9 | 23261.2 | 19941.6 | 14878.4 | 31092.4 | 39294.6 | 13029.4 | 33015.4 |
| 10 | 17.005 | 17.720 | 9.727 | 10.183 | 37.679 | 11.140 | 11.271 |
| 11 | 0.179 | 0.144 | 0.144 | 0.164 | 0.127 | 0.186 | 0.138 |
| 12 | 18.510 | NA | 35.872 | 31.063 | NA | 30.945 | NA |
| 13 | 0.119 | 0.133 | 0.130 | 0.136 | 0.130 | 0.105 | 0.092 |
| 14 | 35.0 | 32.4 | 31.0 | 32.4 | 27.6 | 32.8 | 23.4 |
| 15 | 459.6 | 407.9 | 396.8 | 423.6 | 358.8 | 414.6 | 305.6 |
| 16 | 818.9 | 893.2 | 861.8 | 912.8 | 661.8 | 612.2 | 421.0 |
| 17 | 30.311 | 32.849 | 25.408 | 21.427 | 37.294 | 33.226 | 17.030 |
| 18 | 27117640 | 27702000 | 25021020 | 29202780 | 21264980 | 25132460 | 20308520 |
| 19 | 2766.2 | 3370.4 | 3162.2 | 4531.2 | 3464.5 | 3570.4 | 2267.5 |
| 20 | 77.2 | 103.5 | 100.8 | 130.3 | 100.3 | 72.4 | 43.5 |
| 21 | 0.225 | 0.271 | 0.281 | 0.335 | 0.271 | 0.306 | 0.126 |
| 22 | 134.403 | 96.685 | 112.799 | 101.680 | 106.065 | 84.074 | 105.631 |
| 23 | 1.046 | 1.062 | 0.956 | 1.010 | 0.797 | 0.768 | 0.747 |
| 24 | 0.345 | 0.399 | 0.393 | 0.453 | 0.384 | 0.536 | 0.344 |
| 25 | 1.125 | 1.306 | 1.712 | 2.280 | 1.144 | 1.151 | 1.287 |
| 26 | −12.858 | −13.200 | −13.116 | −12.834 | −13.013 | −13.047 | −13.160 |
| 27 | 31.719 | 29.182 | 30.395 | 29.627 | 30.433 | 29.998 | 29.777 |
| 28 | 65.971 | NA | 74.090 | 71.840 | 63.293 | 77.500 | 70.016 |
| 29 | 16514.4 | 12058.4 | 12787.0 | 9932.2 | 11459.3 | 9116.4 | 9023.2 |
| 30 | 19.965 | 15.459 | 14.231 | 18.436 | 15.989 | 16.376 | 15.415 |
| 31 | 1322.3 | 1669.9 | 1615.1 | 1624.3 | 1784.3 | 1480.9 | 1008.7 |
| 32 | 38.221 | 53.811 | 55.644 | 51.041 | 53.356 | 35.979 | 19.751 |

TABLE 62-continued

Measured parameters in Sorghum accessions under normal conditions

| L/Corr. ID | L-1 | L-2 | L-3 | L-4 | L-5 | L-6 | L-7 |
|---|---|---|---|---|---|---|---|
| 33 | 0.354 | NA | 0.582 | 0.648 | NA | 0.493 | NA |
| 34 | 45.493 | 49.623 | 47.876 | 50.713 | 36.764 | 34.011 | 23.390 |
| 35 | 89.200 | 83.000 | 85.800 | 88.400 | 88.800 | 84.250 | 93.400 |
| 36 | 777.6 | 709.7 | 740.6 | 768.4 | 773.0 | 725.7 | 831.9 |
| 37 | 141.0 | 119.0 | 125.5 | 139.0 | 117.2 | NA | 126.8 |
| 38 | 1469.5 | 1165.8 | 1254.9 | 1441.2 | 1142.7 | NA | 1272.0 |
| 39 | 739.4 | 625.3 | 709.0 | 721.1 | 763.8 | 629.6 | 769.5 |
| 40 | 1237.2 | 1117.6 | 1137.4 | 1191.9 | 1131.7 | 1137.4 | 1137.4 |
| 41 | 1.913 | NA | 1.325 | 1.560 | NA | 1.101 | NA |
| 42 | 5.343 | 5.581 | 4.415 | 3.763 | 3.620 | 4.009 | 4.920 |
| 43 | 1.239 | 2.549 | 2.039 | 2.011 | 2.764 | 1.118 | 2.183 |
| 44 | 2.275 | 1.339 | 1.025 | 1.111 | 2.105 | 1.071 | 1.959 |
| 45 | 90.821 | 91.678 | 91.192 | 88.713 | 88.259 | 84.493 | 87.219 |
| 46 | 56.865 | 52.452 | 49.170 | 55.132 | 48.239 | 53.323 | 48.915 |
| 47 | 56.255 | 56.293 | 53.347 | 59.058 | 52.039 | 54.248 | 47.028 |
| 48 | 48.517 | 42.450 | 43.114 | 42.131 | 39.272 | 45.967 | 33.339 |
| 49 | 2.452 | 7.004 | 2.201 | 30.987 | 5.723 | 2.838 | 2.331 |
| 50 | 137.546 | 148.278 | 164.775 | 175.755 | 162.372 | 150.487 | 110.243 |
| 51 | 53.794 | 77.831 | 79.822 | 78.527 | 67.250 | 77.975 | 71.874 |
| 52 | 0.674 | 0.455 | 0.275 | 0.282 | 0.542 | 0.278 | 0.454 |
| 53 | 0.038 | 0.047 | 0.043 | 0.048 | 0.047 | 0.030 | 0.037 |
| 54 | 1.233 | 3.276 | 4.133 | 3.172 | 1.100 | 2.333 | 3.067 |
| 55 | 25950 | 25250 | 31350 | 37950 | 15918 | 16250 | 23200 |
| 56 | 91.317 | NA | 123.160 | 89.001 | NA | 93.670 | NA |
| 57 | 198.503 | 120.895 | 77.763 | 83.147 | 159.607 | 70.670 | 143.281 |
| 58 | 0.193 | 0.218 | 0.198 | 0.235 | 0.217 | 0.137 | 0.172 |
| 59 | 11.284 | 9.932 | 8.125 | 10.664 | 9.863 | 9.022 | 8.265 |
| 60 | 0.616 | 0.388 | 0.240 | 0.248 | 0.414 | 0.236 | 0.418 |
| 61 | 0.025 | 0.028 | 0.026 | 0.026 | 0.029 | 0.013 | 0.024 |
| 62 | 181.498 | 103.175 | 68.036 | 72.964 | 121.928 | 59.530 | 132.010 |
| 63 | 0.097 | 0.103 | 0.106 | 0.088 | 0.101 | 0.080 | 0.126 |
| 64 | 23.358 | 27.649 | 27.843 | 28.188 | 23.948 | 20.032 | 17.887 |
| 65 | 1.617 | 1.919 | 1.851 | 1.851 | 1.422 | 1.261 | 0.904 |
| 66 | 1.110 | 1.880 | 1.860 | 2.542 | 2.100 | 1.133 | 0.932 |
| 67 | 24.016 | 33.690 | 33.966 | 48.089 | 37.960 | 28.385 | 23.686 |

Table 62: Provided are the values of each of the parameters (as described above) measured in Sorghum accessions ("L" = Line) under normal conditions. Growth conditions are specified in the experimental procedure section.

TABLE 63

Measured parameters in additional Sorghum accessions under normal conditions

| L/Corr. ID | L-8 | L-9 | L-10 | L-11 | L-12 | L-13 | L-14 |
|---|---|---|---|---|---|---|---|
| 1 | NA | 89.502 | 95.076 | 92.841 | 67.342 | 80.367 | 72.241 |
| 2 | 0.000 | 0.061 | 0.145 | 0.130 | 0.183 | 0.096 | 0.121 |
| 3 | 0.166 | 0.578 | 0.550 | 0.321 | 0.231 | 0.040 | 0.129 |
| 4 | NA | 1.796 | NA | NA | NA | NA | NA |
| 5 | NA | 1.369 | NA | NA | NA | NA | NA |
| 6 | NA | 1.795 | NA | NA | NA | NA | NA |
| 7 | NA | 1.151 | NA | NA | NA | NA | NA |
| 8 | 22.636 | 23.197 | 17.265 | 26.974 | 24.677 | 22.564 | 16.849 |
| 9 | 9480.2 | 21372.2 | 57928.1 | 42021.2 | 15340.9 | 10035.2 | 20685.1 |
| 10 | 6.766 | 11.973 | 22.375 | 35.695 | 8.805 | 10.347 | 23.983 |
| 11 | NA | 0.179 | 0.150 | 0.206 | 0.178 | 0.197 | 0.173 |
| 12 | NA | 26.691 | NA | NA | NA | NA | NA |
| 13 | 0.119 | 0.098 | 0.086 | 0.116 | 0.105 | 0.103 | 0.083 |
| 14 | 37.0 | 32.4 | 20.8 | 35.2 | 37.4 | 41.0 | 29.3 |
| 15 | 433.9 | 425.1 | 285.1 | 479.2 | 478.2 | 528.2 | 401.3 |
| 16 | 154.3 | 663.3 | 457.0 | 473.8 | 257.0 | 664.8 | 297.9 |
| 17 | 8.572 | 27.917 | 30.839 | 39.469 | 9.213 | 29.013 | 15.133 |
| 18 | 6938386 | 26620980 | 23566280 | 16059440 | 10047874 | 24969700 | 15586667 |
| 19 | 883.9 | 3870.3 | 3226.6 | 3209.9 | 1567.8 | 2899.6 | 3451.8 |
| 20 | 18.7 | 89.4 | 57.3 | 86.9 | 37.1 | 67.9 | 62.4 |
| 21 | 0.172 | 0.295 | 0.062 | 0.177 | 0.168 | 0.291 | 0.150 |
| 22 | 226.157 | 156.424 | 120.418 | 210.453 | 121.302 | 74.783 | 244.476 |
| 23 | 0.241 | 0.850 | 0.588 | 0.613 | 0.495 | 0.846 | 0.336 |
| 24 | 0.414 | 0.485 | 0.127 | 0.310 | 0.476 | 0.443 | 0.322 |
| 25 | 1.038 | 1.397 | 0.950 | 1.002 | 1.317 | 1.256 | 1.428 |
| 26 | −13.473 | −12.825 | −12.990 | −13.379 | −12.587 | −13.140 | NA |

TABLE 63-continued

Measured parameters in additional Sorghum accessions under normal conditions

| L/Corr. ID | L-8 | L-9 | L-10 | L-11 | L-12 | L-13 | L-14 |
|---|---|---|---|---|---|---|---|
| 27 | NA | 29.518 | 31.398 | 28.672 | 29.792 | 29.705 | 29.464 |
| 28 | 70.199 | 73.164 | 71.107 | 69.660 | 80.116 | 75.597 | 70.564 |
| 29 | 3520.4 | 12434.2 | 18050.2 | 16771.2 | 7915.8 | 8866.2 | 18167.7 |
| 30 | 9.303 | 20.503 | 21.948 | 22.635 | 17.902 | 13.734 | 24.669 |
| 31 | 450.1 | 1979.2 | 1582.7 | 1734.6 | 932.8 | 1362.5 | 2390.5 |
| 32 | 9.952 | 46.648 | 28.461 | 46.906 | 22.198 | 31.058 | 43.412 |
| 33 | NA | 0.479 | NA | NA | NA | NA | NA |
| 34 | 8.574 | 36.852 | 25.390 | 26.320 | 14.279 | 36.932 | 16.553 |
| 35 | 77.750 | 90.200 | 119.000 | 107.000 | 83.800 | 84.000 | 113.333 |
| 36 | 650.1 | 790.9 | 1167.9 | 1008.4 | 719.1 | 721.1 | 1091.8 |
| 37 | 112.6 | 148.8 | 149.3 | 152.2 | 148.7 | 121.3 | 152.0 |
| 38 | 1078.8 | 1581.4 | 1588.7 | 1630.5 | 1580.3 | 1198.4 | 1628.1 |
| 39 | 630.5 | 756.2 | NA | 945.3 | 621.2 | 663.5 | 945.3 |
| 40 | 1084.0 | 1216.0 | 1453.0 | 1487.6 | 1197.2 | 1122.6 | 1493.0 |
| 41 | NA | 1.527 | NA | NA | NA | NA | NA |
| 42 | NA | 6.036 | 7.090 | 3.898 | 2.935 | 4.595 | 2.359 |
| 43 | 2.839 | 0.820 | 1.486 | 1.199 | 1.106 | 1.199 | 0.616 |
| 44 | NA | 1.213 | 3.128 | 2.504 | 1.093 | 0.853 | 3.219 |
| 45 | 91.501 | 83.981 | 85.877 | 89.036 | 85.516 | 88.043 | 89.730 |
| 46 | NA | 57.607 | 53.649 | 59.822 | 50.902 | 54.497 | 58.942 |
| 47 | 60.127 | 59.927 | 50.535 | 58.642 | 51.887 | 52.722 | 57.114 |
| 48 | 48.864 | 45.617 | 39.567 | 43.694 | 45.175 | 42.747 | 36.967 |
| 49 | 0.107 | 4.372 | 0.215 | NA | 2.750 | 1.468 | 0.700 |
| 50 | 191.109 | 123.281 | 143.880 | 118.611 | 171.938 | 154.855 | 121.095 |
| 51 | 83.448 | 72.340 | 74.514 | 63.236 | 76.242 | 75.934 | 56.029 |
| 52 | 0.123 | 0.354 | 0.619 | 0.581 | 0.259 | 0.265 | 0.514 |
| 53 | 0.014 | 0.033 | 0.074 | 0.044 | 0.028 | 0.022 | 0.045 |
| 54 | 1.433 | 2.933 | 1.700 | 2.233 | 3.267 | 2.133 | 1.941 |
| 55 | 17500 | 22300 | 14750 | 11450 | 24700 | 21250 | 18694 |
| 56 | NA | 88.485 | NA | NA | NA | NA | NA |
| 57 | 26.001 | 108.460 | 292.856 | 232.745 | 72.540 | 68.447 | 233.233 |
| 58 | 0.060 | 0.170 | 0.415 | 0.248 | 0.132 | 0.107 | 0.252 |
| 59 | 7.777 | 9.952 | 7.341 | 11.882 | 9.938 | 9.195 | 9.462 |
| 60 | 0.092 | 0.316 | 0.589 | 0.492 | 0.228 | 0.224 | 0.461 |
| 61 | 0.008 | 0.017 | 0.064 | 0.031 | 0.015 | 0.012 | 0.031 |
| 62 | 19.236 | 96.488 | 278.538 | 197.050 | 63.735 | 58.100 | 209.250 |
| 63 | 0.033 | 0.074 | 0.474 | 0.178 | 0.058 | 0.078 | 0.126 |
| 64 | 3.968 | 20.500 | 21.872 | 13.193 | 6.880 | 19.827 | 10.751 |
| 65 | 0.321 | 1.311 | 0.811 | 0.841 | 0.515 | 1.386 | 0.529 |
| 66 | 0.279 | 1.579 | 1.391 | 1.358 | 0.669 | 0.855 | 1.507 |
| 67 | 7.545 | 35.974 | 32.965 | 29.782 | 20.168 | 26.248 | 42.091 |

Table 63: Provided are the values of each of the parameters (as described above) measured in Sorghum accessions ("L" = Line) under normal conditions. Growth conditions are specified in the experimental procedure section.

TABLE 64

Measured parameters in additional Sorghum accessions under normal conditions

| L/Corr. ID | L-15 | L-16 | L-17 | L-18 | L-19 | L-20 | L-21 |
|---|---|---|---|---|---|---|---|
| 1 | 72.683 | 66.338 | 90.911 | 68.461 | 92.993 | 62.232 | 85.473 |
| 2 | 0.188 | 0.229 | 0.246 | 0.036 | 0.173 | 0.015 | 0.147 |
| 3 | 0.142 | 0.213 | 0.272 | 0.241 | 0.302 | 0.141 | 0.042 |
| 4 | NA | NA | NA | NA | NA | NA | NA |
| 5 | NA | NA | NA | NA | NA | NA | NA |
| 6 | NA | NA | NA | NA | NA | NA | NA |
| 7 | NA | NA | NA | NA | NA | NA | NA |
| 8 | 28.154 | 21.772 | 16.872 | 37.026 | 18.169 | 28.835 | 17.383 |
| 9 | 12649.4 | 15432.6 | 14500.7 | 26609.8 | 17621.5 | 13556.3 | 12018.1 |
| 10 | 9.566 | 14.145 | 7.660 | 24.738 | 24.100 | 13.475 | 16.594 |
| 11 | 0.169 | 0.195 | 0.144 | 0.209 | 0.162 | 0.204 | 0.189 |
| 12 | NA | NA | NA | NA | NA | NA | NA |
| 13 | 0.122 | 0.115 | 0.082 | 0.146 | 0.093 | 0.121 | 0.089 |
| 14 | 29.0 | 25.2 | 26.2 | 29.8 | 29.8 | 29.8 | 23.2 |
| 15 | 364.0 | 331.6 | 342.0 | 390.9 | 395.4 | 385.1 | 303.8 |
| 16 | 731.8 | 609.8 | 378.1 | 470.8 | 291.5 | 496.6 | 611.0 |
| 17 | 33.025 | 29.503 | 14.878 | 22.175 | 8.100 | 29.570 | 30.116 |
| 18 | 23737260 | 25534520 | 19319316 | 12802788 | 14629600 | 16643442 | 31788060 |
| 19 | 3187.1 | 3304.8 | 2184.2 | 2187.1 | 1951.8 | 2731.1 | 3818.6 |
| 20 | 88.0 | 72.9 | 39.1 | 76.0 | 37.0 | 75.9 | 67.5 |

TABLE 64-continued

Measured parameters in additional Sorghum accessions under normal conditions

| L/Corr. ID | L-15 | L-16 | L-17 | L-18 | L-19 | L-20 | L-21 |
|---|---|---|---|---|---|---|---|
| 21 | 0.324 | 0.322 | 0.187 | 0.179 | 0.110 | 0.351 | 0.264 |
| 22 | 82.036 | 106.139 | 129.335 | 86.311 | 83.329 | 114.026 | 90.007 |
| 23 | 0.860 | 0.762 | 0.646 | 0.602 | 0.619 | 0.523 | 0.717 |
| 24 | 0.472 | 0.519 | 0.302 | 0.326 | 0.278 | 0.508 | 0.350 |
| 25 | 1.092 | 0.995 | 1.238 | 1.530 | 2.057 | 1.029 | 1.125 |
| 26 | −12.993 | −12.733 | −13.153 | −13.293 | −13.003 | −13.193 | −12.820 |
| 27 | 31.278 | 31.219 | 30.157 | 30.914 | 28.892 | 30.677 | 30.455 |
| 28 | 75.275 | 63.086 | 71.865 | 76.103 | 66.483 | 78.473 | 76.381 |
| 29 | 16019.6 | 20833.0 | 13190.4 | 16299.6 | 12096.8 | 11573.2 | 11655.8 |
| 30 | 16.079 | 20.902 | 16.868 | 22.274 | 16.304 | 19.221 | 19.066 |
| 31 | 1554.3 | 1950.9 | 993.2 | 848.9 | 686.6 | 1329.0 | 1808.6 |
| 32 | 43.158 | 43.208 | 17.962 | 31.778 | 12.954 | 37.849 | 32.471 |
| 33 | NA | NA | NA | NA | NA | NA | NA |
| 34 | 40.655 | 33.876 | 21.007 | 26.157 | 16.195 | 27.587 | 33.944 |
| 35 | 84.600 | 98.000 | 90.600 | 94.250 | 101.750 | 88.200 | 94.400 |
| 36 | 728.4 | 892.5 | 795.5 | 843.1 | 940.9 | 769.5 | 845.1 |
| 37 | 124.6 | NA | NA | 152.0 | 146.5 | NA | 137.0 |
| 38 | 1242.8 | NA | NA | 1628.1 | 1548.8 | NA | 1412.0 |
| 39 | 697.4 | 853.3 | 728.4 | 755.8 | 892.4 | 655.3 | 763.8 |
| 40 | 1092.4 | 1224.1 | 1137.4 | 1234.0 | 1336.3 | 1154.5 | 1148.8 |
| 41 | NA | NA | NA | NA | NA | NA | NA |
| 42 | 3.761 | 3.525 | 6.377 | 3.866 | 3.975 | 3.048 | 4.783 |
| 43 | 1.410 | 0.857 | 0.899 | 1.223 | 1.516 | 0.728 | 0.672 |
| 44 | 1.057 | 2.424 | 0.892 | 3.957 | 1.631 | 1.325 | 2.274 |
| 45 | 91.944 | 91.411 | 83.596 | 90.879 | 87.878 | 90.201 | 89.471 |
| 46 | 52.616 | 49.062 | 53.885 | 61.513 | 51.442 | 51.583 | 47.937 |
| 47 | 54.250 | 49.787 | 54.842 | 61.803 | 54.223 | 55.648 | 51.650 |
| 48 | 45.100 | 42.950 | 40.211 | 42.363 | 31.746 | 49.622 | 41.847 |
| 49 | 0.947 | 0.253 | 5.632 | 10.957 | 5.365 | 5.890 | 1.704 |
| 50 | 179.108 | 183.038 | 159.180 | 157.503 | 111.333 | 163.526 | 142.593 |
| 51 | 82.154 | 54.697 | 76.659 | 48.349 | 62.765 | 81.034 | 29.074 |
| 52 | 0.259 | 0.445 | 0.270 | 0.791 | 0.409 | 0.257 | 0.557 |
| 53 | 0.028 | 0.025 | 0.027 | 0.045 | 0.028 | 0.028 | 0.028 |
| 54 | 1.800 | 1.367 | 1.893 | 4.500 | 5.125 | 2.700 | 1.100 |
| 55 | 19607 | 18300 | 23150 | 22688 | 43348 | 14874 | 18626 |
| 56 | NA | NA | NA | NA | NA | NA | NA |
| 57 | 74.384 | 153.130 | 81.275 | 258.144 | 151.944 | 76.769 | 187.014 |
| 58 | 0.130 | 0.126 | 0.126 | 0.226 | 0.158 | 0.132 | 0.132 |
| 59 | 8.001 | 11.433 | 7.689 | 12.311 | 6.849 | 10.761 | 7.708 |
| 60 | 0.226 | 0.404 | 0.244 | 0.715 | 0.344 | 0.212 | 0.508 |
| 61 | 0.015 | 0.012 | 0.019 | 0.031 | 0.018 | 0.013 | 0.019 |
| 62 | 64.818 | 138.985 | 73.615 | 233.406 | 127.844 | 63.294 | 170.420 |
| 63 | 0.078 | 0.058 | 0.052 | 0.144 | 0.131 | 0.055 | 0.080 |
| 64 | 25.244 | 24.209 | 14.898 | 15.893 | 10.411 | 16.378 | 27.151 |
| 65 | 1.572 | 1.204 | 0.812 | 0.943 | 0.527 | 1.067 | 1.313 |
| 66 | 1.500 | 1.718 | 0.814 | 1.448 | 0.627 | 1.519 | 1.498 |
| 67 | 28.845 | 39.385 | 20.533 | 19.312 | 18.413 | 27.835 | 36.209 |

Table 64: Provided are the values of each of the parameters (as described above) measured in Sorghum accessions ("L" = Line) under normal conditions. Growth conditions are specified in the experimental procedure section.

TABLE 65

Measured parameters in additional Sorghum accessions under normal conditions

| L/Corr. ID | L-22 | L-23 | L-24 | L-25 | L-26 | L-27 | L-28 |
|---|---|---|---|---|---|---|---|
| 1 | 76.025 | 92.104 | 88.446 | 62.175 | 54.728 | 94.411 | 57.550 |
| 2 | 0.043 | 0.125 | 0.245 | 0.128 | 0.114 | 0.327 | 0.077 |
| 3 | 0.059 | 0.413 | 0.788 | 0.188 | 0.152 | 0.635 | 0.139 |
| 4 | NA | NA | 1.542 | 1.604 | NA | NA | NA |
| 5 | NA | NA | 1.862 | 1.651 | NA | NA | NA |
| 6 | NA | NA | 0.795 | 1.293 | NA | NA | NA |
| 7 | NA | NA | 0.408 | 0.834 | NA | NA | NA |
| 8 | 21.378 | 27.975 | 27.046 | 28.951 | 20.937 | 29.442 | 22.508 |
| 9 | 8397.1 | 28819.2 | 52862.1 | 23299.4 | 8716.9 | NA | 18934.9 |
| 10 | 8.594 | 27.635 | 17.499 | 15.463 | 15.008 | NA | 20.314 |
| 11 | NA | 0.164 | 0.175 | 0.147 | 0.153 | 0.170 | 0.177 |
| 12 | NA | NA | 35.130 | 39.995 | NA | NA | NA |
| 13 | 0.103 | 0.129 | 0.116 | 0.129 | 0.103 | 0.125 | 0.112 |
| 14 | 40.6 | 35.2 | 25.0 | 31.6 | 33.0 | 20.4 | 28.6 |

TABLE 65-continued

Measured parameters in additional Sorghum accessions under normal conditions

| L/Corr. ID | L-22 | L-23 | L-24 | L-25 | L-26 | L-27 | L-28 |
|---|---|---|---|---|---|---|---|
| 15 | 500.3 | 476.6 | 343.1 | 415.1 | 423.7 | 268.2 | 363.8 |
| 16 | 307.6 | 221.0 | 685.9 | 792.0 | 449.8 | 626.1 | 497.1 |
| 17 | 13.291 | 8.403 | 37.595 | 48.252 | 25.124 | 31.626 | 30.856 |
| 18 | 13130962 | 6653443 | 23933120 | 24881460 | 19456260 | 19639820 | 21045320 |
| 19 | 2058.7 | 1109.8 | 3819.2 | 5346.8 | 2650.3 | 3204.7 | 3102.0 |
| 20 | 44.3 | 33.6 | 101.5 | 153.4 | 56.4 | 93.6 | 69.0 |
| 21 | 0.271 | 0.076 | 0.174 | 0.367 | 0.250 | 0.238 | 0.245 |
| 22 | 55.030 | 200.519 | 136.462 | 192.125 | 85.898 | 119.330 | 151.300 |
| 23 | 0.361 | 0.417 | 0.981 | 0.898 | 0.636 | 0.748 | 0.826 |
| 24 | 0.417 | 0.204 | 0.337 | 0.594 | 0.453 | 0.358 | 0.586 |
| 25 | 1.823 | 2.179 | 1.059 | 1.290 | 1.022 | 1.443 | 1.143 |
| 26 | −12.720 | −13.077 | −12.408 | −13.138 | −12.827 | −12.677 | −13.003 |
| 27 | 28.560 | 29.173 | 28.565 | 29.963 | 31.465 | 31.661 | 31.462 |
| 28 | NA | 67.303 | 69.978 | 68.160 | 72.923 | 67.295 | 76.050 |
| 29 | 6785.6 | 14171.8 | 21989.2 | 13038.3 | 10639.6 | NA | 14682.2 |
| 30 | 14.975 | 20.277 | 21.868 | 18.888 | 18.942 | 23.163 | 21.965 |
| 31 | 756.2 | 573.1 | 2299.1 | 3152.2 | 1392.1 | 1579.3 | 1438.0 |
| 32 | 16.799 | 17.540 | 62.192 | 89.345 | 29.968 | 46.760 | 33.521 |
| 33 | NA | NA | 0.542 | 0.641 | NA | NA | NA |
| 34 | 17.088 | 12.280 | 38.105 | 43.998 | 24.989 | 34.782 | 27.619 |
| 35 | 74.400 | 106.000 | 115.200 | 89.600 | 85.400 | 102.000 | 86.200 |
| 36 | 611.9 | 996.2 | 1115.4 | 782.2 | 736.1 | 945.3 | 745.5 |
| 37 | NA | 148.6 | 143.0 | 132.0 | NA | 150.8 | 113.0 |
| 38 | NA | 1579.1 | 1498.6 | 1343.5 | NA | 1610.7 | 1084.0 |
| 39 | 530.3 | 945.3 | 945.3 | 740.6 | 693.3 | 879.3 | 709.0 |
| 40 | 1112.2 | 1472.8 | 1458.5 | 1197.3 | 1159.8 | 1213.4 | 1109.2 |
| 41 | NA | NA | 1.211 | 1.089 | NA | NA | NA |
| 42 | 3.564 | 4.343 | 3.259 | 2.881 | 2.372 | 7.275 | 2.811 |
| 43 | 0.971 | 1.152 | 1.116 | 1.598 | 0.782 | 0.972 | 0.872 |
| 44 | 0.665 | 3.191 | 3.362 | 2.569 | 1.450 | NA | 1.450 |
| 45 | 94.615 | 88.734 | 89.247 | 89.338 | 90.476 | 91.910 | 91.291 |
| 46 | 52.657 | 54.712 | 52.455 | 57.742 | 53.535 | 50.162 | 54.922 |
| 47 | 47.168 | 55.997 | 52.395 | 57.607 | 56.565 | 52.338 | 54.393 |
| 48 | 40.922 | 35.689 | 41.167 | 43.278 | 44.881 | 40.239 | 42.969 |
| 49 | 4.103 | 1.835 | NA | 5.049 | 1.249 | NA | NA |
| 50 | 166.853 | 108.385 | 139.894 | 164.925 | 164.415 | NA | 156.660 |
| 51 | NA | 57.267 | 68.469 | 53.460 | 79.583 | NA | 84.561 |
| 52 | 0.242 | 0.722 | 0.627 | 0.457 | 0.251 | NA | 0.277 |
| 53 | 0.015 | 0.044 | 0.053 | 0.049 | 0.025 | 0.035 | 0.026 |
| 54 | 3.500 | 4.833 | 1.000 | 1.200 | 2.067 | 1.200 | 1.000 |
| 55 | 22218 | 27333 | 15850 | 13893 | 16300 | 17150 | 14650 |
| 56 | NA | NA | 169.680 | 105.928 | NA | NA | NA |
| 57 | 49.924 | 292.635 | 293.874 | 134.600 | 70.658 | NA | 81.484 |
| 58 | 0.068 | 0.249 | 0.298 | 0.240 | 0.119 | 0.176 | 0.123 |
| 59 | 8.244 | 8.408 | 11.429 | 10.412 | 9.618 | 11.290 | 11.574 |
| 60 | 0.200 | 0.654 | 0.589 | 0.405 | 0.198 | NA | 0.208 |
| 61 | 0.008 | 0.036 | 0.035 | 0.020 | 0.014 | 0.022 | 0.011 |
| 62 | 41.331 | 265.000 | 276.375 | 119.138 | 55.650 | NA | 61.170 |
| 63 | 0.062 | 0.234 | 0.219 | 0.087 | 0.064 | 0.153 | 0.089 |
| 64 | 7.551 | 6.500 | 27.784 | 25.602 | 13.995 | 30.555 | 17.432 |
| 65 | 0.661 | 0.392 | 1.217 | 1.618 | 0.958 | 1.253 | 1.068 |
| 66 | 0.515 | 0.579 | 2.497 | 2.901 | 0.923 | 2.422 | 1.173 |
| 67 | 20.552 | 11.458 | 43.991 | 53.278 | 25.074 | 31.330 | 26.607 |

Table 65: Provided are the values of each of the parameters (as described above) measured in Sorghum accessions ("L" = Line) under normal conditions. Growth conditions are specified in the experimental procedure section.

TABLE 66

Measured parameters in additional Sorghum accessions under normal conditions

| L-29 | L-30 | L-31 | L-32 | L-33 | L-34 | L-35 | L-36 |
|---|---|---|---|---|---|---|---|
| 85.797 | 88.767 | 92.567 | 87.286 | 81.636 | 90.129 | 66.243 | 82.308 |
| 0.090 | 0.127 | 0.300 | 0.171 | 0.033 | 0.087 | 0.240 | 0.131 |
| 0.000 | 0.018 | 0.168 | 0.256 | 0.117 | 0.148 | 0.226 | 0.263 |
| NA | NA | 1.841 | NA | NA | 1.557 | NA | 1.840 |
| NA | NA | 1.927 | NA | NA | 1.704 | NA | 2.047 |
| NA | NA | 1.324 | NA | NA | 1.235 | NA | 1.340 |
| NA | NA | 0.971 | NA | NA | 1.231 | NA | 0.631 |
| 25.949 | 28.407 | 26.752 | 21.833 | 25.432 | 23.457 | 22.609 | 28.331 |
| 14471.9 | 11682.4 | 12897.2 | 27195.9 | 18515.8 | 16533.5 | 14367.4 | 45771.7 |
| 14.808 | 12.239 | 9.899 | 29.627 | 37.964 | 17.009 | 18.987 | 24.612 |

TABLE 66-continued

Measured parameters in additional Sorghum accessions under normal conditions

| L-29 | L-30 | L-31 | L-32 | L-33 | L-34 | L-35 | L-36 |
|---|---|---|---|---|---|---|---|
| NA | NA | NA | 0.214 | 0.189 | 0.172 | 0.168 | 0.156 |
| NA | NA | 32.593 | NA | NA | 26.714 | NA | 19.842 |
| 0.110 | 0.120 | 0.111 | 0.102 | 0.111 | 0.109 | 0.104 | 0.116 |
| 42.5 | 42.5 | 40.2 | 26.8 | 32.5 | 30.0 | 31.4 | 33.4 |
| 525.9 | 525.9 | 493.6 | 352.0 | 425.1 | 394.9 | 413.3 | 438.2 |
| 693.9 | 663.0 | 668.8 | 861.9 | 904.6 | 757.3 | 874.2 | 653.2 |
| 35.499 | 35.632 | 29.956 | 55.999 | 52.706 | 46.218 | 48.680 | 27.175 |
| 25439325 | 22595225 | 23516220 | 35903040 | 35910300 | 30637940 | 37887500 | 22720400 |
| 3607.6 | 2713.3 | 3012.8 | 5869.7 | 5994.7 | 4733.1 | 4927.4 | 3710.2 |
| 91.9 | 74.1 | 80.3 | 130.1 | 122.6 | 108.7 | 112.8 | 99.9 |
| 0.358 | 0.345 | 0.316 | 0.284 | 0.312 | 0.307 | 0.308 | 0.135 |
| 115.146 | 141.714 | 99.027 | 174.094 | 245.323 | 194.992 | 180.424 | 136.020 |
| 0.816 | 0.810 | 0.845 | 1.027 | 1.014 | 0.968 | 1.139 | 0.787 |
| 0.545 | 0.583 | 0.549 | 0.466 | 0.556 | 0.464 | 0.472 | 0.223 |
| 1.152 | 1.124 | 1.215 | 1.060 | 1.142 | 1.100 | 1.000 | 1.458 |
| −13.360 | −13.000 | −13.074 | −12.850 | NA | −12.561 | −12.790 | −13.138 |
| 28.573 | 29.033 | 28.020 | 30.095 | 30.456 | 30.082 | 30.047 | 30.042 |
| NA | NA | NA | 52.561 | 44.281 | 35.418 | 75.142 | 65.973 |
| 10885.3 | 9702.0 | 12009.2 | 20599.4 | 16039.3 | 17728.8 | 17360.8 | 15975.6 |
| 17.356 | 16.629 | 15.102 | 21.631 | 20.556 | 19.409 | 15.657 | 20.886 |
| 1964.2 | 1191.6 | 1513.4 | 2925.2 | 3386.4 | 2454.2 | 2247.4 | 2021.1 |
| 50.815 | 34.030 | 40.866 | 65.669 | 79.769 | 57.320 | 62.729 | 56.619 |
| NA | NA | 0.600 | NA | NA | 0.416 | NA | 0.365 |
| 38.550 | 36.836 | 37.154 | 47.882 | 50.257 | 42.075 | 48.569 | 36.288 |
| 74.000 | 74.000 | 74.000 | 94.000 | 88.500 | 93.000 | 90.000 | 92.000 |
| 607.3 | 607.3 | 607.3 | 840.0 | 769.5 | 826.7 | 786.8 | 814.0 |
| NA | NA | NA | 146.2 | NA | NA | NA | 141.3 |
| NA | NA | NA | 1544.8 | NA | NA | NA | 1473.8 |
| 563.9 | 537.3 | 591.0 | 769.5 | 715.1 | 756.1 | 756.1 | 768.4 |
| 1133.1 | 1133.1 | 1100.8 | 1191.9 | 1194.6 | 1221.5 | 1200.0 | 1252.2 |
| NA | NA | 1.259 | NA | NA | 1.475 | NA | 1.753 |
| 4.767 | 4.959 | 5.747 | 6.056 | 5.245 | 6.680 | 3.387 | 4.763 |
| 1.023 | 0.956 | 0.985 | 0.836 | 1.123 | 0.878 | 0.941 | 1.778 |
| 0.815 | 0.635 | 0.635 | 4.936 | 4.053 | 3.010 | 2.100 | 2.885 |
| 92.400 | 91.807 | 91.379 | 87.241 | 87.942 | 85.656 | 90.903 | 92.520 |
| 53.863 | 60.083 | 51.130 | 49.700 | 57.019 | 55.100 | 53.853 | 53.908 |
| 51.479 | 54.694 | 50.473 | 54.407 | 55.754 | 53.633 | 52.791 | 55.657 |
| 43.450 | 47.839 | 43.086 | 44.086 | 45.079 | 46.697 | 44.811 | 41.231 |
| 0.547 | 0.412 | 6.979 | 3.442 | 6.650 | 1.205 | NA | 7.502 |
| 173.345 | 151.866 | 167.177 | 104.022 | 82.278 | 66.905 | 172.576 | 131.264 |
| NA | NA | NA | 20.553 | 37.994 | 37.398 | 70.132 | 66.732 |
| 0.330 | 0.271 | 0.286 | 1.226 | 1.098 | 0.814 | 0.478 | 0.751 |
| 0.030 | 0.024 | 0.027 | 0.051 | 0.046 | 0.040 | 0.040 | 0.079 |
| 3.583 | 3.542 | 2.893 | 2.167 | 1.000 | 1.067 | 1.133 | 2.733 |
| 19875 | 17979 | 21600 | 14064 | 16583 | 15400 | 16500 | 21250 |
| NA | NA | 91.382 | NA | NA | 88.568 | NA | 129.502 |
| 68.156 | 56.023 | 59.009 | 403.078 | 323.425 | 264.537 | 140.877 | 231.139 |
| 0.141 | 0.110 | 0.128 | 0.250 | 0.227 | 0.198 | 0.198 | 0.397 |
| 10.101 | 8.910 | 8.771 | 10.075 | 11.503 | 8.806 | 8.564 | 10.101 |
| 0.258 | 0.212 | 0.238 | 1.136 | 0.969 | 0.761 | 0.414 | 0.672 |
| 0.014 | 0.012 | 0.013 | 0.027 | 0.020 | 0.022 | 0.021 | 0.061 |
| 53.348 | 43.784 | 49.111 | 373.451 | 285.461 | 247.528 | 121.890 | 206.527 |
| 0.056 | 0.062 | 0.074 | 0.128 | 0.072 | 0.083 | 0.083 | 0.283 |
| 16.317 | 15.588 | 16.523 | 32.231 | 27.382 | 25.113 | 27.842 | 20.006 |
| 1.491 | 1.424 | 1.437 | 1.744 | 1.811 | 1.516 | 1.773 | 1.289 |
| 1.198 | 0.805 | 1.121 | 2.499 | 2.397 | 1.923 | 2.014 | 1.840 |
| 37.987 | 21.984 | 32.670 | 54.300 | 58.941 | 46.085 | 50.530 | 39.929 |

Table 66: Provided are the values of each of the parameters (as described above) measured in Sorghum accessions ("L" = Line) under normal conditions. Growth conditions are specified in the experimental procedure section

TABLE 67

Measured parameters in Sorghum accessions under drought conditions

| Line/Corr. ID | Line-1 | Line-2 | Line-3 | Line-4 | Line-5 | Line-6 | Line-7 |
|---|---|---|---|---|---|---|---|
| 1 | 78.352 | 78.010 | 71.044 | 63.415 | 69.908 | 73.119 | 77.679 |
| 2 | 0.265 | 0.395 | 0.250 | 0.227 | 0.572 | 0.118 | 0.259 |
| 3 | 0.482 | 0.689 | 0.627 | 0.645 | 0.648 | 0.499 | 0.407 |
| 4 | 27.439 | 28.686 | 34.531 | 28.119 | 25.842 | 22.918 | 17.494 |
| 5 | 13008 | 13795 | 11883 | 22788 | 31653 | 9741 | 19460 |
| 6 | 17.990 | 13.835 | 9.456 | 12.471 | 25.544 | 9.745 | 9.906 |

TABLE 67-continued

Measured parameters in Sorghum accessions under drought conditions

| Line/Corr. ID | Line-1 | Line-2 | Line-3 | Line-4 | Line-5 | Line-6 | Line-7 |
|---|---|---|---|---|---|---|---|
| 7 | 0.150 | 0.131 | 0.144 | 0.134 | 0.131 | 0.187 | 0.109 |
| 8 | 0.117 | 0.126 | 0.135 | 0.130 | 0.122 | 0.103 | 0.092 |
| 9 | 31.8 | 32.2 | 32.0 | 31.6 | 25.4 | 32.6 | 23.4 |
| 10 | 415.250 | 404.350 | 403.300 | 409.850 | 330.450 | 408.850 | 306.550 |
| 11 | 539.551 | 494.005 | 653.565 | 568.314 | 358.361 | 474.717 | 364.646 |
| 12 | 29.007 | 16.979 | 17.260 | 22.347 | 22.506 | 35.358 | 15.765 |
| 13 | 19183840 | 17265920 | 20151620 | 18904060 | 12652968 | 19240800 | 18560870 |
| 14 | 2226.7 | 2367.6 | 2602.6 | 3022.6 | 2051.1 | 2957.7 | 2089.8 |
| 15 | 59.176 | 62.690 | 77.535 | 82.570 | 53.302 | 67.111 | 37.943 |
| 16 | 0.212 | 0.219 | 0.273 | 0.306 | 0.194 | 0.360 | 0.126 |
| 17 | 102.633 | 79.927 | 82.531 | 78.496 | 72.276 | 72.389 | 81.281 |
| 18 | 0.705 | 0.617 | 0.724 | 0.630 | 0.492 | 0.548 | 0.568 |
| 19 | 0.337 | 0.344 | 0.381 | 0.450 | 0.332 | 0.558 | 0.317 |
| 20 | 0.991 | 1.898 | 2.072 | 1.700 | 1.085 | 1.008 | 0.980 |
| 21 | −13.414 | −13.017 | −13.382 | −13.459 | −13.873 | −13.370 | −13.373 |
| 22 | 31.247 | 32.383 | 33.132 | 31.790 | 30.903 | 30.877 | 30.608 |
| 23 | 62.944 | NA | 70.943 | 69.165 | 52.282 | 76.835 | 60.839 |
| 24 | 13806.8 | 10419.0 | 10992.0 | 10397.8 | 10516.7 | 6092.0 | 6199.8 |
| 25 | 18.287 | 14.355 | 14.355 | 19.096 | 16.932 | 14.936 | 14.148 |
| 26 | 1095.968 | 998.732 | 1092.335 | 1171.034 | 1082.701 | 1401.898 | 1073.967 |
| 27 | 30.359 | 29.024 | 37.874 | 32.879 | 28.818 | 32.257 | 19.801 |
| 28 | 89.6 | 82.6 | 83.4 | 87.4 | 90.6 | 82.2 | 95.0 |
| 29 | 784.8 | 704.9 | 714.2 | 757.7 | 795.5 | 700.4 | 853.3 |
| 30 | 130.5 | 114.2 | 114.0 | 122.4 | 114.2 | 126.7 | 121.4 |
| 31 | 1325.3 | 1100.8 | 1098.1 | 1213.0 | 1100.8 | 1274.7 | 1199.2 |
| 32 | 748.2 | 634.9 | 654.4 | 723.6 | 754.3 | 624.8 | 779.1 |
| 33 | 1200.0 | 1109.2 | 1117.5 | 1167.5 | 1125.9 | 1109.2 | 1159.8 |
| 34 | 4.029 | 3.966 | 3.795 | 3.048 | 3.039 | 3.921 | 3.843 |
| 35 | 0.878 | 2.066 | 1.571 | 1.326 | 1.870 | 1.130 | 2.069 |
| 36 | 2.156 | 1.293 | 1.270 | 1.381 | 2.127 | 0.784 | 1.403 |
| 37 | 83.152 | 84.266 | 86.926 | 81.749 | 82.840 | 89.485 | 77.472 |
| 38 | 52.365 | 49.910 | 45.253 | 50.397 | 43.083 | 51.762 | 45.108 |
| 39 | 53.561 | 49.293 | 47.657 | 51.112 | 42.562 | 54.852 | 45.172 |
| 40 | 48.936 | 43.208 | 42.797 | 42.117 | 35.542 | 47.492 | 35.083 |
| 41 | 0.040 | 4.854 | 4.636 | 14.192 | 3.058 | 1.145 | 3.180 |
| 42 | 126.869 | 146.608 | 158.066 | 160.683 | 116.771 | 135.768 | 83.774 |
| 43 | 42.918 | 75.713 | 75.807 | 77.106 | 66.004 | 75.820 | 71.374 |
| 44 | 0.937 | 0.625 | 0.532 | 0.498 | 0.847 | 0.370 | 0.577 |
| 45 | 0.056 | 0.063 | 0.058 | 0.055 | 0.051 | 0.036 | 0.061 |
| 46 | 1.107 | 3.200 | 3.433 | 3.300 | 1.000 | 1.100 | 4.379 |
| 47 | 17250 | 29257 | 36000 | 23967 | 15250 | 12688 | 21430 |
| 48 | 161.6 | 96.1 | 82.7 | 84.2 | 145.3 | 56.0 | 109.1 |
| 49 | 0.157 | 0.163 | 0.152 | 0.148 | 0.134 | 0.093 | 0.162 |
| 50 | 9.327 | 9.114 | 7.802 | 10.150 | 9.824 | 8.717 | 7.802 |
| 51 | 0.833 | 0.535 | 0.472 | 0.424 | 0.698 | 0.306 | 0.525 |
| 52 | 0.039 | 0.042 | 0.036 | 0.031 | 0.034 | 0.016 | 0.042 |
| 53 | 143.638 | 82.260 | 73.275 | 71.738 | 119.795 | 46.255 | 99.235 |
| 54 | 0.082 | 0.086 | 0.083 | 0.075 | 0.087 | 0.046 | 0.105 |
| 55 | 17.070 | 15.356 | 20.624 | 17.892 | 14.011 | 14.573 | 15.448 |
| 56 | 1.936 | 1.922 | 2.481 | 2.108 | 1.386 | 1.847 | 1.374 |
| 57 | 0.978 | 1.052 | 1.354 | 1.393 | 1.162 | 1.014 | 0.946 |
| 58 | 20.591 | 25.638 | 29.817 | 32.103 | 27.309 | 28.434 | 26.690 |

Table 67: Provided are the values of each of the parameters (as described above) measured in Sorghum accessions ("L" = Line) under drought conditions. Growth conditions are specified in the experimental procedure section.

TABLE 68

Measured parameters in additional Sorghum accessions under drought conditions

| Line/Corr. ID | Line-8 | Line-9 | Line-10 | Line-11 | Line-12 | Line-13 | Line-14 |
|---|---|---|---|---|---|---|---|
| 1 | NA | 91.009 | NA | 80.988 | 70.467 | 79.809 | 75.754 |
| 2 | 0.000 | 0.321 | 0.278 | 0.314 | 0.234 | 0.115 | 0.301 |
| 3 | 0.210 | 0.625 | 0.760 | 0.675 | 0.573 | 0.364 | 0.427 |
| 4 | 21.718 | 21.765 | 12.299 | 28.297 | 23.752 | 23.529 | 27.665 |
| 5 | 7925 | 15391 | 46856 | 26600 | 13235 | 8101 | 9566 |
| 6 | 5.942 | 11.074 | 8.455 | 15.925 | 7.906 | 9.860 | 8.572 |
| 7 | NA | 0.165 | 0.145 | 0.171 | 0.145 | 0.163 | 0.162 |
| 8 | 0.113 | 0.097 | 0.070 | 0.120 | 0.106 | 0.105 | 0.121 |
| 9 | 37.0 | 28.3 | 18.3 | 28.8 | 37.2 | 30.6 | 29.8 |

TABLE 68-continued

Measured parameters in additional Sorghum accessions under drought conditions

| Line/Corr. ID | Line-8 | Line-9 | Line-10 | Line-11 | Line-12 | Line-13 | Line-14 |
|---|---|---|---|---|---|---|---|
| 10 | 453.500 | 369.250 | 193.900 | 391.700 | 469.150 | 384.250 | 374.550 |
| 11 | 176.209 | 586.838 | 95.022 | 321.492 | 275.869 | 459.694 | 426.101 |
| 12 | 10.824 | 23.190 | 6.566 | 16.696 | 9.493 | 25.781 | 22.166 |
| 13 | 8106154 | 25074700 | 6470276 | 10728240 | 11082880 | 17810750 | 14047530 |
| 14 | 922.6 | 3192.6 | 1275.3 | 2368.5 | 1297.7 | 2280.5 | 1687.8 |
| 15 | 18.754 | 68.585 | 17.454 | 66.288 | 29.768 | 53.878 | 46.381 |
| 16 | 0.192 | 0.296 | 0.027 | 0.174 | 0.180 | 0.252 | 0.349 |
| 17 | 188.433 | 128.804 | 80.847 | 114.857 | 78.775 | 70.477 | 54.292 |
| 18 | 0.265 | 0.706 | 0.227 | 0.354 | 0.443 | 0.566 | 0.588 |
| 19 | 0.464 | 0.469 | 0.083 | 0.291 | 0.421 | 0.434 | 0.500 |
| 20 | 1.048 | 1.362 | 0.948 | 1.121 | 1.458 | 1.193 | 1.045 |
| 21 | −14.197 | −13.146 | −13.423 | −13.618 | −12.775 | −13.560 | −13.117 |
| 22 | NA | 31.738 | NA | 30.612 | 30.143 | 31.090 | 32.813 |
| 23 | 71.130 | 68.444 | 65.265 | 63.310 | 79.049 | 75.830 | 71.806 |
| 24 | 2894.0 | 9764.5 | 13474.8 | 14964.6 | 9651.0 | 6615.4 | 10532.6 |
| 25 | 9.019 | 19.935 | 23.125 | 21.705 | 17.476 | 13.403 | 17.250 |
| 26 | 363.433 | 1590.208 | 817.400 | 1579.043 | 630.300 | 898.267 | 875.433 |
| 27 | 7.775 | 35.168 | 11.282 | 45.210 | 15.017 | 21.266 | 24.160 |
| 28 | 76.0 | 90.3 | 132.0 | 112.4 | 80.4 | 83.4 | 84.2 |
| 29 | 630.5 | 791.9 | 1343.3 | 1080.7 | 679.7 | 713.9 | 723.6 |
| 30 | 111.8 | 143.3 | 150.0 | 150.6 | 147.3 | 113.0 | 114.0 |
| 31 | 1068.3 | 1501.6 | 1599.4 | 1607.3 | 1558.9 | 1084.0 | 1098.2 |
| 32 | 630.5 | 736.4 | NA | 945.3 | 625.3 | 607.3 | 709.0 |
| 33 | 1092.4 | 1161.1 | 1602.8 | 1472.4 | 1148.8 | 1098.1 | 1098.1 |
| 34 | NA | 6.238 | NA | 3.233 | 3.167 | 4.803 | 3.799 |
| 35 | 2.470 | 0.697 | 1.100 | 1.001 | 0.795 | 1.036 | 0.982 |
| 36 | NA | 1.062 | NA | 2.547 | 0.929 | 0.797 | 0.822 |
| 37 | 89.690 | 79.575 | NA | 85.392 | 86.918 | 84.460 | 84.347 |
| 38 | NA | 48.829 | NA | 50.915 | 50.778 | 52.048 | 50.596 |
| 39 | 55.544 | 50.777 | NA | 52.813 | 51.510 | 52.922 | 48.402 |
| 40 | 47.150 | 44.642 | 39.311 | 44.153 | 42.039 | 44.369 | 46.417 |
| 41 | 0.487 | 6.895 | NA | 0.837 | 1.119 | 0.373 | 2.202 |
| 42 | 188.735 | 106.494 | 96.881 | 104.467 | 161.086 | 116.682 | 152.401 |
| 43 | 83.199 | 68.185 | 53.838 | 56.668 | 78.389 | 74.750 | 77.709 |
| 44 | 0.179 | 0.560 | 1.177 | 0.873 | 0.429 | 0.414 | 0.384 |
| 45 | 0.014 | 0.048 | 0.109 | 0.058 | 0.033 | 0.041 | 0.030 |
| 46 | 1.200 | 2.826 | 1.067 | 1.667 | 3.267 | 2.828 | 2.759 |
| 47 | 16700 | 23063 | 12450 | 13300 | 29500 | 17843 | 18813 |
| 48 | 22.4 | 96.9 | 398.9 | 209.7 | 61.0 | 63.0 | 61.6 |
| 49 | 0.040 | 0.119 | 0.363 | 0.195 | 0.085 | 0.105 | 0.077 |
| 50 | 7.244 | 9.316 | 7.956 | 11.011 | 8.584 | 8.321 | 8.269 |
| 51 | 0.128 | 0.496 | 1.151 | 0.806 | 0.373 | 0.350 | 0.330 |
| 52 | 0.007 | 0.026 | 0.100 | 0.041 | 0.019 | 0.023 | 0.016 |
| 53 | 16.467 | 85.863 | 390.344 | 193.770 | 53.124 | 53.161 | 53.048 |
| 54 | 0.035 | 0.067 | 0.280 | 0.119 | 0.044 | 0.060 | 0.041 |
| 55 | 4.415 | 20.909 | 4.676 | 10.447 | 7.355 | 14.829 | 14.568 |
| 56 | 0.636 | 2.234 | 0.286 | 0.948 | 1.073 | 1.789 | 1.658 |
| 57 | 0.163 | 1.322 | 0.529 | 1.561 | 0.411 | 0.693 | 0.836 |
| 58 | 7.748 | 33.179 | NA | 29.546 | 13.347 | 17.038 | 18.455 |

Table 68: Provided are the values of each of the parameters (as described above) measured in Sorghum accessions ("L" = Line) under drought conditions. Growth conditions are specified in the experimental procedure section.

TABLE 69

Measured parameters in additional Sorghum accessions under drought conditions

| Line/Corr. ID | Line-15 | Line-16 | Line-17 | Line-18 | Line-19 | Line-20 | Line-21 |
|---|---|---|---|---|---|---|---|
| 1 | 63.087 | 82.774 | 61.843 | 91.397 | 69.406 | 78.023 | 72.962 |
| 2 | 0.334 | 0.437 | 0.113 | 0.298 | 0.073 | 0.293 | 0.134 |
| 3 | 0.362 | 0.589 | 0.628 | 0.312 | 0.398 | 0.356 | 0.151 |
| 4 | 23.399 | 17.180 | 36.532 | 15.755 | 24.586 | 17.806 | 21.837 |
| 5 | 12813 | 12286 | 19751 | 12768 | 11090 | 9924 | 6585 |
| 6 | 12.260 | 9.462 | 37.025 | 10.638 | 12.846 | 20.468 | 7.308 |
| 7 | 0.195 | 0.129 | 0.207 | 0.166 | 0.163 | 0.169 | NA |
| 8 | 0.121 | 0.082 | 0.145 | 0.087 | 0.111 | 0.092 | 0.105 |
| 9 | 23.6 | 28.0 | 30.3 | 23.0 | 32.6 | 22.4 | 40.2 |
| 10 | 309.550 | 365.550 | 397.938 | 311.800 | 413.550 | 291.750 | 493.550 |
| 11 | 267.312 | 311.951 | 289.762 | 124.816 | 507.414 | 430.251 | 254.426 |
| 12 | 18.790 | 14.785 | 12.626 | 3.997 | 34.067 | 23.355 | 13.395 |

TABLE 69-continued

Measured parameters in additional Sorghum accessions under drought conditions

| Line/Corr. ID | Line-15 | Line-16 | Line-17 | Line-18 | Line-19 | Line-20 | Line-21 |
|---|---|---|---|---|---|---|---|
| 13 | 10846278 | 15582420 | 8247885 | 6942220 | 18592480 | 21713380 | 10884158 |
| 14 | 1724.4 | 1891.7 | 1683.0 | 927.2 | 2955.1 | 2902.0 | 2221.1 |
| 15 | 39.728 | 34.499 | 56.862 | 15.114 | 73.525 | 52.512 | 48.784 |
| 16 | 0.196 | 0.176 | 0.163 | 0.060 | 0.362 | 0.218 | 0.265 |
| 17 | 65.790 | 120.481 | 84.266 | 59.883 | 116.994 | 73.911 | 60.152 |
| 18 | 0.324 | 0.441 | 0.367 | 0.278 | 0.557 | 0.476 | 0.298 |
| 19 | 0.366 | 0.341 | 0.300 | 0.187 | 0.530 | 0.313 | 0.405 |
| 20 | 0.734 | 1.160 | 1.863 | 1.590 | 1.037 | 1.090 | 1.855 |
| 21 | −13.373 | −13.297 | −13.463 | −13.000 | −13.203 | −13.147 | −13.527 |
| 22 | 32.431 | 32.053 | 31.146 | 29.935 | 30.208 | 31.477 | 29.370 |
| 23 | 68.133 | 63.313 | 72.543 | 61.273 | 75.180 | 49.663 | NA |
| 24 | 15978.1 | 11762.4 | 17356.5 | 13226.2 | 12471.0 | 14010.0 | 4967.2 |
| 25 | 21.798 | 17.391 | 21.641 | 17.464 | 19.075 | 18.937 | 14.289 |
| 26 | 1008.699 | 932.233 | 871.419 | 440.900 | 1460.132 | 1488.968 | 836.533 |
| 27 | 23.657 | 16.936 | 31.881 | 7.227 | 36.169 | 27.165 | 19.778 |
| 28 | 98.6 | 89.2 | 94.3 | 109.0 | 83.6 | 94.0 | 74.0 |
| 29 | 900.5 | 777.6 | 843.1 | 1032.8 | 715.5 | 840.0 | 607.3 |
| 30 | NA | NA | 143.8 | 148.0 | 131.0 | 114.5 | 116.0 |
| 31 | NA | NA | 1508.4 | 1570.0 | 1332.1 | 1105.0 | 1126.0 |
| 32 | 859.8 | 733.3 | 775.3 | 945.3 | 655.5 | 757.7 | 526.3 |
| 33 | 1210.0 | 1143.1 | 1241.1 | 1344.6 | 1129.0 | 1131.7 | 1100.8 |
| 34 | 2.459 | 4.882 | 2.622 | 3.599 | 3.541 | 4.223 | 3.209 |
| 35 | 0.667 | 0.889 | 0.955 | 1.271 | 0.827 | 0.677 | 0.811 |
| 36 | 2.778 | 1.012 | 4.227 | 1.878 | 1.183 | 2.788 | 0.645 |
| 37 | 86.631 | 78.462 | 85.828 | 86.589 | 89.624 | 82.927 | 90.251 |
| 38 | 50.103 | 51.082 | 57.487 | 48.753 | 53.703 | 46.738 | 50.180 |
| 39 | 49.072 | 53.950 | 58.408 | NA | 55.637 | 48.493 | 47.695 |
| 40 | 43.775 | 40.133 | 46.703 | 38.442 | 45.961 | 40.678 | 43.003 |
| 41 | 2.029 | 2.358 | 2.628 | 1.459 | 4.934 | 0.103 | 1.396 |
| 42 | 153.212 | 128.423 | 145.795 | 87.743 | 182.987 | 81.273 | 115.342 |
| 43 | 49.028 | 74.303 | 52.289 | 58.046 | 74.117 | 33.404 | NA |
| 44 | 0.914 | 0.489 | 1.302 | 0.722 | 0.534 | 1.213 | 0.377 |
| 45 | 0.038 | 0.047 | 0.065 | 0.039 | 0.040 | 0.052 | 0.027 |
| 46 | 2.700 | 1.321 | 4.000 | 3.767 | 2.367 | 1.679 | 4.900 |
| 47 | 12750 | 19493 | 20833 | 28979 | 14650 | 16950 | 18229 |
| 48 | 179.3 | 82.6 | 240.6 | 171.0 | 81.5 | 219.4 | 47.1 |
| 49 | 0.106 | 0.120 | 0.191 | 0.123 | 0.102 | 0.132 | 0.069 |
| 50 | 9.990 | 7.644 | 11.805 | 6.583 | 9.750 | 7.259 | 7.540 |
| 51 | 0.852 | 0.433 | 1.096 | 0.646 | 0.449 | 1.102 | 0.319 |
| 52 | 0.024 | 0.024 | 0.045 | 0.031 | 0.019 | 0.037 | 0.016 |
| 53 | 166.994 | 73.170 | 203.563 | 152.470 | 68.615 | 198.943 | 39.832 |
| 54 | 0.074 | 0.057 | 0.118 | 0.102 | 0.054 | 0.080 | 0.124 |
| 55 | 11.247 | 11.185 | 9.840 | 6.220 | 15.757 | 19.331 | 6.372 |
| 56 | 0.968 | 1.214 | 0.998 | 0.405 | 1.974 | 1.674 | 0.990 |
| 57 | 1.037 | 0.640 | 1.137 | 0.381 | 1.188 | 1.234 | 0.531 |
| 58 | 21.530 | 18.176 | 16.057 | NA | 27.647 | 30.353 | 18.934 |

Table 69: Provided are the values of each of the parameters (as described above) measured in Sorghum accessions ("L" = Line) under drought conditions. Growth conditions are specified in the experimental procedure section.

TABLE 70

Measured parameters in additional Sorghum accessions under drought conditions

| Line/Corr. ID | Line-22 | Line-23 | Line-24 | Line-25 | Line-26 | Line-27 | Line-28 |
|---|---|---|---|---|---|---|---|
| 1 | 90.725 | 89.322 | 63.403 | 58.656 | 90.324 | 69.266 | 78.521 |
| 2 | 0.268 | 0.441 | 0.344 | 0.215 | 0.406 | 0.239 | 0.225 |
| 3 | 0.725 | 0.843 | 0.630 | 0.396 | 0.709 | 0.517 | 0.283 |
| 4 | 26.528 | 25.814 | 27.598 | 21.848 | 26.829 | 18.373 | 24.199 |
| 5 | 19859 | 29904 | 18695 | 7513 | 15653 | 14606 | 8279 |
| 6 | 17.594 | 14.916 | 32.575 | 10.572 | 17.710 | 20.438 | 18.601 |
| 7 | 0.157 | 0.154 | 0.147 | 0.140 | 0.175 | 0.157 | NA |
| 8 | 0.124 | 0.113 | 0.130 | 0.105 | 0.123 | 0.098 | 0.107 |
| 9 | 32.4 | 25.4 | 29.2 | 32.8 | 25.0 | 26.6 | 40.3 |
| 10 | 445.700 | 349.800 | 381.150 | 418.800 | 338.100 | 337.300 | 494.375 |
| 11 | 73.585 | 443.706 | 475.258 | 346.323 | 243.625 | 317.094 | 537.350 |
| 12 | 6.229 | 28.228 | 33.821 | 21.880 | 11.814 | 21.905 | 32.903 |
| 13 | 2607623 | 15608820 | 16427920 | 14660064 | 8494728 | 15105380 | 19961625 |
| 14 | 344.2 | 2572.2 | 3186.7 | 2510.2 | 1468.4 | 2754.9 | 3990.9 |
| 15 | 7.619 | 66.818 | 86.304 | 54.757 | 38.833 | 53.782 | 97.093 |

TABLE 70-continued

Measured parameters in additional Sorghum accessions under drought conditions

| Line/Corr. ID | Line-22 | Line-23 | Line-24 | Line-25 | Line-26 | Line-27 | Line-28 |
|---|---|---|---|---|---|---|---|
| 16 | 0.026 | 0.179 | 0.309 | 0.303 | 0.136 | 0.209 | 0.382 |
| 17 | 85.966 | 101.763 | 116.926 | 76.034 | 47.587 | 129.080 | 105.902 |
| 18 | 0.160 | 0.645 | 0.554 | 0.463 | 0.268 | 0.652 | 0.598 |
| 19 | 0.105 | 0.345 | 0.536 | 0.494 | 0.210 | 0.603 | 0.576 |
| 20 | 1.488 | 0.922 | 1.171 | 1.048 | 1.154 | 1.013 | 1.794 |
| 21 | −13.460 | −13.526 | −13.860 | −13.320 | −13.280 | −12.893 | −13.197 |
| 22 | 31.150 | 29.908 | 31.025 | 31.742 | 31.675 | 30.970 | 28.544 |
| 23 | 61.602 | 68.320 | 52.744 | 73.423 | 58.117 | 72.016 | NA |
| 24 | 14354.0 | 14782.2 | 9583.3 | 9224.8 | 12185.8 | 11844.8 | 10118.5 |
| 25 | 21.338 | 21.533 | 17.566 | 18.666 | 19.557 | 20.497 | 14.358 |
| 26 | 130.167 | 1545.898 | 1637.460 | 1351.168 | 533.701 | 1425.000 | 1736.125 |
| 27 | 3.526 | 40.537 | 45.368 | 29.841 | 16.072 | 28.463 | 41.775 |
| 28 | 113.0 | 116.2 | 88.8 | 84.8 | 107.2 | 86.4 | 74.0 |
| 29 | 1086.6 | 1128.6 | 773.0 | 730.0 | 1010.7 | 746.7 | 607.3 |
| 30 | 148.0 | 144.8 | 114.0 | 118.0 | 144.0 | 113.0 | 116.0 |
| 31 | 1570.2 | 1524.0 | 1098.2 | 1154.5 | 1512.2 | 1084.0 | 1126.0 |
| 32 | 854.5 | 945.3 | 734.5 | 688.7 | 801.9 | 709.0 | 607.8 |
| 33 | 1532.3 | 1478.4 | 1154.1 | 1148.8 | 1348.8 | 1084.0 | 1101.6 |
| 34 | 3.535 | 3.439 | 2.707 | 2.399 | 4.568 | 3.537 | 4.244 |
| 35 | 0.877 | 0.697 | 1.425 | 0.745 | 0.803 | 0.821 | 1.134 |
| 36 | 2.442 | 2.285 | 2.053 | 1.118 | 1.526 | 1.204 | 1.035 |
| 37 | 87.868 | 87.156 | 75.524 | 84.972 | 89.151 | 85.963 | 90.046 |
| 38 | 44.029 | 48.585 | 47.358 | 52.498 | 47.105 | 53.847 | 51.967 |
| 39 | 41.940 | 48.005 | 45.902 | 51.158 | 45.948 | 53.493 | 49.990 |
| 40 | 39.201 | 38.294 | 42.158 | 45.281 | 39.606 | 42.350 | 45.856 |
| 41 | 0.538 | NA | 0.434 | 1.437 | 9.145 | NA | 3.368 |
| 42 | 96.152 | 113.450 | 107.560 | 144.486 | 93.734 | 143.428 | 122.910 |
| 43 | 55.471 | 58.489 | 61.581 | 74.220 | 63.845 | 80.472 | NA |
| 44 | 0.887 | 0.775 | 0.750 | 0.390 | 0.588 | 0.488 | 0.658 |
| 45 | 0.045 | 0.063 | 0.058 | 0.049 | 0.045 | 0.043 | 0.045 |
| 46 | 3.800 | 1.033 | 1.143 | 2.172 | 2.067 | 1.000 | 2.826 |
| 47 | 20283 | 13450 | 12802 | 14000 | 18717 | 12750 | 16564 |
| 48 | 222.3 | 203.2 | 126.7 | 64.4 | 137.2 | 80.3 | 82.2 |
| 49 | 0.152 | 0.214 | 0.153 | 0.126 | 0.138 | 0.110 | 0.115 |
| 50 | 8.073 | 11.180 | 11.875 | 8.761 | 9.334 | 10.738 | 8.701 |
| 51 | 0.817 | 0.719 | 0.557 | 0.326 | 0.511 | 0.364 | 0.509 |
| 52 | 0.040 | 0.042 | 0.026 | 0.021 | 0.036 | 0.017 | 0.019 |
| 53 | 204.688 | 188.310 | 94.100 | 53.816 | 119.455 | 59.885 | 63.629 |
| 54 | 0.178 | 0.116 | 0.061 | 0.052 | 0.113 | 0.094 | 0.063 |
| 55 | 2.497 | 17.864 | 16.291 | 10.780 | 10.579 | 12.072 | 13.243 |
| 56 | 0.217 | 1.309 | 1.806 | 1.348 | 0.794 | 1.234 | 2.091 |
| 57 | 0.131 | 1.633 | 1.550 | 0.945 | 1.023 | 1.077 | 1.047 |
| 58 | 4.432 | 32.085 | 35.929 | 26.706 | 18.687 | 26.870 | 35.317 |

Table 70: Provided are the values of each of the parameters (as described above) measured in Sorghum accessions ("L" = Line) under drought conditions. Growth conditions are specified in the experimental procedure section.

TABLE 71

Measured parameters in additional Sorghum accessions under drought conditions

| Line/Corr. ID | Line-29 | Line-30 | Line-31 | Line-32 | Line-33 | Line-34 | Line-35 |
|---|---|---|---|---|---|---|---|
| 1 | 81.125 | 91.194 | 91.259 | 75.635 | 84.772 | 64.819 | 81.827 |
| 2 | 0.163 | 0.453 | 0.350 | 0.220 | 0.227 | 0.408 | 0.416 |
| 3 | 0.356 | 0.602 | 0.633 | 0.361 | 0.365 | 0.561 | 0.591 |
| 4 | 25.929 | 24.781 | 21.284 | 21.644 | 23.479 | 23.959 | 25.378 |
| 5 | 8487 | 10491 | 18823 | 11730 | 13869 | 16143 | 25030 |
| 6 | 10.982 | 11.531 | 22.167 | 49.007 | 13.313 | 32.109 | 12.350 |
| 7 | NA | NA | 0.174 | 0.177 | 0.178 | 0.155 | 0.146 |
| 8 | 0.114 | 0.109 | 0.101 | 0.102 | 0.112 | 0.109 | 0.110 |
| 9 | 39.0 | 39.0 | 23.8 | 30.8 | 26.0 | 29.3 | 35.6 |
| 10 | 476.750 | 476.750 | 311.250 | 403.500 | 341.250 | 383.125 | 470.650 |
| 11 | 542.866 | 561.268 | 582.815 | 506.799 | 712.873 | 625.018 | 397.261 |
| 12 | 32.227 | 32.258 | 39.815 | 41.732 | 45.253 | 43.942 | 17.384 |
| 13 | 18615532 | 21411860 | 25679300 | 23005825 | 29206300 | 27920025 | 15769504 |
| 14 | 4001.9 | 2671.3 | 4808.2 | 4663.8 | 4845.4 | 4510.1 | 2317.9 |
| 15 | 107.428 | 67.195 | 101.624 | 98.272 | 110.299 | 99.760 | 54.332 |
| 16 | 0.351 | 0.324 | 0.274 | 0.329 | 0.317 | 0.294 | 0.117 |
| 17 | 147.091 | 102.130 | 142.655 | 141.282 | 157.432 | 113.911 | 80.454 |
| 18 | 0.648 | 0.693 | 0.691 | 0.648 | 0.800 | 0.748 | 0.455 |

TABLE 71-continued

Measured parameters in additional Sorghum accessions under drought conditions

| Line/Corr. ID | Line-29 | Line-30 | Line-31 | Line-32 | Line-33 | Line-34 | Line-35 |
|---|---|---|---|---|---|---|---|
| 19 | 0.605 | 0.558 | 0.446 | 0.538 | 0.471 | 0.439 | 0.195 |
| 20 | 1.702 | 1.090 | 1.135 | 0.961 | 1.319 | 1.040 | 1.580 |
| 21 | −13.110 | −13.302 | −13.168 | NA | −12.932 | −12.773 | −13.641 |
| 22 | 29.020 | 29.218 | 32.127 | 31.510 | 30.367 | 34.529 | 31.704 |
| 23 | NA | NA | 69.854 | 65.961 | 52.714 | 68.984 | 62.975 |
| 24 | 3717.8 | 7510.6 | 15198.4 | 15660.3 | 26643.7 | 16453.5 | 16261.8 |
| 25 | 15.715 | 15.002 | 21.254 | 17.991 | 21.412 | 18.684 | 18.087 |
| 26 | 1588.502 | 1445.366 | 2590.168 | 2483.498 | 2041.557 | 1695.668 | 1071.869 |
| 27 | 42.428 | 36.053 | 55.958 | 54.938 | 48.327 | 39.825 | 26.772 |
| 28 | 74.0 | 74.0 | 93.4 | 89.5 | 95.0 | 89.5 | 93.4 |
| 29 | 607.3 | 607.3 | 831.9 | 781.0 | 853.3 | 781.0 | 831.8 |
| 30 | 115.3 | 113.0 | 136.6 | 134.0 | 136.5 | 139.0 | 143.3 |
| 31 | 1116.3 | 1084.0 | 1406.8 | 1369.0 | 1405.5 | 1442.0 | 1501.9 |
| 32 | 534.3 | 563.9 | 775.3 | 727.2 | 779.1 | 753.6 | 761.3 |
| 33 | 1084.0 | 1084.0 | 1143.1 | 1184.5 | 1194.5 | 1164.1 | 1260.6 |
| 34 | 4.092 | 5.577 | 6.098 | 3.935 | 4.908 | 3.233 | 3.997 |
| 35 | 0.959 | 1.048 | 0.888 | 0.858 | 0.819 | 1.038 | 1.575 |
| 36 | 0.735 | 0.658 | 2.563 | 4.152 | 3.913 | 2.742 | 2.504 |
| 37 | 91.805 | 90.937 | 76.228 | 80.929 | NA | 81.235 | 81.174 |
| 38 | 58.130 | 50.575 | 48.289 | 55.185 | 52.586 | 52.328 | 51.328 |
| 39 | 51.912 | 50.607 | 50.565 | 56.933 | 51.072 | 50.317 | 50.353 |
| 40 | 52.578 | 44.669 | 43.089 | 46.904 | 47.917 | 44.097 | 43.414 |
| 41 | 13.560 | 16.258 | 4.592 | 4.237 | 2.973 | 3.416 | 2.669 |
| 42 | 90.902 | 109.171 | 130.887 | 121.179 | 100.865 | 133.746 | 113.632 |
| 43 | NA | NA | 31.224 | 25.069 | 33.729 | 63.166 | 61.858 |
| 44 | 0.473 | 0.480 | 1.287 | 1.818 | 1.752 | 1.027 | 1.114 |
| 45 | 0.053 | 0.046 | 0.075 | 0.063 | 0.055 | 0.060 | 0.090 |
| 46 | 2.172 | 3.107 | 1.500 | 1.625 | 1.111 | 1.708 | 2.900 |
| 47 | 15183 | 18906 | 13300 | 10875 | 14778 | 14000 | 23500 |
| 48 | 59.1 | 60.0 | 233.7 | 307.3 | 331.2 | 173.5 | 205.7 |
| 49 | 0.136 | 0.117 | 0.193 | 0.175 | 0.156 | 0.158 | 0.276 |
| 50 | 8.566 | 8.981 | 8.582 | 9.918 | 8.551 | 9.355 | 8.996 |
| 51 | 0.385 | 0.387 | 1.164 | 1.528 | 1.682 | 0.837 | 1.046 |
| 52 | 0.021 | 0.020 | 0.042 | 0.029 | 0.029 | 0.033 | 0.073 |
| 53 | 48.091 | 48.428 | 211.564 | 258.277 | 317.871 | 141.388 | 193.358 |
| 54 | 0.069 | 0.058 | 0.108 | 0.055 | 0.103 | 0.095 | 0.152 |
| 55 | 13.920 | 14.391 | 24.759 | 16.537 | 27.693 | 21.381 | 11.370 |
| 56 | 2.112 | 2.184 | 2.268 | 1.836 | 2.501 | 2.352 | 1.293 |
| 57 | 1.366 | 0.864 | 2.452 | 1.905 | 1.895 | 1.425 | 0.829 |
| 58 | 37.747 | 25.922 | 52.124 | 45.984 | 41.342 | 35.700 | 24.229 |

Table 71: Provided are the values of each of the parameters (as described above) measured in Sorghum accessions ("L" = Line) under drought conditions. Growth conditions are specified in the experimental procedure section.

TABLE 72

Measured parameters in Sorghum accessions under low N conditions

| Line/Corr. ID | Line-1 | Line-2 | Line-3 | Line-4 | Line-5 | Line-6 | Line-7 |
|---|---|---|---|---|---|---|---|
| 1 | 70.982 | 80.778 | 71.062 | 62.932 | 65.104 | 74.278 | 83.123 |
| 2 | 0.149 | 0.204 | 0.123 | 0.140 | 0.289 | 0.063 | 0.099 |
| 3 | 0.303 | 0.177 | 0.091 | 0.303 | 0.321 | 0.048 | 0.275 |
| 4 | 2.012 | NA | 1.641 | 1.494 | NA | 1.565 | NA |
| 5 | 1.617 | NA | 2.306 | 1.380 | NA | 2.062 | NA |
| 6 | 1.223 | NA | 1.005 | 1.417 | NA | 1.674 | NA |
| 7 | 0.925 | NA | 0.667 | 0.580 | NA | 0.992 | NA |
| 8 | 29.775 | 30.575 | 35.404 | 30.667 | 29.218 | 23.386 | 20.149 |
| 9 | 21836 | 19319 | 15291 | 24497 | 44649 | 13715 | 30944 |
| 10 | 19.635 | 17.315 | 9.965 | 11.714 | 38.660 | 12.445 | 13.735 |
| 11 | 0.179 | 0.147 | 0.153 | 0.130 | 0.135 | 0.200 | 0.149 |
| 12 | 24.772 | NA | 29.657 | 37.888 | NA | 28.942 | NA |
| 13 | 0.121 | 0.127 | 0.132 | 0.133 | 0.130 | 0.103 | 0.094 |
| 14 | 33.8 | 29.6 | 35.0 | 28.5 | 26.3 | 33.6 | 21.8 |
| 15 | 444.5 | 380.4 | 439.7 | 373.5 | 273.3 | 428.2 | 285.2 |
| 16 | 661.8 | 769.5 | 745.2 | 653.3 | 610.1 | 581.2 | 324.5 |
| 17 | 34.150 | 35.096 | 23.132 | 18.830 | 42.755 | 38.924 | 15.023 |
| 18 | 22070840 | 24438020 | 21504340 | 21499680 | 20685020 | 21825800 | 16454200 |
| 19 | 3110.7 | 3929.4 | 2654.6 | 3987.6 | 4127.2 | 3314.9 | 2216.5 |
| 20 | 88.128 | 115.995 | 87.409 | 113.013 | 114.984 | 79.512 | 42.224 |
| 21 | 0.238 | 0.281 | 0.245 | 0.294 | 0.270 | 0.300 | 0.126 |

TABLE 72-continued

Measured parameters in Sorghum accessions under low N conditions

| Line/Corr. ID | Line-1 | Line-2 | Line-3 | Line-4 | Line-5 | Line-6 | Line-7 |
|---|---|---|---|---|---|---|---|
| 22 | 135.426 | 108.347 | 102.784 | 108.131 | 133.977 | 94.102 | 97.673 |
| 23 | 0.871 | 0.883 | 0.818 | 0.737 | 0.685 | 0.673 | 0.505 |
| 24 | 0.419 | 0.408 | 0.364 | 0.414 | 0.390 | 0.447 | 0.310 |
| 25 | 1.154 | 1.349 | 1.635 | 2.158 | 0.990 | 1.127 | 1.147 |
| 26 | −12.781 | −13.107 | −12.994 | −12.832 | −13.047 | −13.437 | −12.963 |
| 27 | 30.750 | 29.233 | 30.853 | 30.262 | 29.008 | 30.268 | 29.357 |
| 28 | 70.470 | NA | 71.859 | 71.849 | 61.250 | 76.638 | 65.094 |
| 29 | 16770.4 | 10615.2 | 9361.4 | 12263.6 | 12503.9 | 7283.2 | 7295.8 |
| 30 | 19.657 | 14.270 | 14.101 | 17.056 | 17.317 | 15.079 | 16.105 |
| 31 | 1700.3 | 2239.1 | 1281.7 | 1754.3 | 2275.7 | 1569.7 | 1123.2 |
| 32 | 49.898 | 68.289 | 45.839 | 53.946 | 66.982 | 37.499 | 23.114 |
| 33 | 0.498 | NA | 0.487 | 0.566 | NA | 0.453 | NA |
| 34 | 330.902 | 384.754 | 372.597 | 326.628 | 305.061 | 290.601 | 162.240 |
| 35 | 92.000 | 86.800 | 81.200 | 89.600 | 89.500 | 84.000 | 95.800 |
| 36 | 814.0 | 751.3 | 689.4 | 782.2 | 781.0 | 720.7 | 863.7 |
| 37 | 139.0 | 117.0 | 122.6 | 133.0 | 115.3 | NA | 126.4 |
| 38 | 1442.0 | 1139.8 | 1215.2 | 1357.9 | 1115.5 | NA | 1266.7 |
| 39 | 762.250 | 669.063 | 675.083 | 757.650 | 757.650 | 649.438 | 823.417 |
| 40 | 1258.5 | 1131.7 | 1129.0 | 1154.5 | 1123.3 | 1148.8 | 1148.8 |
| 41 | 14.711 | NA | 12.003 | 8.510 | NA | 9.037 | NA |
| 42 | 3.949 | 4.099 | 3.362 | 3.023 | 2.144 | 3.819 | 4.352 |
| 43 | 0.899 | 2.178 | 1.923 | 1.476 | 2.094 | 1.370 | 2.046 |
| 44 | 2.746 | 1.271 | 1.287 | 1.557 | 3.225 | 0.899 | 1.665 |
| 45 | 91.270 | 90.888 | 91.349 | 87.339 | 89.630 | 87.146 | 84.594 |
| 46 | 56.305 | 49.677 | 46.965 | 48.598 | 42.805 | 54.763 | 43.717 |
| 47 | 54.540 | 51.730 | 47.538 | 48.722 | 44.574 | 52.847 | 47.843 |
| 48 | 50.167 | 39.128 | 42.389 | 38.897 | 36.192 | 41.514 | 37.042 |
| 49 | 6.429 | 0.789 | 3.957 | 18.903 | 5.833 | 0.137 | 2.175 |
| 50 | 155.139 | 162.491 | 161.900 | 181.391 | 148.290 | 144.063 | 100.333 |
| 51 | 49.466 | 81.590 | 76.055 | 77.961 | 60.221 | 79.401 | 72.605 |
| 52 | 0.546 | 0.360 | 0.326 | 0.308 | 0.639 | 0.243 | 0.407 |
| 53 | 0.0384 | 0.0497 | 0.0458 | 0.0529 | 0.0563 | 0.0281 | 0.0392 |
| 54 | 1.143 | 2.233 | 5.034 | 2.200 | 1.100 | 2.793 | 3.000 |
| 55 | 19050.0 | 19500.0 | 30600.0 | 29007.1 | 13250.0 | 14125.0 | 19550.0 |
| 56 | 93.293 | NA | 120.520 | 126.608 | NA | 99.805 | NA |
| 57 | 166.039 | 103.715 | 85.701 | 90.811 | 205.656 | 66.689 | 138.327 |
| 58 | 0.200 | 0.231 | 0.213 | 0.243 | 0.262 | 0.131 | 0.183 |
| 59 | 10.718 | 9.678 | 7.879 | 9.474 | 10.835 | 9.783 | 8.964 |
| 60 | 0.482 | 0.300 | 0.287 | 0.269 | 0.522 | 0.198 | 0.367 |
| 61 | 0.022 | 0.030 | 0.029 | 0.033 | 0.034 | 0.016 | 0.027 |
| 62 | 146.546 | 86.400 | 75.736 | 79.097 | 166.996 | 54.244 | 124.591 |
| 63 | 0.114 | 0.114 | 0.102 | 0.083 | 0.101 | 0.085 | 0.127 |
| 64 | 19.977 | 26.227 | 21.485 | 21.746 | 22.048 | 16.902 | 14.848 |
| 65 | 1.277 | 1.653 | 1.601 | 1.328 | 1.311 | 1.249 | 0.697 |
| 66 | 1.574 | 2.346 | 1.430 | 2.426 | 2.855 | 1.139 | 1.153 |
| 67 | 32.656 | 43.472 | 30.906 | 52.059 | 57.152 | 29.519 | 25.534 |

Table 72: Provided are the values of each of the parameters (as described above) measured in Sorghum accessions (Line) under low N conditions. Growth conditions are specified in the experimental procedure section.

TABLE 73

Measured parameters in additional Sorghum accessions under low N conditions

| Line/Corr. ID | Line-8 | Line-9 | Line-10 | Line-11 | Line-12 | Line-13 | Line-14 |
|---|---|---|---|---|---|---|---|
| 1 | NA | 87.393 | 85.484 | 93.116 | 55.446 | 74.116 | 67.367 |
| 2 | 0.000 | 0.105 | 0.200 | 0.037 | 0.240 | 0.165 | 0.244 |
| 3 | 0.199 | 0.416 | 0.590 | 0.344 | 0.186 | 0.032 | 0.206 |
| 4 | NA | 1.759 | NA | NA | NA | NA | NA |
| 5 | NA | 1.160 | NA | NA | NA | NA | NA |
| 6 | NA | 1.314 | NA | NA | NA | NA | NA |
| 7 | NA | 0.892 | NA | NA | NA | NA | NA |
| 8 | 23.746 | 22.838 | 16.503 | 24.820 | 25.570 | 25.177 | 29.479 |
| 9 | 8654 | 22139 | 48188 | 46278 | 15265 | 9785 | 13167 |
| 10 | 6.745 | 10.983 | 10.180 | 31.720 | 7.650 | 10.130 | 9.523 |
| 11 | NA | 0.169 | 0.131 | 0.175 | 0.168 | 0.185 | 0.181 |
| 12 | NA | 22.900 | NA | NA | NA | NA | NA |
| 13 | 0.121 | 0.096 | 0.083 | 0.111 | 0.110 | 0.108 | 0.123 |
| 14 | 37.0 | 33.3 | 22.0 | 27.8 | 34.8 | 31.6 | 28.6 |
| 15 | 453.5 | 437.0 | 303.1 | 381.1 | 448.5 | 400.9 | 366.1 |

TABLE 73-continued

Measured parameters in additional Sorghum accessions under low N conditions

| Line/Corr. ID | Line-8 | Line-9 | Line-10 | Line-11 | Line-12 | Line-13 | Line-14 |
|---|---|---|---|---|---|---|---|
| 16 | 152.0 | 633.4 | 389.1 | 306.5 | 283.0 | 558.3 | 690.4 |
| 17 | 12.901 | 27.970 | 27.662 | 20.911 | 9.965 | 27.625 | 34.066 |
| 18 | 6420783 | 26192733 | 21156820 | 10734122 | 10820540 | 21581650 | 22437200 |
| 19 | 1326.9 | 4021.6 | 3454.5 | 1697.2 | 1472.7 | 3041.2 | 2942.7 |
| 20 | 31.060 | 90.240 | 58.679 | 44.118 | 35.686 | 74.674 | 84.101 |
| 21 | 0.194 | 0.225 | 0.065 | 0.085 | 0.165 | 0.357 | 0.296 |
| 22 | 235.316 | 156.903 | 136.671 | 190.285 | 117.019 | 75.922 | 78.987 |
| 23 | 0.200 | 0.756 | 0.509 | 0.470 | 0.499 | 0.627 | 0.783 |
| 24 | 0.360 | 0.363 | 0.122 | 0.176 | 0.469 | 0.510 | 0.460 |
| 25 | 1.067 | 1.414 | 0.949 | 1.126 | 1.464 | 1.258 | 1.110 |
| 26 | −13.617 | −12.690 | −13.107 | −13.168 | −12.587 | −13.127 | −12.997 |
| 27 | NA | 30.044 | 32.523 | 32.462 | 29.503 | 29.288 | 30.948 |
| 28 | 71.939 | 69.210 | 68.575 | 69.279 | 79.731 | 76.658 | 73.608 |
| 29 | 3501.0 | 12503.7 | 15699.7 | 22712.4 | 8595.4 | 8279.6 | 14579.4 |
| 30 | 8.967 | 19.410 | 20.615 | 22.694 | 18.017 | 13.931 | 16.957 |
| 31 | 520.9 | 1874.6 | 1912.8 | 732.1 | 810.6 | 1593.3 | 1572.2 |
| 32 | 12.331 | 43.669 | 32.983 | 19.063 | 19.801 | 40.775 | 46.400 |
| 33 | NA | 0.403 | NA | NA | NA | NA | NA |
| 34 | 75.982 | 316.713 | 194.545 | 153.235 | 141.521 | 279.168 | 345.200 |
| 35 | 76.000 | 91.000 | 120.600 | 113.800 | 85.800 | 84.400 | 86.800 |
| 36 | 630.5 | 802.3 | 1189.1 | 1097.1 | 740.6 | 725.2 | 751.6 |
| 37 | 112.0 | 147.0 | 145.5 | 154.2 | 148.0 | 137.0 | 119.0 |
| 38 | 1070.9 | 1554.5 | 1534.3 | 1659.7 | 1570.2 | 1412.0 | 1165.8 |
| 39 | 630.500 | 734.917 | NA | 945.250 | 661.900 | 670.000 | 717.083 |
| 40 | 1084.0 | 1239.3 | 1492.2 | 1478.1 | 1189.1 | 1126.0 | 1117.6 |
| 41 | NA | 11.607 | NA | NA | NA | NA | NA |
| 42 | NA | 5.217 | 4.975 | 6.281 | 2.147 | 4.017 | 2.835 |
| 43 | 2.500 | 0.647 | 1.153 | 0.958 | 0.711 | 0.999 | 1.122 |
| 44 | NA | 1.351 | 2.875 | 2.149 | 1.060 | 0.877 | 1.046 |
| 45 | 92.267 | 87.171 | 86.652 | 88.087 | 86.867 | 85.891 | 91.490 |
| 46 | NA | 51.189 | 46.238 | 57.363 | 49.617 | 53.647 | 48.521 |
| 47 | 50.112 | 53.108 | 42.777 | 56.933 | 49.052 | 50.500 | 48.795 |
| 48 | 41.900 | 40.083 | 36.017 | 39.369 | 36.297 | 40.442 | 45.400 |
| 49 | 5.200 | 10.090 | NA | 5.248 | 1.450 | 9.657 | NA |
| 50 | 189.473 | 125.519 | 140.628 | 160.009 | 159.603 | 178.499 | 157.837 |
| 51 | 84.085 | 67.668 | 73.146 | 71.748 | 82.454 | 74.350 | 79.973 |
| 52 | 0.118 | 0.381 | 0.482 | 0.437 | 0.196 | 0.232 | 0.231 |
| 53 | 0.0179 | 0.0436 | 0.0742 | 0.0518 | 0.0253 | 0.0269 | 0.0361 |
| 54 | 1.826 | 2.471 | 1.200 | 2.267 | 2.533 | 3.833 | 1.536 |
| 55 | 12833.3 | 20833.3 | 13166.7 | 14150.0 | 25900.0 | 18950.0 | 18250.0 |
| 56 | NA | 104.355 | NA | NA | NA | NA | NA |
| 57 | 26.195 | 119.974 | 240.975 | 200.845 | 55.271 | 64.623 | 68.036 |
| 58 | 0.078 | 0.223 | 0.418 | 0.292 | 0.122 | 0.125 | 0.168 |
| 59 | 7.894 | 9.503 | 6.876 | 11.006 | 9.427 | 8.680 | 8.355 |
| 60 | 0.086 | 0.346 | 0.462 | 0.368 | 0.169 | 0.195 | 0.199 |
| 61 | 0.011 | 0.028 | 0.063 | 0.043 | 0.014 | 0.013 | 0.015 |
| 62 | 19.450 | 108.992 | 230.795 | 169.125 | 47.621 | 54.493 | 58.513 |
| 63 | 0.053 | 0.119 | 0.467 | 0.192 | 0.059 | 0.052 | 0.071 |
| 64 | 3.976 | 18.907 | 17.986 | 11.876 | 8.179 | 17.225 | 24.337 |
| 65 | 0.316 | 1.246 | 0.690 | 0.544 | 0.567 | 1.199 | 1.483 |
| 66 | 0.489 | 1.511 | 1.518 | 0.747 | 0.606 | 1.417 | 1.635 |
| 67 | 12.034 | 40.630 | 40.858 | 13.330 | 17.471 | 34.938 | 31.887 |

Table 73: Provided are the values of each of the parameters (as described above) measured in Sorghum accessions (Line) under low N conditions. Growth conditions are specified in the experimental procedure section.

TABLE 74

Measured parameters in additional Sorghum accessions under low N conditions

| Line/Corr. ID | Line-15 | Line-16 | Line-17 | Line-18 | Line-19 | Line-20 | Line-21 |
|---|---|---|---|---|---|---|---|
| 1 | 71.204 | 87.744 | 66.577 | 88.729 | 69.236 | 82.991 | 61.314 |
| 2 | 0.280 | 0.108 | 0.142 | 0.197 | 0.044 | 0.176 | 0.009 |
| 3 | 0.276 | 0.215 | 0.080 | 0.227 | 0.034 | 0.151 | 0.057 |
| 4 | NA | NA | NA | NA | NA | NA | NA |
| 5 | NA | NA | NA | NA | NA | NA | NA |
| 6 | NA | NA | NA | NA | NA | NA | NA |
| 7 | NA | NA | NA | NA | NA | NA | NA |
| 8 | 22.654 | 16.496 | 36.959 | 16.850 | 26.577 | 17.793 | 21.080 |
| 9 | 14934 | 18163 | 28962 | 18746 | 12235 | 15453 | 7724 |

TABLE 74-continued

Measured parameters in additional Sorghum accessions under low N conditions

| Line/Corr. ID | Line-15 | Line-16 | Line-17 | Line-18 | Line-19 | Line-20 | Line-21 |
|---|---|---|---|---|---|---|---|
| 10 | 9.865 | 11.363 | 19.744 | 16.135 | 17.348 | 13.860 | 8.299 |
| 11 | 0.177 | 0.165 | 0.199 | 0.160 | 0.183 | 0.185 | NA |
| 12 | NA | NA | NA | NA | NA | NA | NA |
| 13 | 0.116 | 0.079 | 0.144 | 0.089 | 0.113 | 0.088 | 0.101 |
| 14 | 22.2 | 29.2 | 29.5 | 30.0 | 35.4 | 24.6 | 42.6 |
| 15 | 293.6 | 384.4 | 389.3 | 405.6 | 454.6 | 323.1 | 527.5 |
| 16 | 605.1 | 366.7 | 423.1 | 280.2 | 590.6 | 454.7 | 263.7 |
| 17 | 37.096 | 17.573 | 16.101 | 5.704 | 36.432 | 28.131 | 13.219 |
| 18 | 25344720 | 20035920 | 11582823 | 14659840 | 20818740 | 23299560 | 11431484 |
| 19 | 3864.4 | 2620.7 | 1944.0 | 1369.3 | 3561.9 | 3839.1 | 1999.4 |
| 20 | 85.481 | 44.335 | 66.859 | 23.580 | 95.691 | 68.241 | 43.298 |
| 21 | 0.327 | 0.196 | 0.146 | 0.074 | 0.351 | 0.258 | 0.290 |
| 22 | 107.039 | 176.320 | 83.007 | 66.675 | 117.480 | 98.120 | 47.498 |
| 23 | 0.693 | 0.580 | 0.474 | 0.577 | 0.679 | 0.508 | 0.262 |
| 24 | 0.492 | 0.352 | 0.257 | 0.203 | 0.526 | 0.390 | 0.367 |
| 25 | 1.064 | 1.108 | 1.779 | 2.298 | 1.154 | 1.220 | 2.537 |
| 26 | −12.960 | −13.070 | −12.937 | −12.773 | −13.347 | −12.603 | −12.827 |
| 27 | 29.694 | 30.343 | 30.742 | 32.608 | 29.950 | 29.898 | 27.933 |
| 28 | 68.654 | 70.917 | 73.210 | 65.330 | 75.551 | 62.980 | NA |
| 29 | 16710.4 | 13218.2 | 14464.5 | 11759.2 | 8621.8 | 13816.8 | 6363.6 |
| 30 | 21.007 | 20.015 | 21.476 | 17.659 | 18.518 | 20.684 | 14.810 |
| 31 | 2037.5 | 1422.1 | 854.8 | 449.6 | 1466.9 | 1989.8 | 659.5 |
| 32 | 46.213 | 24.508 | 31.902 | 7.677 | 40.562 | 35.605 | 14.155 |
| 33 | NA | NA | NA | NA | NA | NA | NA |
| 34 | 302.543 | 183.331 | 211.574 | 140.091 | 295.283 | 227.327 | 131.841 |
| 35 | 103.800 | 94.000 | 97.750 | 107.400 | 84.600 | 95.800 | 74.000 |
| 36 | 967.4 | 840.0 | 889.3 | 1013.4 | 726.8 | 863.6 | 607.3 |
| 37 | 143.0 | NA | 149.0 | 148.4 | 144.0 | 137.0 | NA |
| 38 | 1498.3 | NA | 1584.5 | 1576.2 | 1512.8 | 1412.0 | NA |
| 39 | 892.583 | 769.500 | 814.250 | 905.750 | 641.550 | 772.950 | 534.250 |
| 40 | 1261.0 | 1224.4 | 1278.5 | 1419.0 | 1181.3 | 1186.6 | 1134.7 |
| 41 | NA | NA | NA | NA | NA | NA | NA |
| 42 | 3.567 | 5.907 | 3.218 | 6.071 | 3.701 | 4.375 | 2.217 |
| 43 | 0.773 | 0.767 | 1.074 | 1.261 | 0.695 | 0.637 | 0.878 |
| 44 | 2.347 | 1.034 | 3.932 | 1.500 | 1.318 | 1.683 | 0.782 |
| 45 | 91.398 | 84.469 | 92.502 | 85.150 | 88.160 | 87.006 | 92.399 |
| 46 | 46.307 | 50.003 | 56.171 | 49.742 | 51.292 | 48.132 | 52.547 |
| 47 | 47.387 | 55.860 | 55.535 | 49.918 | 51.232 | 48.133 | 44.398 |
| 48 | 39.886 | 39.142 | 41.953 | 41.992 | 44.542 | 39.442 | 38.208 |
| 49 | 0.852 | 0.498 | 6.537 | 3.625 | 4.036 | 0.617 | 11.122 |
| 50 | 153.250 | 149.854 | 148.157 | 123.344 | 147.837 | 130.549 | 150.061 |
| 51 | 47.458 | 78.799 | 48.808 | 65.768 | 74.641 | 43.761 | NA |
| 52 | 0.412 | 0.277 | 0.691 | 0.319 | 0.321 | 0.411 | 0.233 |
| 53 | 0.0270 | 0.0265 | 0.0507 | 0.0345 | 0.0239 | 0.0265 | 0.0198 |
| 54 | 1.241 | 1.300 | 4.792 | 4.267 | 2.367 | 1.433 | 4.933 |
| 55 | 15050.0 | 18650.0 | 26500.0 | 47771.4 | 15378.6 | 14791.3 | 23437.3 |
| 56 | NA | NA | NA | NA | NA | NA | NA |
| 57 | 159.390 | 90.693 | 240.230 | 133.705 | 88.750 | 138.098 | 48.102 |
| 58 | 0.139 | 0.134 | 0.267 | 0.194 | 0.115 | 0.129 | 0.092 |
| 59 | 9.779 | 8.566 | 12.728 | 7.753 | 10.945 | 7.753 | 7.522 |
| 60 | 0.387 | 0.242 | 0.634 | 0.280 | 0.259 | 0.368 | 0.193 |
| 61 | 0.014 | 0.017 | 0.038 | 0.028 | 0.011 | 0.016 | 0.012 |
| 62 | 149.525 | 79.330 | 220.486 | 117.570 | 71.401 | 123.368 | 39.803 |
| 63 | 0.069 | 0.055 | 0.147 | 0.106 | 0.071 | 0.092 | 0.092 |
| 64 | 27.277 | 13.002 | 14.810 | 9.341 | 16.670 | 18.492 | 6.211 |
| 65 | 1.183 | 0.731 | 0.793 | 0.497 | 1.229 | 0.934 | 0.566 |
| 66 | 2.106 | 0.885 | 1.349 | 0.366 | 1.251 | 1.460 | 0.593 |
| 67 | 44.016 | 26.275 | 19.654 | 11.967 | 31.069 | 41.683 | 25.750 |

Table 74: Provided are the values of each of the parameters (as described above) measured in Sorghum accessions (Line) under low N conditions. Growth conditions are specified in the experimental procedure section.

TABLE 75

Measured parameters in additional Sorghum accessions under low N conditions

| Line/Corr. ID | Line-22 | Line-23 | Line-24 | Line-25 | Line-26 | Line-27 | Line-28 |
|---|---|---|---|---|---|---|---|
| 1 | 90.328 | 85.738 | 71.241 | 60.074 | 94.779 | 60.588 | 81.112 |
| 2 | 0.194 | 0.209 | 0.145 | 0.151 | NA | 0.074 | 0.012 |
| 3 | 0.407 | 0.693 | 0.225 | 0.277 | 0.472 | 0.179 | 0.050 |

TABLE 75-continued

Measured parameters in additional Sorghum accessions under low N conditions

| Line/Corr. ID | Line-22 | Line-23 | Line-24 | Line-25 | Line-26 | Line-27 | Line-28 |
|---|---|---|---|---|---|---|---|
| 4 | NA | 1.466 | 1.411 | NA | NA | NA | NA |
| 5 | NA | 1.976 | 1.639 | NA | NA | NA | NA |
| 6 | NA | 0.695 | 0.986 | NA | NA | NA | NA |
| 7 | NA | 0.488 | 0.700 | NA | NA | NA | NA |
| 8 | 26.721 | 22.723 | 31.566 | 20.307 | 31.218 | 21.468 | 25.958 |
| 9 | 32880 | 62130 | 28010 | 8133 | NA | 18762 | 13549 |
| 10 | 20.358 | 19.750 | 36.955 | 10.978 | NA | 18.170 | 14.521 |
| 11 | 0.156 | 0.164 | 0.178 | 0.146 | NA | 0.188 | NA |
| 12 | NA | 18.142 | 40.260 | NA | NA | NA | NA |
| 13 | 0.129 | 0.105 | 0.136 | 0.102 | 0.133 | 0.105 | 0.109 |
| 14 | 29.0 | 29.2 | 32.8 | 31.8 | 22.4 | 29.4 | 42.3 |
| 15 | 395.4 | 404.3 | 428.3 | 411.5 | 295.7 | 380.9 | 522.0 |
| 16 | 145.5 | 282.2 | 605.5 | 378.0 | 581.1 | 291.8 | 671.5 |
| 17 | 9.494 | 19.131 | 36.400 | 21.959 | 36.595 | 19.138 | 33.894 |
| 18 | 4496747 | 11541518 | 18740650 | 16305080 | 20382340 | 12164286 | 23557125 |
| 19 | 592.6 | 1907.3 | 3702.6 | 2806.6 | 3624.3 | 2363.9 | 3599.6 |
| 20 | 17.465 | 43.235 | 111.350 | 59.062 | 109.255 | 52.912 | 93.946 |
| 21 | 0.052 | 0.086 | 0.312 | 0.237 | 0.218 | 0.206 | 0.364 |
| 22 | 178.349 | 124.018 | 150.210 | 82.476 | 123.731 | 113.667 | 108.224 |
| 23 | 0.347 | 0.485 | 0.710 | 0.503 | 0.720 | 0.639 | 0.774 |
| 24 | 0.158 | 0.235 | 0.518 | 0.439 | 0.342 | 0.426 | 0.518 |
| 25 | 1.687 | 0.978 | 1.341 | 1.021 | 1.531 | 1.163 | 1.431 |
| 26 | −12.900 | −12.356 | −13.100 | −13.060 | −12.753 | −12.897 | −13.027 |
| 27 | 28.392 | 28.580 | 30.164 | 30.863 | 30.922 | 30.485 | 28.167 |
| 28 | 60.372 | 72.783 | 66.842 | 73.948 | NA | 76.292 | NA |
| 29 | 16953.3 | 26482.6 | 15781.4 | 8543.0 | NA | 15080.6 | 9350.7 |
| 30 | 20.918 | 24.373 | 18.204 | 16.931 | NA | 21.535 | 16.783 |
| 31 | 161.4 | 1071.8 | 2162.9 | 1311.7 | 1900.6 | 1326.5 | 1619.0 |
| 32 | 4.767 | 24.813 | 66.886 | 27.138 | 58.639 | 30.343 | 42.588 |
| 33 | NA | 0.266 | 0.568 | NA | NA | NA | NA |
| 34 | 72.738 | 141.110 | 302.756 | 188.981 | 290.536 | 145.891 | 335.752 |
| 35 | 111.000 | 118.000 | 88.600 | 86.600 | 102.800 | 87.800 | 74.000 |
| 36 | 1060.4 | 1153.7 | 771.5 | 748.3 | 955.2 | 762.3 | 607.3 |
| 37 | 148.3 | 149.2 | 125.3 | 134.0 | 152.2 | NA | NA |
| 38 | 1575.3 | 1586.7 | 1250.8 | 1369.0 | 1631.0 | NA | NA |
| 39 | 912.250 | NA | 751.550 | 677.800 | 901.250 | 727.250 | 574.750 |
| 40 | 1483.8 | 1558.0 | 1199.7 | 1159.8 | 1250.9 | 1143.1 | 1129.3 |
| 41 | NA | 8.785 | 7.165 | NA | NA | NA | NA |
| 42 | 4.003 | 2.981 | 2.915 | 2.884 | 6.847 | 2.319 | 3.891 |
| 43 | 0.839 | 0.854 | 1.546 | 0.817 | 0.830 | 0.572 | 0.740 |
| 44 | 3.399 | 4.557 | 2.643 | 0.907 | NA | 1.354 | 0.847 |
| 45 | 88.581 | 88.916 | 89.900 | 93.134 | 90.596 | 92.356 | 93.272 |
| 46 | 47.819 | 47.105 | 54.950 | 50.338 | 43.192 | 50.742 | 55.121 |
| 47 | 48.950 | 41.013 | 49.182 | 49.587 | 48.732 | 52.500 | 52.931 |
| 48 | 35.946 | 38.519 | 40.503 | 48.417 | 40.564 | 41.089 | 44.604 |
| 49 | 1.761 | NA | 3.736 | 10.924 | 36.793 | 0.502 | 6.363 |
| 50 | 96.895 | 165.864 | 153.371 | 165.165 | NA | 153.072 | 143.283 |
| 51 | 52.295 | 62.874 | 56.192 | 78.702 | NA | 81.757 | NA |
| 52 | 0.629 | 0.804 | 0.614 | 0.185 | NA | 0.274 | 0.340 |
| 53 | 0.0332 | 0.0443 | 0.0442 | 0.0268 | 0.0536 | 0.0296 | 0.0281 |
| 54 | 5.333 | 1.000 | 1.433 | 1.833 | 1.400 | 1.067 | 3.500 |
| 55 | 26033.3 | 13200.0 | 14404.8 | 13600.0 | 15500.0 | 13466.7 | 20520.8 |
| 56 | NA | 194.870 | 128.452 | NA | NA | NA | NA |
| 57 | 306.075 | 385.010 | 180.831 | 53.288 | NA | 80.795 | 70.308 |
| 58 | 0.204 | 0.250 | 0.214 | 0.127 | 0.272 | 0.138 | 0.133 |
| 59 | 9.426 | 11.937 | 12.746 | 9.969 | NA | 10.982 | 9.123 |
| 60 | 0.591 | 0.762 | 0.489 | 0.147 | NA | 0.213 | 0.270 |
| 61 | 0.027 | 0.034 | 0.021 | 0.015 | 0.035 | 0.017 | 0.014 |
| 62 | 285.717 | 365.260 | 143.876 | 42.310 | NA | 62.625 | 55.786 |
| 63 | 0.244 | 0.267 | 0.076 | 0.069 | 0.187 | 0.064 | 0.057 |
| 64 | 7.562 | 9.868 | 19.784 | 12.093 | 25.950 | 9.999 | 15.852 |
| 65 | 0.333 | 0.501 | 1.267 | 0.799 | 1.134 | 0.627 | 1.409 |
| 66 | 0.389 | 0.869 | 2.190 | 1.009 | 2.435 | 1.045 | 1.125 |
| 67 | 4.993 | 23.220 | 44.882 | 30.093 | 36.307 | 25.426 | 33.842 |

Table 75: Provided are the values of each of the parameters (as described above) measured in Sorghum accessions (Line) under low N conditions. Growth conditions are specified in the experimental procedure section.

TABLE 76

Measured parameters in additional Sorghum accessions under low N conditions

| Line/Corr. ID | Line-29 | Line-30 | Line-31 | Line-32 | Line-33 | Line-34 |
|---|---|---|---|---|---|---|
| 1 | 73.956 | 88.152 | 94.306 | 84.535 | 68.632 | 84.006 |
| 2 | 0.084 | 0.254 | 0.088 | 0.118 | 0.220 | 0.205 |
| 3 | 0.092 | 0.069 | 0.175 | 0.137 | 0.326 | 0.404 |
| 4 | NA | 1.684 | NA | 1.326 | NA | 2.015 |
| 5 | NA | 1.532 | NA | 1.478 | NA | 1.703 |
| 6 | NA | 1.380 | NA | 1.137 | NA | 1.584 |
| 7 | NA | 0.856 | NA | 0.808 | NA | 0.539 |
| 8 | 27.928 | 28.402 | 20.911 | 24.414 | 23.544 | 26.070 |
| 9 | 9492 | 14554 | 27231 | 18260 | 18322 | 42073 |
| 10 | 10.883 | 11.098 | 16.014 | 22.554 | 19.837 | 14.741 |
| 11 | NA | NA | 0.200 | 0.178 | 0.159 | 0.158 |
| 12 | NA | 35.158 | NA | 43.484 | NA | 15.477 |
| 13 | 0.118 | 0.116 | 0.098 | 0.113 | 0.104 | 0.109 |
| 14 | 42.3 | 42.0 | 26.3 | 31.3 | 29.8 | 33.2 |
| 15 | 522.5 | 518.8 | 344.9 | 412.3 | 391.0 | 437.0 |
| 16 | 510.9 | 774.6 | 816.4 | 922.4 | 828.4 | 485.5 |
| 17 | 27.858 | 40.001 | 57.513 | 50.774 | 48.677 | 26.396 |
| 18 | 16479475 | 25747580 | 36116975 | 36860650 | 33562075 | 18000140 |
| 19 | 2406.1 | 3436.2 | 6082.5 | 5855.7 | 4395.8 | 3020.8 |
| 20 | 68.157 | 95.293 | 127.781 | 139.390 | 101.239 | 76.087 |
| 21 | 0.344 | 0.334 | 0.256 | 0.366 | 0.300 | 0.114 |
| 22 | 138.647 | 112.243 | 185.571 | 222.258 | 140.774 | 115.633 |
| 23 | 0.635 | 0.926 | 0.969 | 0.996 | 1.040 | 0.585 |
| 24 | 0.610 | 0.533 | 0.425 | 0.535 | 0.486 | 0.176 |
| 25 | 1.080 | 1.161 | 1.018 | 1.144 | 1.062 | 1.281 |
| 26 | −13.023 | −12.976 | −13.033 | −12.842 | −12.637 | −13.032 |
| 27 | 27.846 | 27.982 | 30.517 | 29.685 | 32.517 | 29.522 |
| 28 | NA | NA | 67.302 | 68.590 | 71.740 | 69.007 |
| 29 | 5454.0 | 9065.6 | 20008.0 | 21922.8 | 15977.0 | 18430.4 |
| 30 | 15.374 | 15.420 | 21.194 | 20.837 | 17.496 | 20.502 |
| 31 | 1259.4 | 1724.0 | 3230.2 | 3170.3 | 2099.3 | 1383.3 |
| 32 | 36.016 | 48.781 | 69.211 | 79.250 | 49.550 | 36.400 |
| 33 | NA | 0.592 | NA | 0.577 | NA | 0.312 |
| 34 | 255.429 | 387.307 | 408.199 | 461.182 | 414.199 | 242.755 |
| 35 | 74.000 | 74.000 | 96.500 | 96.000 | 92.500 | 92.000 |
| 36 | 607.3 | 607.3 | 872.8 | 866.3 | 820.0 | 813.4 |
| 37 | NA | 125.0 | 145.0 | NA | 136.5 | 135.5 |
| 38 | NA | 1247.5 | 1528.0 | NA | 1405.5 | 1392.6 |
| 39 | 574.750 | 607.250 | 814.250 | 749.083 | 769.500 | 772.950 |
| 40 | 1129.8 | 1126.0 | 1217.6 | 1278.6 | 1211.0 | 1250.3 |
| 41 | NA | 11.089 | NA | 10.961 | NA | 13.237 |
| 42 | 3.177 | 5.365 | 6.861 | 4.959 | 3.385 | 4.381 |
| 43 | 0.852 | 1.174 | 0.823 | 0.772 | 0.914 | 1.537 |
| 44 | 0.600 | 0.655 | 3.127 | 3.279 | 1.837 | 4.079 |
| 45 | 93.540 | 94.229 | 85.910 | 87.606 | 92.159 | 92.029 |
| 46 | 55.483 | 49.848 | 45.775 | 51.031 | 45.042 | 50.562 |
| 47 | 52.167 | 49.887 | 47.292 | 53.750 | 45.912 | 50.865 |
| 48 | 46.864 | 41.394 | 39.913 | 41.771 | 39.519 | 38.342 |
| 49 | 5.117 | 1.572 | NA | 12.827 | 0.765 | 5.673 |
| 50 | 151.126 | 142.923 | 152.429 | 133.144 | 159.389 | 139.693 |
| 51 | NA | NA | 30.298 | 39.911 | 72.543 | 50.458 |
| 52 | 0.220 | 0.284 | 0.866 | 0.811 | 0.385 | 1.105 |
| 53 | 0.0226 | 0.0310 | 0.0526 | 0.0398 | 0.0319 | 0.0801 |
| 54 | 3.458 | 3.400 | 2.250 | 1.000 | 1.083 | 2.833 |
| 55 | 16495.8 | 17950.0 | 12910.7 | 15812.5 | 15567.9 | 18400.0 |
| 56 | NA | 102.189 | NA | 112.370 | NA | 154.249 |
| 57 | 45.408 | 58.552 | 293.949 | 275.478 | 124.359 | 343.974 |
| 58 | 0.105 | 0.145 | 0.263 | 0.212 | 0.163 | 0.405 |
| 59 | 8.627 | 8.781 | 9.046 | 9.396 | 9.412 | 9.063 |
| 60 | 0.167 | 0.230 | 0.819 | 0.745 | 0.324 | 1.058 |
| 61 | 0.009 | 0.015 | 0.030 | 0.018 | 0.017 | 0.066 |
| 62 | 34.524 | 47.455 | 277.935 | 252.924 | 104.523 | 329.233 |
| 63 | 0.045 | 0.075 | 0.147 | 0.091 | 0.083 | 0.217 |
| 64 | 12.154 | 18.443 | 31.944 | 29.922 | 27.784 | 14.902 |
| 65 | 1.097 | 1.664 | 1.634 | 1.740 | 1.686 | 0.962 |
| 66 | 0.910 | 1.176 | 2.673 | 2.661 | 1.671 | 1.316 |
| 67 | 26.885 | 35.287 | 69.844 | 61.562 | 45.610 | 31.897 |

Table 76: Provided are the values of each of the parameters (as described above) measured in Sorghum accessions (Line) under low N conditions. Growth conditions are specified in the experimental procedure section.

TABLE 77

Correlation between the expression level of selected genes of some embodiments of the invention in various tissues and the phenotypic performance under normal conditions across Sorghum accessions

| Gene Name | R | P value | Exp. set | Corr. ID | Gene Name | R | P value | Exp. set | Corr. ID |
|---|---|---|---|---|---|---|---|---|---|
| LBY149 | 0.79 | 3.32E−02 | 2 | 12 | LBY150 | 0.74 | 5.56E−02 | 2 | 41 |
| LBY153 | 0.82 | 2.28E−02 | 1 | 5 | LBY155 | 0.93 | 2.49E−03 | 1 | 5 |
| LBY156 | 0.82 | 2.43E−02 | 2 | 33 | LBY156 | 0.76 | 4.94E−02 | 2 | 12 |
| LBY156 | 0.81 | 2.82E−02 | 1 | 33 | LBY158 | 0.84 | 1.75E−02 | 2 | 33 |
| LBY158 | 0.77 | 4.12E−02 | 2 | 12 | LBY160 | 0.71 | 7.56E−02 | 2 | 5 |
| LBY160 | 0.72 | 6.56E−02 | 2 | 12 | LBY160 | 0.76 | 2.20E−06 | 1 | 63 |
| LBY160 | 0.71 | 2.01E−05 | 1 | 53 | LBY160 | 0.77 | 3.16E−06 | 1 | 9 |
| LBY160 | 0.74 | 7.02E−06 | 1 | 58 | LBY160 | 0.71 | 2.65E−05 | 1 | 61 |
| LBY161 | 0.91 | 4.87E−03 | 2 | 56 | LBY162 | 0.74 | 5.71E−02 | 2 | 33 |
| LBY162 | 0.72 | 6.94E−02 | 2 | 56 | LBY162 | 0.83 | 2.20E−02 | 1 | 5 |
| LBY163 | 0.80 | 4.11E−07 | 1 | 63 | LBY163 | 0.72 | 6.61E−02 | 1 | 56 |
| LBY164 | 0.82 | 2.29E−02 | 2 | 56 | LBY164 | 0.87 | 1.08E−02 | 1 | 5 |
| LBY165 | 0.79 | 3.59E−02 | 1 | 33 | LBY165 | 0.75 | 4.99E−02 | 1 | 12 |
| LBY167 | 0.80 | 3.21E−02 | 2 | 4 | LBY167 | 0.89 | 7.78E−03 | 2 | 41 |
| LBY168 | 0.72 | 6.66E−02 | 1 | 7 | LBY168 | 0.87 | 1.04E−02 | 1 | 5 |
| LBY168 | 0.73 | 6.14E−02 | 1 | 4 | LBY168 | 0.81 | 2.60E−02 | 1 | 6 |
| LBY170 | 0.77 | 4.08E−02 | 1 | 4 | LBY171 | 0.99 | 4.33E−06 | 2 | 56 |
| LBY171 | 0.71 | 1.05E−04 | 1 | 49 | LBY171 | 0.79 | 3.49E−02 | 1 | 4 |
| LBY173 | 0.72 | 7.08E−02 | 2 | 5 | LBY173 | 0.73 | 6.37E−02 | 2 | 33 |
| LBY173 | 0.94 | 1.58E−03 | 2 | 56 | LBY177 | 0.85 | 1.56E−02 | 2 | 7 |
| LBY177 | 0.70 | 7.82E−02 | 2 | 6 | LBY178 | 0.77 | 4.17E−02 | 2 | 6 |
| LBY178 | 0.77 | 4.36E−02 | 1 | 4 | LBY179 | 0.73 | 6.07E−02 | 2 | 56 |
| LBY180 | 0.97 | 3.03E−04 | 2 | 56 | LBY180 | 0.78 | 3.88E−02 | 1 | 33 |
| LBY180 | 0.72 | 6.98E−02 | 1 | 12 | LBY185 | 0.79 | 6.32E−07 | 1 | 63 |
| LBY185 | 0.72 | 2.10E−05 | 1 | 62 | LBY185 | 0.80 | 6.38E−07 | 1 | 9 |
| LBY185 | 0.70 | 2.90E−05 | 1 | 58 | LBY185 | 0.72 | 2.31E−05 | 1 | 57 |
| LBY185 | 0.83 | 2.03E−02 | 1 | 56 | LBY185 | 0.74 | 5.61E−06 | 1 | 61 |
| LBY186 | 0.78 | 4.01E−02 | 2 | 5 | LBY186 | 0.73 | 6.40E−02 | 2 | 12 |
| LBY186 | 0.70 | 7.76E−02 | 2 | 56 | LBY186 | 0.73 | 6.51E−02 | 1 | 12 |
| LBY187 | 0.71 | 7.18E−02 | 1 | 4 | LBY187 | 0.75 | 5.46E−02 | 1 | 41 |
| LBY189 | 0.76 | 4.94E−02 | 2 | 7 | LBY189 | 0.92 | 3.21E−03 | 2 | 6 |
| LBY190 | 0.78 | 4.03E−02 | 2 | 4 | LBY191 | 0.76 | 4.58E−02 | 1 | 4 |
| LBY192 | 0.73 | 6.34E−02 | 1 | 4 | LGN3 | 0.71 | 7.66E−02 | 2 | 33 |
| LGN4 | 0.72 | 6.56E−02 | 2 | 12 | LGN5 | 0.89 | 6.83E−03 | 2 | 7 |
| LGN5 | 0.77 | 4.14E−02 | 2 | 6 | LGN5 | 0.79 | 3.31E−02 | 1 | 7 |
| LGN5 | 0.76 | 4.96E−02 | 1 | 6 | LGN57 | 0.83 | 1.98E−02 | 2 | 33 |
| LGN7 | 0.95 | 1.09E−03 | 2 | 56 | | | | | |

Table 77. Provided are the correlations (R) between the genes expression levels in various tissues and the phenotypic performance. "Corr. ID "—correlation set ID according to the correlated parameters specified in Table 60. "Exp. Set"—Expression set specified in Table 59. "R" = Pearson correlation coefficient; "P" = p value.

TABLE 78

Correlation between the expression level of selected genes of some embodiments of the invention in various tissues and the phenotypic performance under drought stress conditions across Sorghum accessions

| Gene Name | R | P value | Exp. set | Corr. ID | Gene Name | R | P value | Exp. set | Corr. ID |
|---|---|---|---|---|---|---|---|---|---|
| LBY163 | 0.71 | 6.44E−05 | 3 | 52 | LBY185 | 0.70 | 8.87E−05 | 3 | 49 |
| LBY185 | 0.70 | 9.21E−05 | 3 | 45 | LBY185 | 0.70 | 8.32E−05 | 3 | 52 |

Table 78. Provided are the correlations (R) between the genes expression levels in various tissues and the phenotypic performance "Corr. ID "—correlation set ID according to the correlated parameters specified in Table 61. "Exp. Set"—Expression set specified in Table 59. "R" = Pearson correlation coefficient; "P" = p value

TABLE 79

Correlation between the expression level of selected genes of some embodiments of the invention in various tissues and the phenotypic performance under Low N growth stress conditions across Sorghum accessions

| Gene Name | R | P value | Exp. set | Corr. ID | Gene Name | R | P value | Exp. set | Corr. ID |
|---|---|---|---|---|---|---|---|---|---|
| LBY14 | 0.73 | 6.20E−02 | 4 | 6 | LBY151 | 0.74 | 5.82E−02 | 4 | 41 |
| LBY156 | 0.82 | 2.32E−02 | 4 | 33 | LBY156 | 0.83 | 1.98E−02 | 4 | 12 |
| LBY159 | 0.80 | 2.92E−02 | 4 | 33 | LBY159 | 0.73 | 6.10E−02 | 4 | 12 |
| LBY161 | 0.86 | 1.35E−02 | 4 | 5 | LBY162 | 0.73 | 6.00E−02 | 4 | 33 |
| LBY162 | 0.76 | 4.85E−02 | 4 | 12 | LBY166 | 0.87 | 1.08E−02 | 4 | 4 |

TABLE 79-continued

Correlation between the expression level of selected genes of some embodiments of the invention in various tissues and the phenotypic performance under Low N growth stress conditions across Sorghum accessions

| Gene Name | R | P value | Exp. set | Corr. ID | Gene Name | R | P value | Exp. set | Corr. ID |
|---|---|---|---|---|---|---|---|---|---|
| LBY166 | 0.71 | 7.46E−02 | 4 | 41 | LBY168 | 0.73 | 6.48E−02 | 4 | 56 |
| LBY177 | 0.81 | 2.81E−02 | 4 | 56 | LBY178 | 0.76 | 4.89E−02 | 4 | 7 |
| LBY181 | 0.72 | 6.86E−02 | 4 | 4 | LBY186 | 0.90 | 5.68E−03 | 4 | 56 |
| LBY192 | 0.80 | 2.97E−02 | 4 | 56 | LGN54 | 0.88 | 9.25E−03 | 4 | 7 |
| LGN57 | 0.72 | 6.55E−02 | 4 | 5 | LGN6 | 0.93 | 2.47E−03 | 4 | 6 |

Table 79. Provided are the correlations (R) between the genes expression levels in various tissues and the phenotypic performance. "Corr. ID "—correlation set ID according to the correlated parameters specified in Table 60. "Exp. Set"—Expression set specified in Table 59 "R" = Pearson correlation coefficient; "P" = p value Example 10

Production of Maize Transcriptome and High Throughput Correlation Analysis Using 60K Maize Oligonucleotide Micro-Array To produce a high throughput correlation analysis, the present inventors utilized a Maize oligonucleotide micro-array, produced by Agilent Technologies [chem. (dot) agilent (dot) com/Scripts/PDS (dot) asp?1Page=50879]. The array oligonucleotide represents about 60K Maize genes and transcripts designed based on data from Public databases (Example 1). To define correlations between the levels of RNA expression and yield, biomass components or vigor related parameters, various plant characteristics of 12 different Maize hybrids were analyzed. Among them, 10 hybrids encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

All 10 selected maize hybrids were sampled in three time points (TP2=V2-V3 (when two to three collar leaf are visible, rapid growth phase and kernel row determination begins), TP5=R1-R2 (silking-blister), TP6=R3-R4 (milk-dough). Four types of plant tissues [Ear, flag leaf indicated in Table as leaf, grain distal part, and internode] were sampled and RNA was extracted as described in "GENERAL EXPERIMENTAL AND BIOINFORMATICS METHODS". For convenience, each micro-array expression information tissue type has received a Set ID as summarized in Table 80 below.

TABLE 80

Tissues used for Maize transcriptome expression sets

| Expression Set | Set ID |
|---|---|
| Ear under normal conditions at reproductive stage: R1-R2 | 1 |
| Ear under normal conditions at reproductive stage: R3-R4 | 2 |
| Internode under normal conditions at vegetative stage: Vegetative V2-3 | 3 |
| Internode under normal conditions at reproductive stage: R1-R2 | 4 |
| Internode under normal conditions at reproductive stage: R3-R4 | 5 |
| Leaf under normal conditions at vegetative stage: Vegetative V2-3 | 6 |
| Leaf under normal conditions at reproductive stage: R1-R2 | 7 |
| Grain distal under normal conditions at reproductive stage: R1-R2 | 8 |

Table 80: Provided are the identification (ID) number of each of the Maize expression sets The following parameters were collected:

Grain Area ($cm^2$)—At the end of the growing period the grains were separated from the ear. A sample of ~200 grains was weighted, photographed and images were processed using the below described image processing system. The grain area was measured from those images and was divided by the number of grains.

Grain Length and Grain width (cm)—At the end of the growing period the grains were separated from the ear. A sample of ~200 grains was weighted, photographed and images were processed using the below described image processing system. The sum of grain lengths/or width (longest axis) was measured from those images and was divided by the number of grains.

Ear Area ($cm^2$)—At the end of the growing period 6 ears were, photographed and images were processed using the below described image processing system. The Ear area was measured from those images and was divided by the number of Ears.

Ear Length and Ear Width (cm)—At the end of the growing period 6 ears were photographed and images were processed using the below described image processing system. The Ear length and width (longest axis) was measured from those images and was divided by the number of ears.

Filled per Whole Ear—it was calculated as the length of the ear with grains out of the total ear.

Percent Filled Ear—At the end of the growing period 6 ears were photographed and images were processed using the below described image processing system. The percent filled Ear grain was the ear with grains out of the total ear and was measured from those images and was divided by the number of Ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.), measurement of yield parameter—At the end of the experiment all ears from plots within blocks A-C were collected. Six ears were separately threshed and grains were weighted, all additional ears were threshed together and weighted as well. The grain weight was normalized using the relative humidity to be 0%. The normalized average grain weight per ear was calculated by dividing the total normalized grain weight by the total number of ears per plot (based on plot). In case of 6 ears, the total grains weight of 6 ears was divided by 6.

Ear fresh weight (FW) (gr.)—At the end of the experiment (when ears were harvested) total and 6 selected ears per plots within blocks A-C were collected separately. The plants' ears (total and 6) were weighted (gr.) separately and the average ear per plant was calculated for total (Ear FW per plot) and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located Leaf number per plant—Plants were characterized for leaf number during growing period at 5 time points. In each measure, plants were measured for their leaf number by counting all the leaves of 3 selected plants per plot.

Relative Growth Rate was calculated using regression coefficient of leaf number change a long time course.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Dry weight=total weight of the vegetative portion above ground (excluding roots) after drying at 70° C. in oven for 48 hours.

Dry weight per plant—At the end of the experiment when all vegetative material from plots within blocks A-C were collected, weight and divided by the number of plants.

Ear diameter [cm]—The diameter of the ear at the mid of the ear was measured using a ruler.

Cob diameter [cm]—The diameter of the cob without grains was measured using a ruler.

Kernel Row Number per Ear—The number of rows in each ear was counted. The average of 6 ears per plot was calculated.

Leaf area index [LAI]=total leaf area of all plants in a plot. Measurement was performed using a Leaf area-meter.

Yield/LAI [kg]—is the ratio between total grain yields and total leaf area index.

TABLE 81

Maize correlated parameters (vectors)

| Correlated parameter with | Correlation ID |
|---|---|
| Cob Diameter (mm) | 1 |
| DW per Plant based on 6 (gr.) | 2 |
| Ear Area (cm²) | 3 |

TABLE 81-continued

Maize correlated parameters (vectors)

| Correlated parameter with | Correlation ID |
|---|---|
| Ear FW per Plant based on 6 (gr.) | 4 |
| Ear Height (cm) | 5 |
| Ear Length (cm) | 6 |
| Ear Width (cm) | 7 |
| Ears FW per plant based on all (gr.) | 8 |
| Filled per Whole Ear | 9 |
| Grain Area (cm²) | 10 |
| Grain Length (cm) | 11 |
| Grain Width (cm) | 12 |
| Growth Rate Leaf Number | 13 |
| Kernel Row Number per Ear | 14 |
| Leaf Number per Plant | 15 |
| Normalized Grain Weight per Plant based on all (gr.) | 16 |
| Normalized Grain Weight per plant based on 6 (gr.) | 17 |
| Percent Filled Ear | 18 |
| Plant Height per Plot (cm) | 19 |
| SPAD R1 | 20 |
| SPAD R2 | 21 |

Table 81.

Twelve maize varieties were grown and characterized for parameters, as described above. The average for each parameter was calculated using the JMP software, and values are summarized in Tables 82-83 below. Subsequent correlation between the various transcriptome sets for all or sub sets of lines was done by the bioinformatic unit and results were integrated into the database (Table 84 below).

TABLE 82

Measured parameters in Maize Hybrid

| Ecotype/Treatment | Line-1 | Line-2 | Line-3 | Line-4 | Line-5 | Line-6 |
|---|---|---|---|---|---|---|
| 1 | 28.96 | 25.08 | 28.05 | 25.73 | 28.72 | 25.78 |
| 2 | 657.50 | 491.67 | 641.11 | 580.56 | 655.56 | 569.44 |
| 3 | 85.06 | 85.84 | 90.51 | 95.95 | 91.62 | 72.41 |
| 4 | 245.83 | 208.33 | 262.22 | 263.89 | 272.22 | 177.78 |
| 5 | 135.17 | 122.33 | 131.97 | 114.00 | 135.28 | 94.28 |
| 6 | 19.69 | 19.05 | 20.52 | 21.34 | 20.92 | 18.23 |
| 7 | 5.58 | 5.15 | 5.67 | 5.53 | 5.73 | 5.23 |
| 8 | 278.19 | 217.50 | 288.28 | 247.88 | 280.11 | 175.84 |
| 9 | 0.916 | 0.922 | 0.927 | 0.917 | 0.908 | 0.950 |
| 10 | 0.75 | 0.71 | 0.75 | 0.77 | 0.81 | 0.71 |
| 11 | 1.17 | 1.09 | 1.18 | 1.20 | 1.23 | 1.12 |
| 12 | 0.81 | 0.81 | 0.80 | 0.80 | 0.82 | 0.80 |
| 13 | 0.28 | 0.22 | 0.28 | 0.27 | 0.31 | 0.24 |
| 14 | 16.17 | 14.67 | 16.20 | 15.89 | 16.17 | 15.17 |
| 15 | 12.00 | 11.11 | 11.69 | 11.78 | 11.94 | 12.33 |
| 16 | 153.90 | 135.88 | 152.50 | 159.16 | 140.46 | 117.14 |
| 17 | 140.68 | 139.54 | 153.67 | 176.98 | 156.61 | 119.67 |
| 18 | 80.62 | 86.76 | 82.14 | 92.71 | 80.38 | 82.76 |
| 19 | 278.08 | 260.50 | 275.13 | 238.50 | 286.94 | 224.83 |
| 20 | 51.67 | 56.41 | 53.55 | 55.21 | 55.30 | 59.35 |
| 21 | 54.28 | 57.18 | 56.01 | 59.68 | 54.77 | 59.14 |

Table 82.

TABLE 83

Measured parameters in Maize Hybrid additional parameters

| Ecotype/Treatment | Line-7 | Line-8 | Line-9 | Line-10 | Line-11 | Line-12 |
|---|---|---|---|---|---|---|
| 1 | 26.43 | 25.19 | | 26.67 | | |
| 2 | 511.11 | 544.44 | | 574.17 | 522.22 | |
| 3 | 74.03 | 76.53 | | 55.20 | 95.36 | |
| 4 | 188.89 | 197.22 | | 141.11 | 261.11 | |
| 5 | 120.94 | 107.72 | | 60.44 | 112.50 | |
| 6 | 19.02 | 18.57 | | 16.69 | 21.70 | |

TABLE 83-continued

Measured parameters in Maize Hybrid additional parameters

| Ecotype/Treatment | Line-7 | Line-8 | Line-9 | Line-10 | Line-11 | Line-12 |
|---|---|---|---|---|---|---|
| 7 | 5.22 | 5.33 | | 4.12 | 5.58 | |
| 8 | 192.47 | 204.70 | | 142.72 | 264.24 | |
| 9 | 0.87 | 0.94 | | 0.80 | 0.96 | |
| 10 | 0.71 | 0.75 | | 0.50 | 0.76 | |
| 11 | 1.14 | 1.13 | | 0.92 | 1.18 | |
| 12 | 0.79 | 0.84 | | 0.67 | 0.81 | |
| 13 | 0.24 | 0.27 | | 0.19 | 0.30 | |
| 14 | 16.00 | 14.83 | | 14.27 | 15.39 | |
| 15 | 12.44 | 12.22 | | 9.28 | 12.56 | |
| 16 | 123.24 | 131.27 | | 40.84 | 170.66 | |
| 17 | 119.69 | 133.51 | | 54.32 | 173.23 | |
| 18 | 73.25 | 81.06 | | 81.06 | 91.60 | |
| 19 | 264.44 | 251.61 | | 163.78 | 278.44 | |
| 20 | 58.48 | 55.88 | 52.98 | 53.86 | 59.75 | 49.99 |
| 21 | 57.99 | 60.36 | 54.77 | 51.39 | 61.14 | 53.34 |

Table 83

TABLE 84

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LBY103 | 0.80 | 5.38E−02 | 1 | 1 | LBY103 | 0.83 | 4.17E−02 | 2 | 12 |
| LBY104 | 0.77 | 7.55E−02 | 7 | 1 | LBY104 | 0.71 | 7.40E−02 | 1 | 15 |
| LBY104 | 0.72 | 6.85E−02 | 1 | 9 | LBY104 | 0.76 | 4.90E−02 | 1 | 12 |
| LBY104 | 0.83 | 1.07E−02 | 8 | 1 | LBY104 | 0.81 | 1.53E−02 | 8 | 14 |
| LBY104 | 0.93 | 7.12E−04 | 8 | 13 | LBY104 | 0.92 | 1.32E−03 | 8 | 11 |
| LBY104 | 0.74 | 3.47E−02 | 8 | 6 | LBY104 | 0.84 | 9.30E−03 | 8 | 10 |
| LBY104 | 0.92 | 1.05E−03 | 8 | 2 | LBY104 | 0.96 | 1.42E−04 | 8 | 7 |
| LBY104 | 0.79 | 2.05E−02 | 8 | 8 | LBY104 | 0.81 | 1.47E−02 | 8 | 4 |
| LBY104 | 0.72 | 1.03E−01 | 2 | 14 | LBY104 | 0.79 | 6.28E−02 | 2 | 9 |
| LBY105 | 0.77 | 4.07E−02 | 4 | 3 | LBY105 | 0.73 | 6.18E−02 | 4 | 16 |
| LBY105 | 0.83 | 2.19E−02 | 4 | 14 | LBY105 | 0.72 | 6.98E−02 | 4 | 6 |
| LBY105 | 0.80 | 3.15E−02 | 4 | 19 | LBY105 | 0.87 | 1.14E−02 | 4 | 5 |
| LBY105 | 0.77 | 4.17E−02 | 4 | 7 | LBY105 | 0.92 | 3.50E−03 | 4 | 8 |
| LBY105 | 0.82 | 2.37E−02 | 4 | 4 | LBY105 | 0.72 | 6.90E−02 | 1 | 14 |
| LBY105 | 0.76 | 4.61E−02 | 1 | 11 | LBY105 | 0.76 | 4.84E−02 | 1 | 10 |
| LBY105 | 0.72 | 6.82E−02 | 1 | 19 | LBY105 | 0.75 | 5.20E−02 | 1 | 7 |
| LBY105 | 0.71 | 7.64E−02 | 1 | 12 | LBY105 | 0.77 | 2.57E−02 | 8 | 9 |
| LBY105 | 0.72 | 3.00E−02 | 3 | 14 | LBY105 | 0.71 | 3.36E−02 | 3 | 11 |
| LBY105 | 0.71 | 3.15E−02 | 3 | 10 | LBY105 | 0.78 | 1.28E−02 | 3 | 18 |
| LBY105 | 0.74 | 2.13E−02 | 3 | 19 | LBY105 | 0.83 | 5.48E−03 | 3 | 5 |
| LBY105 | 0.77 | 1.63E−02 | 3 | 7 | LBY105 | 0.81 | 8.53E−03 | 3 | 8 |
| LBY105 | 0.72 | 2.95E−02 | 3 | 4 | LBY105 | 0.77 | 7.04E−02 | 2 | 14 |
| LBY105 | 0.87 | 2.56E−02 | 2 | 2 | LBY105 | 0.81 | 5.01E−02 | 2 | 5 |
| LBY106 | 0.71 | 4.65E−02 | 5 | 12 | LBY106 | 0.74 | 5.58E−02 | 4 | 8 |
| LBY107 | 0.79 | 2.02E−02 | 5 | 9 | LBY107 | 0.71 | 7.11E−02 | 4 | 6 |
| LBY107 | 0.77 | 4.25E−02 | 4 | 18 | LBY107 | 0.71 | 7.14E−02 | 4 | 2 |
| LBY107 | 0.74 | 5.78E−02 | 7 | 15 | LBY107 | 0.75 | 5.06E−02 | 7 | 21 |
| LBY107 | 0.82 | 2.37E−02 | 7 | 9 | LBY107 | 0.84 | 1.93E−02 | 7 | 12 |
| LBY107 | 0.76 | 1.08E−02 | 6 | 3 | LBY107 | 0.77 | 9.15E−03 | 6 | 16 |
| LBY107 | 0.76 | 1.06E−02 | 6 | 17 | LBY107 | 0.83 | 4.32E−02 | 2 | 9 |
| LBY107 | 0.74 | 9.17E−02 | 2 | 18 | LBY107 | 0.72 | 1.05E−01 | 2 | 12 |
| LBY110 | 0.70 | 7.69E−02 | 7 | 3 | LBY110 | 0.77 | 4.38E−02 | 7 | 16 |
| LBY110 | 0.74 | 5.64E−02 | 7 | 15 | LBY110 | 0.91 | 3.87E−03 | 7 | 13 |
| LBY110 | 0.79 | 3.46E−02 | 7 | 21 | LBY110 | 0.79 | 3.38E−02 | 7 | 11 |
| LBY110 | 0.78 | 3.82E−02 | 7 | 6 | LBY110 | 0.76 | 4.61E−02 | 7 | 10 |
| LBY110 | 0.75 | 5.09E−02 | 7 | 7 | LBY110 | 0.74 | 5.50E−02 | 7 | 4 |
| LBY110 | 0.78 | 3.70E−02 | 7 | 17 | LBY110 | 0.72 | 4.21E−02 | 8 | 1 |
| LBY110 | 0.77 | 1.51E−02 | 3 | 9 | LBY110 | 0.75 | 8.75E−02 | 2 | 12 |
| LBY112 | 0.71 | 7.35E−02 | 4 | 14 | LBY112 | 0.78 | 3.73E−02 | 1 | 15 |
| LBY112 | 0.78 | 3.89E−02 | 1 | 9 | LBY112 | 0.72 | 6.88E−02 | 1 | 10 |
| LBY112 | 0.77 | 4.48E−02 | 1 | 12 | LBY112 | 0.73 | 9.94E−02 | 2 | 14 |
| LBY113 | 0.80 | 3.14E−02 | 1 | 15 | LBY113 | 0.82 | 2.40E−02 | 1 | 9 |
| LBY113 | 0.82 | 2.48E−02 | 1 | 12 | LBY113 | 0.78 | 2.26E−02 | 8 | 1 |
| LBY113 | 0.92 | 1.35E−03 | 8 | 13 | LBY113 | 0.82 | 1.33E−02 | 8 | 11 |
| LBY113 | 0.88 | 3.82E−03 | 8 | 10 | LBY113 | 0.80 | 1.70E−02 | 8 | 2 |
| LBY113 | 0.82 | 1.19E−02 | 8 | 7 | LBY113 | 0.71 | 4.78E−02 | 8 | 8 |
| LBY113 | 0.70 | 5.15E−02 | 8 | 4 | LBY114 | 0.73 | 6.49E−02 | 4 | 3 |
| LBY116 | 0.74 | 3.44E−02 | 5 | 6 | LBY116 | 0.89 | 1.89E−02 | 7 | 1 |
| LBY116 | 0.77 | 4.21E−02 | 7 | 2 | LBY116 | 0.73 | 4.16E−02 | 8 | 13 |
| LBY116 | 0.76 | 3.00E−02 | 8 | 11 | LBY116 | 0.76 | 3.03E−02 | 8 | 2 |
| LBY116 | 0.87 | 2.37E−02 | 2 | 14 | LBY117 | 0.77 | 4.17E−02 | 1 | 15 |
| LBY117 | 0.78 | 3.82E−02 | 1 | 9 | LBY117 | 0.71 | 7.41E−02 | 1 | 12 |
| LBY117 | 0.86 | 5.61E−03 | 8 | 15 | LBY117 | 0.97 | 1.59E−03 | 2 | 14 |
| LBY117 | 0.92 | 9.96E−03 | 2 | 5 | LBY118 | 0.70 | 7.89E−02 | 1 | 5 |

TABLE 84-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LBY118 | 0.75 | 3.26E−02 | 8 | 13 | LBY118 | 0.80 | 1.63E−02 | 8 | 2 |
| LBY118 | 0.79 | 6.29E−02 | 2 | 14 | LBY119 | 0.71 | 7.40E−02 | 1 | 16 |
| LBY119 | 0.89 | 7.69E−03 | 1 | 15 | LBY119 | 0.76 | 4.62E−02 | 1 | 11 |
| LBY119 | 0.94 | 1.93E−03 | 1 | 9 | LBY119 | 0.86 | 1.41E−02 | 1 | 10 |
| LBY119 | 0.73 | 6.33E−02 | 1 | 19 | LBY119 | 0.80 | 3.21E−02 | 1 | 7 |
| LBY119 | 0.93 | 2.20E−03 | 1 | 12 | LBY119 | 0.74 | 3.57E−02 | 8 | 13 |
| LBY119 | 0.78 | 2.25E−02 | 8 | 2 | LBY120 | 0.72 | 1.08E−01 | 4 | 1 |
| LBY120 | 0.70 | 5.17E−02 | 8 | 14 | LBY120 | 0.72 | 4.19E−02 | 8 | 13 |
| LBY120 | 0.73 | 4.09E−02 | 8 | 11 | LBY120 | 0.85 | 7.21E−03 | 8 | 2 |
| LBY120 | 0.81 | 1.55E−02 | 8 | 7 | LBY120 | 0.74 | 9.26E−02 | 2 | 14 |
| LBY121 | 0.82 | 2.25E−02 | 7 | 19 | LBY121 | 0.73 | 6.24E−02 | 7 | 5 |
| LBY121 | 0.75 | 5.18E−02 | 7 | 12 | LBY121 | 0.94 | 1.45E−03 | 1 | 3 |
| LBY121 | 0.86 | 1.27E−02 | 1 | 16 | LBY121 | 0.82 | 2.43E−02 | 1 | 14 |
| LBY121 | 0.74 | 5.70E−02 | 1 | 13 | LBY121 | 0.84 | 1.88E−02 | 1 | 11 |
| LBY121 | 0.92 | 3.46E−03 | 1 | 6 | LBY121 | 0.79 | 3.31E−02 | 1 | 9 |
| LBY121 | 0.77 | 4.36E−02 | 1 | 10 | LBY121 | 0.70 | 7.96E−02 | 1 | 18 |
| LBY121 | 0.73 | 6.00E−02 | 1 | 19 | LBY121 | 0.82 | 2.31E−02 | 1 | 5 |
| LBY121 | 0.80 | 3.00E−02 | 1 | 7 | LBY121 | 0.89 | 7.17E−03 | 1 | 8 |
| LBY121 | 0.89 | 7.24E−03 | 1 | 12 | LBY121 | 0.95 | 1.07E−03 | 1 | 4 |
| LBY121 | 0.91 | 4.34E−03 | 1 | 17 | LBY121 | 0.73 | 1.03E−01 | 2 | 15 |
| LBY123 | 0.79 | 3.30E−02 | 4 | 14 | LBY123 | 0.79 | 3.62E−02 | 1 | 3 |
| LBY123 | 0.74 | 5.72E−02 | 1 | 16 | LBY123 | 0.84 | 1.68E−02 | 1 | 14 |
| LBY123 | 0.79 | 3.57E−02 | 1 | 13 | LBY123 | 0.71 | 7.65E−02 | 1 | 11 |
| LBY123 | 0.86 | 1.36E−02 | 1 | 6 | LBY123 | 0.71 | 7.60E−02 | 1 | 19 |
| LBY123 | 0.74 | 5.80E−02 | 1 | 7 | LBY123 | 0.90 | 6.03E−03 | 1 | 8 |
| LBY123 | 0.87 | 1.07E−02 | 1 | 4 | LBY123 | 0.73 | 6.36E−02 | 1 | 17 |
| LBY123 | 0.73 | 3.82E−02 | 8 | 1 | LBY123 | 0.79 | 1.06E−02 | 3 | 3 |
| LBY123 | 0.76 | 1.82E−02 | 3 | 11 | LBY123 | 0.81 | 7.96E−03 | 3 | 6 |
| LBY123 | 0.75 | 2.03E−02 | 3 | 10 | LBY123 | 0.78 | 1.34E−02 | 3 | 19 |
| LBY123 | 0.72 | 2.89E−02 | 3 | 7 | LBY123 | 0.76 | 1.76E−02 | 3 | 4 |
| LBY123 | 0.79 | 1.19E−02 | 3 | 17 | LBY233 | 0.88 | 2.10E−02 | 2 | 14 |
| LBY233 | 0.71 | 1.13E−01 | 2 | 5 | LBY5 | 0.76 | 4.59E−02 | 7 | 15 |
| LBY5 | 0.75 | 2.07E−02 | 6 | 1 | LBY5 | 0.74 | 1.44E−02 | 6 | 14 |
| LBY5 | 0.76 | 1.09E−02 | 6 | 2 | LBY5 | 0.73 | 1.67E−02 | 6 | 5 |
| LBY5 | 0.78 | 8.34E−03 | 6 | 8 | LBY5 | 0.76 | 2.84E−02 | 3 | 1 |
| LBY5 | 0.78 | 6.53E−02 | 2 | 9 | LBY5 | 0.78 | 6.57E−02 | 2 | 18 |
| LBY5 | 0.96 | 2.27E−03 | 2 | 12 | LBY6 | 0.77 | 4.29E−02 | 4 | 13 |
| LBY6 | 0.78 | 3.67E−02 | 4 | 6 | LBY6 | 0.87 | 1.03E−02 | 1 | 13 |
| LBY6 | 0.74 | 5.80E−02 | 1 | 6 | LBY6 | 0.74 | 5.76E−02 | 1 | 4 |
| LGN17 | 0.72 | 4.42E−02 | 5 | 18 | LGN17 | 0.84 | 3.85E−02 | 4 | 1 |
| LGN17 | 0.85 | 1.63E−02 | 4 | 2 | LGN17 | 0.76 | 7.70E−02 | 1 | 1 |
| LGN17 | 0.74 | 5.57E−02 | 1 | 2 | LGN17 | 0.89 | 1.71E−02 | 2 | 9 |
| LGN17 | 0.88 | 2.20E−02 | 2 | 18 | LGN20 | 0.70 | 7.85E−02 | 4 | 3 |
| LGN20 | 0.81 | 2.63E−02 | 4 | 18 | LGN20 | 0.73 | 6.22E−02 | 7 | 3 |
| LGN20 | 0.72 | 6.58E−02 | 7 | 5 | LGN20 | 0.74 | 5.85E−02 | 1 | 19 |
| LGN20 | 0.71 | 7.17E−02 | 1 | 12 | LGN20 | 0.72 | 2.97E−02 | 3 | 3 |
| LGN20 | 0.73 | 2.51E−02 | 3 | 13 | LGN20 | 0.73 | 2.52E−02 | 3 | 19 |
| LGN20 | 0.74 | 2.37E−02 | 3 | 5 | LGN20 | 0.75 | 1.91E−02 | 3 | 8 |
| LGN20 | 0.77 | 1.51E−02 | 3 | 4 | LGN20 | 0.80 | 5.37E−02 | 2 | 13 |
| LGN20 | 0.71 | 1.15E−01 | 2 | 9 | LGN20 | 0.92 | 1.04E−02 | 2 | 10 |
| LGN20 | 0.71 | 1.11E−01 | 2 | 18 | LGN20 | 0.74 | 9.14E−02 | 2 | 12 |
| LGN20 | 0.73 | 1.02E−01 | 2 | 17 | LGN23 | 0.91 | 6.58E−04 | 6 | 1 |
| LGN23 | 0.79 | 6.88E−03 | 6 | 13 | LGN23 | 0.85 | 2.00E−03 | 6 | 2 |
| LGN23 | 0.83 | 2.68E−03 | 6 | 8 | LGN23 | 0.78 | 7.60E−03 | 6 | 4 |
| LGN24 | 0.76 | 8.07E−02 | 2 | 9 | LGN26 | 0.77 | 2.65E−02 | 5 | 10 |
| LGN26 | 0.73 | 9.62E−02 | 1 | 1 | LGN26 | 0.82 | 1.22E−02 | 8 | 1 |
| LGN26 | 0.73 | 3.78E−02 | 8 | 14 | LGN26 | 0.77 | 2.58E−02 | 8 | 13 |
| LGN26 | 0.71 | 4.85E−02 | 8 | 11 | LGN26 | 0.73 | 4.08E−02 | 8 | 2 |
| LGN26 | 0.71 | 4.99E−02 | 8 | 5 | LGN26 | 0.72 | 4.39E−02 | 8 | 7 |
| LGN26 | 0.70 | 5.25E−02 | 8 | 8 | LGN33 | 0.73 | 1.02E−01 | 2 | 9 |
| LGN33 | 0.96 | 2.67E−03 | 2 | 12 | LGN34 | 0.79 | 1.87E−02 | 5 | 9 |
| LGN34 | 0.85 | 1.43E−02 | 4 | 3 | LGN34 | 0.92 | 3.81E−03 | 4 | 16 |
| LGN34 | 0.79 | 3.46E−02 | 4 | 14 | LGN34 | 0.80 | 3.02E−02 | 4 | 15 |
| LGN34 | 0.86 | 1.40E−02 | 4 | 11 | LGN34 | 0.79 | 3.40E−02 | 4 | 6 |
| LGN34 | 0.91 | 5.03E−03 | 4 | 9 | LGN34 | 0.89 | 6.98E−03 | 4 | 10 |
| LGN34 | 0.92 | 2.89E−03 | 4 | 19 | LGN34 | 0.90 | 5.43E−03 | 4 | 5 |
| LGN34 | 0.90 | 5.75E−03 | 4 | 7 | LGN34 | 0.88 | 8.56E−03 | 4 | 8 |
| LGN34 | 0.87 | 1.09E−02 | 4 | 12 | LGN34 | 0.82 | 2.39E−02 | 4 | 4 |
| LGN34 | 0.87 | 1.17E−02 | 4 | 17 | LGN34 | 0.86 | 1.38E−02 | 1 | 3 |
| LGN34 | 0.92 | 3.40E−03 | 1 | 16 | LGN34 | 0.78 | 4.06E−02 | 1 | 14 |
| LGN34 | 0.94 | 1.95E−03 | 1 | 15 | LGN34 | 0.74 | 5.79E−02 | 1 | 13 |
| LGN34 | 0.93 | 2.15E−03 | 1 | 11 | LGN34 | 0.77 | 4.40E−02 | 1 | 6 |
| LGN34 | 0.96 | 7.52E−04 | 1 | 9 | LGN34 | 0.93 | 2.48E−03 | 1 | 10 |

TABLE 84-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LGN34 | 0.86 | 1.37E−02 | 1 | 19 | LGN34 | 0.88 | 8.85E−03 | 1 | 5 |
| LGN34 | 0.95 | 1.06E−03 | 1 | 7 | LGN34 | 0.78 | 4.01E−02 | 1 | 8 |
| LGN34 | 0.86 | 1.37E−02 | 1 | 12 | LGN34 | 0.79 | 3.47E−02 | 1 | 4 |
| LGN34 | 0.89 | 7.17E−03 | 1 | 17 | LGN34 | 0.81 | 1.39E−02 | 8 | 1 |
| LGN34 | 0.75 | 3.17E−02 | 8 | 2 | LGN34 | 0.83 | 5.24E−03 | 3 | 3 |
| LGN34 | 0.88 | 1.89E−03 | 3 | 16 | LGN34 | 0.83 | 5.86E−03 | 3 | 15 |
| LGN34 | 0.88 | 1.92E−03 | 3 | 13 | LGN34 | 0.90 | 1.08E−03 | 3 | 11 |
| LGN34 | 0.75 | 1.93E−02 | 3 | 6 | LGN34 | 0.84 | 4.77E−03 | 3 | 9 |
| LGN34 | 0.93 | 2.61E−04 | 3 | 10 | LGN34 | 0.83 | 5.17E−03 | 3 | 19 |
| LGN34 | 0.78 | 1.38E−02 | 3 | 5 | LGN34 | 0.94 | 2.12E−04 | 3 | 7 |
| LGN34 | 0.82 | 6.92E−03 | 3 | 8 | LGN34 | 0.89 | 1.28E−03 | 3 | 12 |
| LGN34 | 0.83 | 6.02E−03 | 3 | 4 | LGN34 | 0.89 | 1.40E−03 | 3 | 17 |
| LGN34 | 0.77 | 7.59E−02 | 2 | 15 | LGN35 | 0.77 | 2.45E−02 | 5 | 5 |
| LGN35 | 0.84 | 4.42E−03 | 6 | 1 | LGN35 | 0.79 | 7.08E−03 | 6 | 2 |
| LGN35 | 0.70 | 1.19E−01 | 2 | 7 | LGN36 | 0.74 | 8.96E−02 | 7 | 1 |
| LGN36 | 0.78 | 8.34E−03 | 6 | 18 | LGN36 | 0.79 | 5.95E−02 | 2 | 12 |
| LGN39 | 0.71 | 7.54E−02 | 4 | 16 | LGN39 | 0.74 | 5.83E−02 | 4 | 15 |
| LGN39 | 0.82 | 2.34E−02 | 4 | 13 | LGN39 | 0.75 | 5.34E−02 | 4 | 6 |
| LGN39 | 0.74 | 9.14E−02 | 1 | 1 | LGN39 | 0.74 | 5.97E−02 | 1 | 14 |
| LGN39 | 0.71 | 7.50E−02 | 1 | 13 | LGN39 | 0.72 | 7.02E−02 | 1 | 6 |
| LGN39 | 0.71 | 7.30E−02 | 1 | 8 | LGN39 | 0.73 | 6.52E−02 | 1 | 4 |
| LGN39 | 0.78 | 2.16E−02 | 8 | 19 | LGN39 | 0.77 | 2.62E−02 | 8 | 5 |
| LGN49 | 0.70 | 7.73E−02 | 4 | 9 | LGN49 | 0.82 | 1.27E−02 | 8 | 1 |
| LGN49 | 0.78 | 2.34E−02 | 8 | 2 | LGN61 | 0.83 | 1.10E−02 | 5 | 2 |

Table 84. Provided are the correlations (R) between the expression levels of the yield improving genes and their homologs in various tissues [Expression (Exp) sets, Table 80] and the phenotypic performance [yield, biomass, growth rate and/or vigor components (Table 82-83) as determined using the Correlation vector (Corr.) in Table 81)] under normal conditions across maize varieties. P = p value.

Example 11

Production of Maize Transcriptome and High Throughput Correlation Analysis with Yield, NUE, and ABST Related Parameters Measured in Semi-Hydroponics Conditions Using 60K Maize Oligonucleotide Micro-Arrays Maize vigor related parameters under low nitrogen, 100 mM NaCl, low temperature (10±2° C.) and normal growth conditions—Twelve Maize hybrids were grown in 5 repetitive plots, each containing 7 plants, at a net house under semi-hydroponics conditions. Briefly, the growing protocol was as follows: Maize seeds were sown in trays filled with a mix of vermiculite and peat in a 1:1 ratio. Following germination, the trays were transferred to the high salinity solution (100 mM NaCl in addition to the Full Hoagland solution at 28±2° C., low temperature ("cold conditions" of 10±2° C. in the presence of Full Hoagland solution), low nitrogen solution (the amount of total nitrogen was reduced in 90% from the full Hoagland solution (i.e., to a final concentration of 10% from full Hoagland solution, final amount of 1.6 mM N, at 28±2° C.) or at Normal growth solution (Full Hoagland containing 16 mM N solution, at 28±2° C.). Plants were grown at 28±2° C.

Full Hoagland solution consists of: $KNO_3$—0.808 grams/liter, $MgSO_4$—0.12 grams/liter, $KH_2PO_4$—0.136 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Analyzed Maize tissues—Twelve selected Maize hybrids were sampled per each treatment. Two tissues [leaves and root tip] growing at 100 mM NaCl, low temperature (10±2° C.), low Nitrogen (1.6 mM N) or under Normal conditions were sampled at the vegetative stage (V4-5) and RNA was extracted as described above. Each micro-array expression information tissue type has received a Set ID as summarized in Table 85-88 below.

TABLE 85

Maize transcriptome expression sets under semi hydroponics and normal conditions

| Expression set | Set ID |
|---|---|
| leaf at vegetative stage (V4-V5) under Normal conditions | 1 |
| root tip at vegetative stage (V4-V5) under Normal conditions | 2 |

Table 85: Provided are the Maize transcriptome expression sets at normal conditions.

TABLE 86

Maize transcriptome expression sets under semi hydroponics and cold conditions

| Expression set | Set ID |
|---|---|
| leaf at vegetative stage (V4-V5) under cold conditions | 1 |
| root tip at vegetative stage (V4-V5) under cold conditions | 2 |

Table 86: Provided are the Maize transcriptome expression sets at cold conditions.

TABLE 87

Maize transcriptome expression sets under semi hydroponics and low N (Nitrogen deficient) conditions

| Expression set | Set ID |
|---|---|
| leaf at vegetative stage (V4-V5) under low N conditions (1.6 mM N) | 1 |
| root tip at vegetative stage (V4-V5) under low N conditions (1.6 mM N) | 2 |

Table 87: Provided are the Maize transcriptome expression sets at low nitrogen conditions 1.6 mM Nitrogen.

TABLE 88

Maize transcriptome expression sets under semi hydroponics and salinity conditions

| Expression set | Set ID |
|---|---|
| leaf at vegetative stage (V4-V5) under salinity conditions (NaCl 100 mM) | 1 |
| root tip at vegetative stage (V4-V5) under salinity conditions (NaCl 100 mM) | 2 |

Table 88: Provided are the Maize transcriptome expression sets at 100 mM NaCl.

The following parameters were collected:

Leaves DW—leaves dry weight per plant (average of five plants).

Plant Height growth—was calculated as regression coefficient of plant height [cm] along time course (average of five plants).

Root DW—root dry weight per plant, all vegetative tissue above ground (average of four plants).

Root length—the length of the root was measured at V4 developmental stage.

Shoot DW—shoot dry weight per plant, all vegetative tissue above ground (average of four plants) after drying at 70° C. in oven for 48 hours.

Shoot FW—shoot fresh weight per plant, all vegetative tissue above ground (average of four plants).

SPAD—Chlorophyll content was determined using a Minolta SPAD 502 chlorophyll meter and measurement was performed 30 days post sowing. SPAD meter readings were done on young fully developed leaf. Three measurements per leaf were taken per plot.

Experimental Results 12 different Maize hybrids were grown and characterized at the vegetative stage (V4-5) for different parameters. The correlated parameters are described in Table 89 below. The average for each of the measured parameter was calculated using the JMP software and values are summarized in Tables 90-97 below. Subsequent correlation analysis was performed (Table 98-101). Results were then integrated to the database.

TABLE 89

Maize correlated parameters (vectors)

| Correlated parameter with | Correlation ID |
|---|---|
| Leaves DW [gr] | 1 |
| Plant height growth [cm/day] | 2 |
| Root DW [gr] | 3 |
| Root length [cm] | 4 |
| SPAD | 5 |
| Shoot DW [gr] | 6 |
| Shoot FW [gr] | 7 |

Table 89: Provided are the Maize correlated parameters. "DW"-dry weight; "FW"-fresh weight.

TABLE 90

Maize accessions, measured parameters under low nitrogen growth conditions

| Ecotype/Treatment | Line-1 | Line-2 | Line-3 | Line-4 | Line-5 | Line-6 |
|---|---|---|---|---|---|---|
| 1 | 0.57 | 0.45 | 0.46 | 0.48 | 0.36 | 0.51 |
| 2 | 0.75 | 0.81 | 0.88 | 0.69 | 0.83 | 0.84 |
| 3 | 0.38 | 0.35 | 0.25 | 0.36 | 0.31 | 0.30 |
| 4 | 44.50 | 45.63 | 44.25 | 43.59 | 40.67 | 42.03 |
| 5 | 21.43 | 21.24 | 22.23 | 24.56 | 22.75 | 26.47 |
| 6 | 2.56 | 1.96 | 2.01 | 1.94 | 1.94 | 2.52 |
| 7 | 23.27 | 20.58 | 19.26 | 20.02 | 17.98 | 22.06 |

Table 90: Provided are the values of each of the parameters (as described above) measured in Maize accessions (Seed ID) under low nitrogen (nitrogen deficient) conditions. Growth conditions are specified in the experimental procedure section.

TABLE 91

Maize accessions, measured parameters under low nitrogen growth conditions

| Ecotype/Treatment | Line-7 | Line-8 | Line-9 | Line-10 | Line-11 | Line-12 |
|---|---|---|---|---|---|---|
| 1 | 0.53 | 0.58 | 0.55 | 0.51 | 0.56 | 0.39 |
| 2 | 0.78 | 0.92 | 0.89 | 0.85 | 0.80 | 0.64 |
| 3 | 0.29 | 0.31 | 0.29 | 0.32 | 0.43 | 0.17 |
| 4 | 42.65 | 45.06 | 45.31 | 42.17 | 41.03 | 37.65 |
| 5 | 22.08 | 25.09 | 23.73 | 25.68 | 25.02 | 19.51 |
| 6 | 2.03 | 2.37 | 2.09 | 2.17 | 2.62 | 1.53 |
| 7 | 21.28 | 22.13 | 20.29 | 19.94 | 22.50 | 15.93 |

Table 91: Provided are the values of each of the parameters (as described above) measured in Maize accessions (Seed ID) under low nitrogen (nitrogen deficient) conditions. Growth conditions are specified in the experimental procedure section.

TABLE 92

Maize accessions, measured parameters under 100 mM NaCl growth conditions

| Ecotype/Treatment | Line-1 | Line-2 | Line-3 | Line-4 | Line-5 | Line-6 |
|---|---|---|---|---|---|---|
| 1 | 0.41 | 0.50 | 0.43 | 0.48 | 0.43 | 0.56 |
| 2 | 0.46 | 0.40 | 0.45 | 0.32 | 0.32 | 0.31 |
| 3 | 0.05 | 0.05 | 0.03 | 0.07 | 0.05 | 0.03 |
| 4 | 10.88 | 11.28 | 11.82 | 10.08 | 8.46 | 10.56 |
| 5 | 36.55 | 39.92 | 37.82 | 41.33 | 40.82 | 44.40 |
| 6 | 2.43 | 2.19 | 2.25 | 2.26 | 1.54 | 1.94 |
| 7 | 19.58 | 20.78 | 18.45 | 19.35 | 15.65 | 16.09 |

Table 92: Provided are the values of each of the parameters (as described above) measured in Maize accessions (Seed ID) under 100 mM NaCl (salinity) growth conditions. Growth conditions are specified in the experimental procedure section.

TABLE 93

Maize accessions, measured parameters under 100 mM NaCl growth conditions

| Ecotype/Treatment | Line-7 | Line-8 | Line-9 | Line-10 | Line-11 | Line-12 |
|---|---|---|---|---|---|---|
| 1 | 0.33 | 0.51 | 0.47 | 0.98 | 0.48 | 0.15 |
| 2 | 0.29 | 0.36 | 0.37 | 0.35 | 0.31 | 0.27 |
| 3 | 0.10 | 0.06 | 0.02 | 0.04 | 0.05 | 0.01 |
| 4 | 10.14 | 11.83 | 10.55 | 11.18 | 10.09 | 8.90 |
| 5 | 37.92 | 43.22 | 39.83 | 38.20 | 38.14 | 37.84 |
| 6 | 1.78 | 1.90 | 1.89 | 2.20 | 1.86 | 0.97 |
| 7 | 12.46 | 16.92 | 16.75 | 17.64 | 15.90 | 9.40 |

Table 93: Provided are the values of each of the parameters (as described above) measured in Maize accessions (Seed ID) under 100 mM NaCl (salinity) growth conditions. Growth conditions are specified in the experimental procedure section.

TABLE 94

Maize accessions, measured parameters under cold growth conditions

| Ecotype/Treatment | Line-1 | Line-2 | Line-3 | Line-4 | Line-5 | Line-6 |
|---|---|---|---|---|---|---|
| 1 | 1.19 | 1.17 | 1.02 | 1.18 | 1.04 | 1.23 |
| 2 | 2.15 | 1.93 | 2.12 | 1.80 | 2.32 | 2.15 |
| 3 | 0.05 | 0.07 | 0.10 | 0.08 | 0.07 | 0.07 |
| 5 | 28.88 | 29.11 | 27.08 | 32.38 | 32.68 | 32.89 |
| 6 | 5.74 | 4.86 | 3.98 | 4.22 | 4.63 | 4.93 |
| 7 | 73.79 | 55.46 | 53.26 | 54.92 | 58.95 | 62.36 |

Table 94: Provided are the values of each of the parameters (as described above) measured in Maize accessions (Seed ID) under cold growth conditions. Growth conditions are specified in the experimental procedure section.

TABLE 95

Maize accessions, measured parameters under cold growth conditions

| Ecotype/Treatment | Line-7 | Line-8 | Line-9 | Line-10 | Line-11 | Line-12 |
|---|---|---|---|---|---|---|
| 1 | 1.13 | 0.98 | 0.88 | 1.28 | 1.10 | 0.60 |
| 2 | 2.49 | 2.01 | 1.95 | 2.03 | 1.85 | 1.21 |
| 3 | 0.14 | 0.07 | 0.07 | 0.02 | 0.05 | 0.06 |
| 5 | 31.58 | 33.01 | 28.65 | 31.43 | 30.64 | 30.71 |
| 6 | 4.82 | 4.03 | 3.57 | 3.99 | 4.64 | 1.89 |
| 7 | 63.65 | 54.90 | 48.25 | 52.83 | 55.08 | 29.61 |

Table 95: Provided are the values of each of the parameters (as described above) measured in Maize accessions (Seed ID) under cold growth conditions. Growth conditions are specified in the experimental procedure section.

TABLE 96

Maize accessions, measured parameters under regular growth conditions

| Ecotype/Treatment | Line-1 | Line-2 | Line-3 | Line-4 | Line-5 | Line-6 |
|---|---|---|---|---|---|---|
| 1 | 1.16 | 1.10 | 0.92 | 1.01 | 0.93 | 0.91 |
| 2 | 1.99 | 1.92 | 1.93 | 1.93 | 2.15 | 1.95 |
| 3 | 0.14 | 0.11 | 0.23 | 0.16 | 0.08 | 0.05 |
| 4 | 20.15 | 15.89 | 18.59 | 18.72 | 16.38 | 14.93 |
| 5 | 34.50 | 35.77 | 34.70 | 34.42 | 35.26 | 37.52 |
| 6 | 5.27 | 4.67 | 3.88 | 5.08 | 4.10 | 4.46 |
| 7 | 79.00 | 62.85 | 59.73 | 63.92 | 60.06 | 64.67 |

Table 96: Provided are the values of each of the parameters (as described above) measured in Maize accessions (Seed ID) under regular growth conditions. Growth conditions are specified in the experimental procedure section.

TABLE 97

Maize accessions, measured parameters under regular growth conditions

| Ecotype/Treatment | Line-7 | Line-8 | Line-9 | Line-10 | Line-11 | Line-12 |
|---|---|---|---|---|---|---|
| 1 | 1.11 | 1.01 | 1.01 | 1.02 | 1.23 | 0.44 |
| 2 | 2.23 | 1.94 | 1.97 | 2.05 | 1.74 | 1.26 |
| 3 | 0.17 | 0.10 | 0.07 | 0.14 | 0.03 | 0.03 |
| 4 | 17.48 | 15.74 | 15.71 | 17.58 | 16.13 | 17.43 |
| 5 | 36.50 | 36.07 | 33.74 | 34.34 | 35.74 | 29.04 |
| 6 | 4.68 | 4.59 | 4.08 | 4.61 | 5.42 | 2.02 |
| 7 | 68.10 | 65.81 | 58.31 | 61.87 | 70.04 | 35.96 |

Table 97: Provided are the values of each of the parameters (as described above) measured in Maize accessions (Seed ID) under regular growth conditions. Growth conditions are specified in the experimental procedure section.

TABLE 98

Correlation between the expression level of selected genes of some embodiments of the invention in various tissues and the phenotypic performance under normal conditions across Maize accessions

| Gene Name | R | P value | Exp. set | Corr. Set ID | Gene Name | R | P value | Exp. set | Corr. Set ID |
|---|---|---|---|---|---|---|---|---|---|
| LBY107 | 0.77 | 9.51E−03 | 1 | 1 | LBY114 | 0.74 | 2.34E−02 | 2 | 4 |
| LBY120 | 0.73 | 2.64E−02 | 2 | 7 | LBY120 | 0.72 | 3.00E−02 | 2 | 3 |
| LGN17 | 0.80 | 1.03E−02 | 2 | 7 | LGN33 | 0.77 | 8.77E−03 | 1 | 7 |
| LGN36 | 0.81 | 8.75E−03 | 2 | 5 | LGN36 | 0.70 | 2.29E−02 | 1 | 5 |
| LGN49 | 0.73 | 2.53E−02 | 2 | 7 | LGN49 | 0.78 | 1.35E−02 | 2 | 5 |

Table 98. Provided are the correlations (R) between the expression levels of yield improving genes and their homologues in tissues [Leaves or roots; Expression sets (Exp), Table 85] and the phenotypic performance in various biomass, growth rate and/or vigor components [Tables 96-97 using the Correlation vector (corr.) as described in Table 89] under normal conditions across Maize accessions. P = p value.

TABLE 99

Correlation between the expression level of selected genes of some embodiments of the invention in various tissues and the phenotypic performance under low nitrogen conditions across Maize accessions

| Gene Name | R | P value | Exp. set | Corr. Set ID | Gene Name | R | P value | Exp. set | Corr. Set ID |
|---|---|---|---|---|---|---|---|---|---|
| LGN34 | 0.77 | 1.51E−02 | 2 | 2 | LGN36 | 0.79 | 1.13E−02 | 2 | 2 |
| LGN36 | 0.83 | 5.33E−03 | 2 | 5 | LGN49 | 0.88 | 1.76E−03 | 2 | 5 |
| LGN62 | 0.71 | 2.05E−02 | 1 | 5 | LGN62 | 0.76 | 1.14E−02 | 1 | 6 |

Table 99. Provided are the correlations (R) between the expression levels of yield improving genes and their homologues in tissues [Leaves or roots; Expression sets (Exp), Table 87] and the phenotypic performance in various biomass, growth rate and/or vigor components [Tables 90-91 using the Correlation vector (corr.) as described in Table 89] under low nitrogen conditions across Maize accessions. P = p value.

TABLE 100

Correlation between the expression level of selected genes of some embodiments of the invention in various tissues and the phenotypic performance under cold conditions across Maize accessions

| Gene Name | R | P value | Exp. set | Corr. Set ID | Gene Name | R | P value | Exp. set | Corr. Set ID |
|---|---|---|---|---|---|---|---|---|---|
| LBY104 | 0.71 | 3.27E−02 | 2 | 6 | LBY117 | 0.70 | 3.45E−02 | 2 | 7 |
| LBY5 | 0.71 | 4.78E−02 | 1 | 6 | LGN17 | 0.81 | 1.42E−02 | 1 | 3 |
| LGN18 | 0.71 | 3.08E−02 | 2 | 7 | | | | | |

Table 100. Provided are the correlations (R) between the expression levels of yield improving genes and their homologues in tissues [Leaves or roots; Expression sets (Exp), Table 86] and the phenotypic performance in various biomass, growth rate and/or vigor components [Tables 94-95 using the Correlation vector (corr.) as described in Table 89] under cold conditions (10 ± 2° C.) across Maize accessions. P = p value.

TABLE 101

Correlation between the expression level of selected genes of some embodiments of the invention in various tissues and the phenotypic performance under salinity conditions across Maize accessions

| Gene Name | R | P value | Exp. set | Corr. Set ID | Gene Name | R | P value | Exp. set | Corr. Set ID |
|---|---|---|---|---|---|---|---|---|---|
| LBY105 | 0.72 | 3.00E−02 | 2 | 2 | LBY107 | 0.74 | 2.13E−02 | 2 | 1 |
| LBY107 | 0.76 | 1.11E−02 | 1 | 7 | LBY113 | 0.77 | 1.60E−02 | 2 | 3 |
| LBY121 | 0.75 | 2.10E−02 | 2 | 1 | LBY121 | 0.76 | 1.15E−02 | 1 | 1 |
| LGN26 | 0.80 | 9.46E−03 | 2 | 3 | LGN36 | 0.79 | 7.08E−03 | 1 | 2 |

Table 101. Provided are the correlations (R) between the expression levels of yield improving genes and their homologues in tissues [Leaves or roots; Expression sets (Exp), Table 88] and the phenotypic performance in various biomass, growth rate and/or vigor components [Tables 92-93 using the Correlation vector (corr.) as described in Table 89] under salinity conditions (100 mM NaCl) across Maize accessions. P = p value.

Example 12

Production of Maize Transcriptome and High Throughput Correlation Analysis when Grown Under Normal Conditions and Defoliation Treatment Using 60K Maize Oligonucleotide Micro-Array To produce a high throughput correlation analysis, the present inventors utilized a Maize oligonucleotide microarray, produced by Agilent Technologies [chem. (dot) agilent (dot) com/Scripts/PDS (dot) asp?1Page=50879]. The array oligonucleotide represents about 60K Maize genes and transcripts designed based on data from Public databases (Example 1). To define correlations between the levels of RNA expression and yield, biomass components or vigor related parameters, various plant characteristics of 13 different Maize hybrids were analyzed under normal and defoliation conditions. Same hybrids were subjected to RNA expression analysis. The correlation between the RNA levels and the characterized parameters was analyzed using Pearson correlation test [davidmlane (dot) com/hyperstat/A34739 (dot) html].

Experimental Procedures 13 maize hybrids lines were grown in 6 repetitive plots, in field. Maize seeds were planted and plants were grown in the field using commercial fertilization and irrigation protocols. After silking, 3 plots in every hybrid line underwent the defoliation treatment. In this treatment all the leaves above the ear (about 75% of the total leaves) were removed. After the treatment, all the plants were grown according to the same commercial fertilization and irrigation protocols.

Three tissues at flowering developmental (R1) and grain filling (R3) stage including leaf (flowering -R1), stem (flowering -R1 and grain filling -R3), and flowering meristem (flowering -R1) representing different plant characteristics, were sampled from treated and untreated plants. RNA was extracted as described in "GENERAL EXPERIMENTAL AND BIOINFORMATICS METHODS". For convenience, each micro-array expression information tissue type has received a Set ID as summarized in Tables 102-103 below.

TABLE 102

Tissues used for Maize transcriptome expression sets
(Under normal conditions)

| Expression Set | Set ID |
|---|---|
| Female meristem at flowering stage under normal conditions | 1 |
| leaf at flowering stage under normal conditions | 2 |
| stem at flowering stage under normal conditions | 3 |
| stem at grain filling stage under normal conditions | 4 |

Table 102: Provided are the identification (ID) numbers of each of the Maize expression sets.

TABLE 103

Tissues used for Maize transcriptome expression sets
(Under defoliation treatment)

| Expression Set | Set ID |
|---|---|
| Female meristem at flowering stage under defoliation treatment | 1 |
| Leaf at flowering stage under defoliation treatment | 2 |
| Stem at flowering stage under defoliation treatment | 3 |
| Stem at grain filling stage under defoliation treatment | 4 |

Table 103: Provided are the identification (ID) numbers of each of the Maize expression sets.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

The following parameters were collected by imaging.

1000 grain weight—At the end of the experiment all seeds from all plots were collected and weighed and the weight of 1000 was calculated.

Ear Area (cm$^2$)—At the end of the growing period 5 ears were photographed and images were processed using the below described image processing system. The Ear area was measured from those images and was divided by the number of ears.

Ear Length and Ear Width (cm)—At the end of the growing period 6 ears were, photographed and images were processed using the below described image processing system. The Ear length and width (longest axis) was measured from those images and was divided by the number of ears.

Grain Area (cm$^2$)—At the end of the growing period the grains were separated from the ear. A sample of ~200 grains were weighted, photographed and images were processed using the below described image processing system. The grain area was measured from those images and was divided by the number of grains.

Grain Length and Grain width (cm)—At the end of the growing period the grains were separated from the ear. A sample of ~200 grains was weighted, photographed and images were processed using the below described image processing system. The sum of grain lengths/or width (longest axis) was measured from those images and was divided by the number of grains.

Grain Perimeter (cm)—At the end of the growing period the grains were separated from the ear. A sample of ~200 grains was weighted, photographed and images were processed using the below described image processing system. The sum of grain perimeter was measured from those images and was divided by the number of grains.

Ear filled grain area (cm$^2$)—At the end of the growing period 5 ears were photographed and images were processed using the below described image processing system. The Ear area filled with kernels was measured from those images and was divided by the number of Ears.

Filled per Whole Ear—was calculated as the length of the ear with grains out of the total ear.

Additional parameters were collected either by sampling 6 plants per plot or by measuring the parameter across all the plants within the plot.

Cob width [cm]—The diameter of the cob without grains was measured using a ruler.

Ear average weight [kg]—At the end of the experiment (when ears were harvested) total and 6 selected ears per plots were collected. The ears were weighted and the average ear per plant was calculated. The ear weight was normalized using the relative humidity to be 0%.

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located Ear row num—The number of rows per ear was counted.

Ear fresh weight per plant (GF)—During the grain filling period (GF) and total and 6 selected ears per plot were collected separately. The ears were weighted and the average ear weight per plant was calculated.

Ears dry weight—At the end of the experiment (when ears were harvested) total and 6 selected ears per plots were collected and weighted. The ear weight was normalized using the relative humidity to be 0%.

Ears fresh weight—At the end of the experiment (when ears were harvested) total and 6 selected ears per plots were collected and weighted.

Ears per plant—number of ears per plant were counted.

Grains weight (Kg.)—At the end of the experiment all ears were collected. Ears from 6 plants from each plot were separately threshed and grains were weighted.

Grains dry weight (Kg.)—At the end of the experiment all ears were collected. Ears from 6 plants from each plot were separately threshed and grains were weighted. The grain weight was normalized using the relative humidity to be 0%.

Grain weight per ear (Kg.)—At the end of the experiment all ears were collected. 5 ears from each plot were separately threshed and grains were weighted. The average grain weight per ear was calculated by dividing the total grain weight by the number of ears.

Leaves area per plant at GF and HD [LAI, leaf area index]=Total leaf area of 6 plants in a plot his parameter was measured at two time points during the course of the experiment; at heading (HD) and during the grain filling period (GF). Measurement was performed using a Leaf area-meter at two time points in the course of the experiment; during the grain filling period and at the heading stage (VT).

Leaves fresh weight at GF and HD—This parameter was measured at two time points during the course of the experiment; at heading (HD) and during the grain filling period (GF). Leaves used for measurement of the LAI were weighted.

Lower stem fresh weight at GF, HD and H—This parameter was measured at three time points during the course of the experiment: at heading (HD), during the grain filling period (GF) and at harvest (H). Lower internodes from at least 4 plants per plot were separated from the plant and weighted. The average internode weight per plant was calculated by dividing the total grain weight by the number of plants.

Lower stem length at GF, HD and H—This parameter was measured at three time points during the course of the experiment; at heading (HD), during the grain filling period (GF) and at harvest (H). Lower internodes from at least 4 plants per plot were separated from the plant and their length was measured using a ruler. The average internode length per plant was calculated by dividing the total grain weight by the number of plants.

Lower stem width at GF, HD, and H—This parameter was measured at three time points during the course of the experiment: at heading (HD), during the grain filling period (GF) and at harvest (H). Lower internodes from at least 4 plants per plot were separated from the plant and their diameter was measured using a caliber. The average internode width per plant was calculated by dividing the total grain weight by the number of plants.

Plant height growth—the relative growth rate (RGR) of Plant Height was calculated as described in Formula III above.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Stem fresh weight at GF and HD—This parameter was measured at two time points during the course of the experiment: at heading (HD) and during the grain filling period (GF). Stems of the plants used for measurement of the LAI were weighted.

Total dry matter—Total dry matter was calculated using Formula XXI above.

Upper stem fresh weight at GF, HD and H—This parameter was measured at three time points during the course of the experiment; at heading (HD), during the grain filling period (GF) and at harvest (H). Upper internodes from at least 4 plants per plot were separated from the plant and weighted. The average internode weight per plant was calculated by dividing the total grain weight by the number of plants.

Upper stem length at GF, HD, and H—This parameter was measured at three time points during the course of the experiment; at heading (HD), during the grain filling period (GF) and at harvest (H). Upper internodes from at least 4 plants per plot were separated from the plant and their length was measured using a ruler. The average internode length per plant was calculated by dividing the total grain weight by the number of plants.

Upper stem width at GF, HD and H (mm)—This parameter was measured at three time points during the course of the experiment: at heading (HD), during the grain filling period (GF) and at harvest (H). Upper internodes from at least 4 plants per plot were separated from the plant and their diameter was measured using a caliber. The average internode width per plant was calculated by dividing the total grain weight by the number of plants.

Vegetative dry weight (Kg.)—total weight of the vegetative portion of 6 plants (above ground excluding roots) after drying at 70° C. in oven for 48 hours weight by the number of plants.

Vegetative fresh weight (Kg.)—total weight of the vegetative portion of 6 plants (above ground excluding roots).

Node number—nodes on the stem were counted at the heading stage of plant development.

TABLE 104

Maize correlated parameters (vectors) under normal grown conditions and under the treatment of defoliation

| Normal conditions | | Defoliation treatment | |
| --- | --- | --- | --- |
| Correlated parameter with | Corr. ID | Correlated parameter with | Corr. ID |
| 1000 grains weight [gr.] | 1 | 1000 grains weight [gr.] | 1 |
| Cob width [mm] | 2 | Cob width [mm] | 2 |
| Ear Area [cm$^2$] | 3 | Ear Area [cm$^2$] | 3 |
| Ear Filled Grain Area [cm$^2$] | 4 | Ear Filled Grain Area [cm$^2$] | 4 |
| Ear Width [cm] | 5 | Ear Width [cm] | 5 |
| Ear avr. Weight [gr.] | 6 | Ear avr weight [gr.] | 6 |
| Ear height [cm] | 7 | Ear height [cm] | 7 |
| Ear length [feret's diameter] [cm] | 8 | Ear length (feret's diameter) [cm] | 8 |
| Ear row number [num] | 9 | Ear row number [num] | 9 |
| Ears FW per plant (GF) [gr./plant] | 10 | Ears dry weight (SP) [gr.] | 10 |
| Ears dry weight (SP) [kg] | 11 | Ears fresh weight (SP) [kg] | 11 |
| Ears fresh weight (SP) [kg] | 12 | Ears per plant (SP) [num] | 12 |
| Ears per plant (SP) [num] | 13 | Filled/Whole Ear [ratio] | 13 |
| Filled/Whole Ear [ratio] | 14 | Grain Perimeter [cm] | 14 |
| Grain Perimeter [cm] | 15 | Grain area [cm$^2$] | 15 |
| Grain area [cm$^2$] | 16 | Grain length [cm] | 16 |
| Grain length [cm] | 17 | Grain width [mm] | 17 |
| Grain width [cm] | 18 | Grains dry yield (SP) [kg] | 18 |
| Grains dry yield (SP) [kg] | 19 | Grains yield (SP) [kg] | 19 |
| Grains yield (SP) [kg] | 20 | Grains yield per ear (SP) [kg] | 20 |
| Grains yield per ear (SP) [kg] | 21 | Leaves FW (HD) [gr.] | 21 |
| Leaves FW (GF) [gr.] | 22 | Leaves area PP (HD) [cm$^2$] | 22 |
| Leaves FW (HD) [gr.] | 23 | Leaves temperature_[GF] [° C.] | 23 |
| Leaves area PP (GF) [cm$^2$] | 24 | Lower Stem FW [H] [gr.] | 24 |
| Leaves area PP (HD) [cm$^2$] | 25 | Lower Stem FW (HD) [gr.] | 25 |
| Leaves temperature (GF) [° C.] | 26 | Lower Stem length [H] [cm] | 26 |
| Lower Stem FW (GF) [gr.] | 27 | Lower Stem length (HD) [cm] | 27 |
| Lower Stem FW (H) [gr.] | 28 | Lower Stem width [H] [mm] | 28 |
| Lower Stem FW (HD) [gr.] | 29 | Lower Stem width (HD) [mm] | 29 |
| Lower Stem length (GF) [cm] | 30 | Node number [num] | 30 |
| Lower Stem length (H) [cm] | 31 | Plant_height [cm] | 31 |
| Lower Stem length (HD) [cm] | 32 | Plant height growth [cm/day] | 32 |
| Lower Stem width (GF) [mm] | 33 | SPAD (GF) [SPAD unit] | 33 |
| Lower Stem width (H) [mm] | 34 | Stem FW (HD) [gr.] | 34 |
| Lower Stem width (HD) [mm] | 35 | Total dry matter (SP) [kg] | 35 |
| Node number [num] | 36 | Upper Stem FW (H) [gr.] | 36 |
| Plant height [cm] | 37 | Upper Stem length (H) [cm] | 37 |
| Plant height growth [cm/day] | 38 | Upper Stem width (H) [mm] | 38 |
| SPAD (GF) [SPAD unit] | 39 | Vegetative DW (SP) [kg] | 39 |
| Stem FW (GF) [gr.] | 40 | Vegetative FW (SP) [kg] | 40 |
| Stem FW (HD) [gr.] | 41 | | |
| Total dry matter (SP) [kg] | 42 | | |
| Upper Stem FW (GF) [gr.] | 43 | | |
| Upper Stem FW (H) [gr.] | 44 | | |
| Upper Stem length (GF) [cm] | 45 | | |
| Upper Stem length (H) [cm] | 46 | | |
| Upper Stem width (GF) [mm] | 47 | | |
| Upper Stem width (H) [mm] | 48 | | |
| Vegetative DW (SP) [kg] | 49 | | |
| Vegetative FW (SP) [kg] | 50 | | |

Table 104.

Thirteen maize varieties were grown, and characterized for parameters, as described above. The average for each parameter was calculated using the JMP software, and values are summarized in Tables 105-108 below. Subsequent correlation between the various transcriptome sets for all or sub set of lines was done and results were integrated into the database (Tables 109 and 110 below).

TABLE 105

Measured parameters in Maize Hybrid under normal conditions

| Line/Corr. ID | Line-1 | Line-2 | Line-3 | Line-4 | Line-5 | Line-6 | Line-7 |
|---|---|---|---|---|---|---|---|
| 1 | 296.50 | 263.25 | 303.61 | 304.70 | 281.18 | 330.45 | 290.88 |
| 2 | 24.63 | 25.11 | 23.21 | 23.69 | 22.81 | 22.40 | 23.18 |
| 3 | 82.30 | 74.63 | 77.00 | 90.15 | 83.80 | 96.63 | 78.36 |
| 4 | 80.89 | 72.42 | 73.43 | 85.96 | 80.64 | 95.03 | 74.41 |
| 5 | 4.656 | 4.787 | 4.961 | 4.998 | 4.650 | 4.802 | 4.786 |
| 6 | 209.50 | 164.63 | 177.44 | 218.53 | 205.58 | 135.77 | 147.49 |
| 7 | 121.67 | 134.24 | 149.64 | 152.14 | 143.83 | 133.65 | 118.39 |
| 8 | 22.09 | 19.62 | 20.02 | 23.21 | 22.63 | 23.74 | 20.31 |
| 9 | 13.00 | 14.94 | 14.56 | 14.56 | 13.56 | 13.06 | 16.12 |
| 10 | 351.26 | 323.08 | 307.87 | 330.60 | 320.51 | 434.60 | 325.08 |
| 11 | 1.257 | 1.087 | 1.065 | 1.311 | 1.234 | 1.354 | 1.159 |
| 12 | 1.687 | 1.457 | 1.412 | 1.699 | 1.519 | 1.739 | 1.800 |
| 13 | 1.000 | 1.111 | 1.000 | 1.000 | 1.000 | 1.056 | 1.000 |
| 14 | 0.982 | 0.969 | 0.953 | 0.953 | 0.949 | 0.937 | 0.930 |
| 15 | 3.299 | 3.233 | 3.275 | 3.338 | 3.178 | 3.382 | 3.246 |
| 16 | 0.720 | 0.667 | 0.706 | 0.722 | 0.671 | 0.753 | 0.665 |
| 17 | 1.125 | 1.123 | 1.133 | 1.170 | 1.081 | 1.159 | 1.142 |
| 18 | 0.808 | 0.753 | 0.789 | 0.782 | 0.787 | 0.823 | 0.740 |
| 19 | 0.907 | 0.800 | 0.766 | 0.923 | 0.833 | 0.986 | 0.820 |
| 20 | 1.037 | 0.913 | 0.869 | 1.058 | 0.953 | 1.123 | 0.940 |
| 21 | 0.151 | 0.133 | 0.128 | 0.154 | 0.139 | 0.164 | 0.137 |
| 22 | 230.13 | 197.64 | 201.03 | 205.53 | 224.81 | 204.49 | 212.41 |
| 23 | 110.97 | 80.57 | 157.21 | 128.83 | 100.57 | 111.80 | 116.75 |
| 24 | 7034.60 | 6402.80 | 6353.07 | 6443.92 | 6835.50 | 6507.33 | 7123.48 |
| 25 | 4341.25 | 3171.00 | 4205.50 | 4347.50 | 3527.00 | 4517.33 | 3984.75 |
| 26 | 33.11 | 33.52 | 33.87 | 34.18 | 33.78 | 32.85 | 33.19 |
| 27 | 35.40 | 25.03 | 26.51 | 21.74 | 26.13 | 34.44 | 27.61 |
| 28 | 23.52 | 20.34 | 25.08 | 14.18 | 17.53 | 25.74 | 20.60 |
| 29 | 72.99 | 59.90 | 74.72 | 90.48 | 69.52 | 66.91 | 60.36 |
| 30 | 19.35 | 20.40 | 20.93 | 21.38 | 20.03 | 20.31 | 18.08 |
| 31 | 16.76 | 20.02 | 22.59 | 21.68 | 22.34 | 21.39 | 17.07 |
| 32 | 14.50 | 17.75 | 20.00 | 19.35 | 20.33 | 20.75 | 15.00 |
| 33 | 19.86 | 16.84 | 16.14 | 16.37 | 17.01 | 17.53 | 18.11 |
| 34 | 19.42 | 17.19 | 16.09 | 16.92 | 17.52 | 17.88 | 17.96 |
| 35 | 24.14 | 20.53 | 20.97 | 24.43 | 21.70 | 19.49 | 23.47 |
| 36 | 15.22 | 14.56 | 14.61 | 14.83 | 15.00 | 13.83 | 14.28 |
| 37 | 265.11 | 255.94 | 271.11 | 283.89 | 279.72 | 268.78 | 244.25 |
| 38 | 6.30 | 6.52 | 7.14 | 6.98 | 7.41 | 7.50 | 5.60 |
| 39 | 59.77 | 53.17 | 53.21 | 54.95 | 53.99 | 55.24 | 55.38 |
| 40 | 649.03 | 489.32 | 524.06 | 512.66 | 542.16 | 627.76 | 507.78 |
| 41 | 758.61 | 587.88 | 801.32 | 794.80 | 721.87 | 708.38 | 660.70 |
| 42 | 2.57 | 2.06 | 2.32 | 2.44 | 2.36 | 2.57 | 2.23 |
| 43 | 19.61 | 15.54 | 17.82 | 10.79 | 14.41 | 20.31 | 15.85 |
| 44 | 12.94 | 11.21 | 12.98 | 6.50 | 7.99 | 12.08 | 9.72 |
| 45 | 16.63 | 18.75 | 18.38 | 17.92 | 17.60 | 18.79 | 17.07 |
| 46 | 16.93 | 18.76 | 18.72 | 20.01 | 19.40 | 19.65 | 16.42 |
| 47 | 16.00 | 14.11 | 13.50 | 11.89 | 13.08 | 14.34 | 15.04 |
| 48 | 14.93 | 13.00 | 12.44 | 12.04 | 12.89 | 13.28 | 13.10 |
| 49 | 1.308 | 0.971 | 1.251 | 1.131 | 1.128 | 1.213 | 1.073 |
| 50 | 3.157 | 2.252 | 2.607 | 2.596 | 2.416 | 2.640 | 2.220 |

Table 105.

TABLE 106

Measured parameters in Maize Hybrid under normal conditions, additional maize lines

| Line/Corr. ID | Line-8 | Line-9 | Line-10 | Line-11 | Line-12 | Line-13 |
|---|---|---|---|---|---|---|
| 1 | 250.26 | 306.20 | 253.19 | 277.03 | 269.53 | 274.81 |
| 2 | 24.88 | 26.47 | 23.09 | 22.69 | 23.55 | 26.31 |
| 3 | 93.91 | 96.77 | 85.44 | 76.77 | 97.99 | |
| 4 | 92.31 | 95.43 | 83.28 | 74.35 | 96.88 | |
| 5 | 5.182 | 5.001 | 4.952 | 4.786 | 5.426 | |
| 6 | 207.11 | 228.44 | 215.92 | 198.69 | 188.50 | 254.42 |
| 7 | 145.24 | 133.78 | 143.71 | 134.17 | 143.00 | 147.78 |
| 8 | 22.60 | 23.84 | 21.74 | 20.04 | 22.41 | |
| 9 | 15.89 | 14.00 | 15.44 | 14.89 | 14.94 | 16.78 |
| 10 | 327.15 | 363.70 | 405.72 | 338.24 | 345.32 | 369.69 |
| 11 | 1.292 | 1.371 | 1.296 | 1.192 | 1.131 | 1.527 |
| 12 | 1.595 | 1.739 | 1.681 | 1.565 | 1.421 | 1.891 |
| 13 | 1.056 | 1.000 | 1.000 | 1.000 | 1.000 | 1.000 |

TABLE 106-continued

Measured parameters in Maize Hybrid under normal conditions, additional maize lines

| Line/Corr. ID | Line-8 | Line-9 | Line-10 | Line-11 | Line-12 | Line-13 |
|---|---|---|---|---|---|---|
| 14 | 0.982 | 0.986 | 0.974 | 0.966 | 0.989 | |
| 15 | 3.182 | 3.291 | 3.269 | 3.216 | 3.155 | 3.384 |
| 16 | 0.646 | 0.705 | 0.678 | 0.670 | 0.652 | 0.723 |
| 17 | 1.118 | 1.151 | 1.163 | 1.124 | 1.090 | 1.206 |
| 18 | 0.730 | 0.774 | 0.739 | 0.756 | 0.757 | 0.760 |
| 19 | 0.921 | 1.017 | 0.942 | 0.852 | 0.813 | 1.142 |
| 20 | 1.050 | 1.155 | 1.076 | 0.974 | 0.924 | 1.287 |
| 21 | 0.154 | 0.169 | 0.157 | 0.142 | 0.136 | 0.190 |
| 22 | 181.43 | 199.22 | 206.91 | 168.54 | 199.42 | 200.12 |
| 23 | 106.95 | 85.97 | 102.71 | 105.73 | 102.12 | 143.06 |
| 24 | 6075.21 | 6597.67 | 6030.40 | 6307.06 | 6617.65 | 6848.03 |
| 25 | 3696.75 | 3926.67 | 3127.67 | 3942.75 | 3955.00 | 4854.00 |
| 26 | 33.66 | 33.78 | 32.64 | 33.95 | 33.28 | 33.90 |
| 27 | 25.26 | 26.18 | 34.31 | 25.50 | 23.06 | 25.59 |
| 28 | 16.35 | 18.90 | 27.30 | 22.35 | 19.26 | 22.82 |
| 29 | 63.07 | 55.89 | 82.13 | 60.02 | 58.70 | 116.12 |
| 30 | 20.18 | 19.81 | 22.89 | 19.81 | 19.53 | 21.40 |
| 31 | 20.69 | 18.48 | 23.31 | 19.39 | 19.66 | 19.97 |
| 32 | 18.68 | 20.50 | 22.57 | 19.83 | 14.50 | 20.33 |
| 33 | 17.09 | 16.87 | 17.49 | 16.62 | 17.10 | 17.38 |
| 34 | 18.42 | 17.43 | 18.07 | 17.68 | 17.61 | 18.93 |
| 35 | 20.97 | 21.46 | 21.41 | 22.12 | 23.25 | 24.31 |
| 36 | 14.72 | 15.44 | 14.33 | 14.44 | 14.89 | 14.39 |
| 37 | 273.56 | 273.22 | 295.33 | 259.25 | 257.89 | 277.19 |
| 38 | 6.96 | 7.02 | 7.83 | 6.98 | 6.56 | 7.25 |
| 39 | 56.76 | 55.81 | 58.54 | 51.68 | 55.16 | 54.16 |
| 40 | 549.34 | 509.74 | 662.13 | 527.43 | 474.68 | 544.03 |
| 41 | 724.58 | 618.46 | 837.56 | 612.81 | 728.00 | 950.29 |
| 42 | 2.73 | 2.33 | 2.40 | 2.20 | 2.08 | 2.84 |
| 43 | 14.39 | 17.85 | 20.42 | 13.93 | 13.05 | 16.45 |
| 44 | 6.98 | 9.40 | 13.58 | 9.20 | 7.69 | 10.17 |
| 45 | 17.52 | 18.15 | 18.61 | 17.69 | 18.15 | 18.64 |
| 46 | 18.34 | 16.63 | 19.38 | 16.71 | 16.27 | 15.92 |
| 47 | 13.63 | 14.73 | 14.61 | 13.17 | 12.77 | 14.15 |
| 48 | 13.48 | 13.42 | 13.27 | 13.14 | 12.53 | 13.79 |
| 49 | 1.438 | 0.961 | 1.100 | 1.007 | 0.953 | 1.313 |
| 50 | 2.897 | 2.224 | 2.827 | 2.295 | 2.151 | 2.900 |

Table 106.

TABLE 107

Measured parameters in Maize Hybrid under defoliation treatment

| Line/Corr. ID | Line-1 | Line-2 | Line-3 | Line-4 | Line-5 | Line-6 | Line-7 |
|---|---|---|---|---|---|---|---|
| 1 | 280.03 | 251.86 | 294.29 | 295.36 | 288.40 | 308.25 | 230.12 |
| 2 | 19.03 | 22.12 | 16.31 | 21.54 | 19.84 | 18.21 | 19.77 |
| 3 | 53.60 | 45.50 | 38.31 | 58.47 | 53.89 | 63.54 | 39.83 |
| 4 | 51.50 | 42.95 | 34.59 | 55.67 | 51.36 | 61.44 | 36.31 |
| 5 | 4.181 | 4.207 | 3.919 | 4.773 | 4.506 | 4.612 | 4.099 |
| 6 | 89.20 | 100.75 | 73.39 | 129.84 | 129.78 | 115.06 | 85.04 |
| 7 | 119.44 | 131.56 | 145.53 | 156.06 | 145.28 | 129.53 | 123.38 |
| 8 | 16.34 | 13.63 | 12.89 | 15.94 | 15.34 | 17.53 | 13.21 |
| 9 | 12.71 | 14.36 | 13.00 | 14.12 | 13.47 | 13.07 | 14.06 |
| 10 | 0.747 | 0.583 | 0.440 | 0.742 | 0.779 | 0.576 | 0.454 |
| 11 | 0.973 | 0.833 | 0.629 | 0.979 | 1.010 | 0.803 | 0.648 |
| 12 | 1.000 | 0.944 | 1.000 | 0.944 | 1.000 | 0.941 | 0.889 |
| 13 | 0.954 | 0.915 | 0.873 | 0.950 | 0.948 | 0.961 | 0.905 |
| 14 | 3.109 | 3.144 | 3.179 | 3.207 | 3.196 | 3.230 | 3.130 |
| 15 | 0.649 | 0.632 | 0.669 | 0.675 | 0.677 | 0.683 | 0.631 |
| 16 | 1.052 | 1.080 | 1.079 | 1.110 | 1.087 | 1.094 | 1.066 |
| 17 | 0.777 | 0.740 | 0.781 | 0.765 | 0.786 | 0.788 | 0.750 |
| 18 | 0.523 | 0.400 | 0.289 | 0.517 | 0.547 | 0.398 | 0.302 |
| 19 | 0.604 | 0.456 | 0.331 | 0.588 | 0.624 | 0.458 | 0.345 |
| 20 | 0.087 | 0.069 | 0.048 | 0.090 | 0.091 | 0.080 | 0.056 |
| 21 | 112.27 | 94.99 | 125.14 | 144.48 | 112.50 | 116.16 | 113.78 |
| 22 | 3914.00 | 3480.00 | 4276.50 | 4985.50 | 4643.50 | 4223.00 | 3436.00 |
| 23 | 32.47 | 33.09 | 33.64 | 32.29 | 32.87 | 33.40 | 33.43 |
| 24 | 23.02 | 26.50 | 26.98 | 15.24 | 18.19 | 37.21 | 27.88 |
| 25 | 64.16 | 53.81 | 56.41 | 80.95 | 71.27 | 66.69 | 64.19 |

TABLE 107-continued

Measured parameters in Maize Hybrid under defoliation treatment

| Line/Corr. ID | Line-1 | Line-2 | Line-3 | Line-4 | Line-5 | Line-6 | Line-7 |
|---|---|---|---|---|---|---|---|
| 26 | 16.29 | 21.44 | 20.85 | 22.58 | 22.94 | 21.62 | 18.76 |
| 27 | 15.15 | 18.50 | 16.67 | 18.07 | 18.00 | 19.83 | 16.10 |
| 28 | 19.54 | 16.90 | 15.79 | 17.01 | 17.12 | 18.17 | 18.21 |
| 29 | 24.30 | 20.57 | 21.06 | 24.87 | 20.85 | 20.46 | 20.96 |
| 30 | 15.17 | 14.39 | 15.00 | 15.11 | 14.50 | 14.22 | 14.39 |
| 31 | 251.42 | 248.64 | 268.06 | 285.11 | 278.83 | 261.88 | 254.64 |
| 32 | 6.38 | 6.32 | 6.31 | 6.93 | 6.83 | 7.14 | 6.48 |
| 33 | 61.21 | 57.36 | 58.02 | 62.36 | 60.72 | 62.22 | 59.65 |
| 34 | 713.54 | 538.04 | 705.53 | 803.33 | 703.36 | 664.23 | 673.24 |
| 35 | 1.539 | 1.365 | 1.440 | 1.532 | 1.571 | 1.574 | 1.337 |
| 36 | 8.68 | 11.08 | 14.10 | 4.89 | 6.04 | 13.95 | 10.93 |
| 37 | 16.24 | 18.83 | 17.74 | 19.64 | 20.74 | 20.14 | 17.18 |
| 38 | 14.27 | 12.82 | 12.69 | 11.09 | 12.00 | 13.03 | 14.25 |
| 39 | 0.792 | 0.782 | 1.000 | 0.790 | 0.792 | 0.998 | 0.883 |
| 40 | 2.511 | 1.955 | 2.797 | 2.107 | 2.205 | 2.785 | 2.541 |

Table 107.

TABLE 108

Measured parameters in Maize Hybrid under defoliation treatment, additional maize lines

| Line/Corr. ID | Line-8 | Line-9 | Line-10 | Line-11 | Line-12 | Line-13 |
|---|---|---|---|---|---|---|
| 1 | 271.25 | 259.43 | 243.98 | 262.41 | 248.64 | 244.16 |
| 2 | 22.44 | 20.28 | 19.64 | 22.32 | 23.31 | 27.78 |
| 3 | 47.33 | 65.90 | 43.83 | 43.28 | 52.30 | 58.31 |
| 4 | 43.34 | 64.80 | 39.56 | 40.43 | 49.28 | 55.69 |
| 5 | 4.202 | 4.664 | 4.056 | 4.012 | 4.407 | 4.975 |
| 6 | 33.10 | 161.76 | 89.36 | 87.68 | 88.18 | 124.58 |
| 7 | 135.00 | 136.50 | 136.39 | 130.32 | 139.71 | 143.44 |
| 8 | 14.82 | 17.60 | 13.78 | 13.75 | 15.53 | 14.87 |
| 9 | 13.75 | 13.94 | 12.79 | 13.00 | 14.29 | 15.83 |
| 10 | 0.630 | 0.803 | 0.536 | 0.552 | 0.512 | 0.748 |
| 11 | 0.819 | 1.148 | 0.877 | 0.791 | 0.693 | 0.991 |
| 12 | 1.000 | 0.882 | 1.000 | 1.056 | 0.944 | 1.000 |
| 13 | 0.905 | 0.983 | 0.890 | 0.918 | 0.940 | 0.950 |
| 14 | 3.016 | 3.117 | 3.086 | 3.030 | 2.976 | 3.153 |
| 15 | 0.610 | 0.623 | 0.619 | 0.600 | 0.583 | 0.631 |
| 16 | 1.024 | 1.084 | 1.054 | 1.025 | 0.995 | 1.095 |
| 17 | 0.750 | 0.724 | 0.741 | 0.738 | 0.733 | 0.725 |
| 18 | 0.439 | 0.667 | 0.359 | 0.377 | 0.344 | 0.531 |
| 19 | 0.505 | 0.767 | 0.411 | 0.435 | 0.394 | 0.609 |
| 20 | 0.073 | 0.124 | 0.060 | 0.063 | 0.059 | 0.088 |
| 21 | 93.74 | 89.86 | 86.98 | 117.27 | 150.68 | 161.65 |
| 22 | 4593.00 | 4315.50 | 4020.50 | 4154.00 | 4851.50 | 3750.00 |
| 23 | 33.42 | 33.98 | 33.12 | 32.64 | 33.55 | 33.27 |
| 24 | 17.33 | 20.51 | 25.36 | 28.41 | 23.16 | 38.80 |
| 25 | 76.23 | 57.85 | 69.98 | 67.30 | 72.90 | 83.58 |
| 26 | 20.88 | 17.83 | 20.70 | 20.43 | 20.11 | 24.13 |
| 27 | 14.83 | 17.50 | 23.67 | 19.00 | 16.45 | 20.60 |
| 28 | 17.23 | 17.88 | 17.12 | 17.53 | 18.63 | 19.87 |
| 29 | 22.47 | 21.23 | 19.85 | 21.29 | 23.58 | 21.37 |
| 30 | 14.67 | 15.61 | 14.39 | 14.06 | 14.61 | 14.00 |
| 31 | 261.94 | 268.88 | 272.71 | 262.50 | 266.33 | 279.14 |
| 32 | 6.28 | 7.04 | 7.20 | 7.34 | 6.94 | 7.27 |
| 33 | 59.99 | 56.76 | 65.70 | 57.94 | 60.31 | 57.71 |
| 34 | 738.37 | 692.23 | 619.79 | 729.23 | 794.64 | 847.52 |
| 35 | 1.474 | 1.663 | 1.477 | 1.314 | 1.476 | 1.715 |
| 36 | 6.48 | 9.01 | 10.69 | 10.38 | 8.49 | 12.29 |
| 37 | 19.12 | 16.74 | 15.96 | 17.31 | 18.19 | 17.77 |
| 38 | 12.77 | 13.52 | 13.08 | 13.43 | 13.21 | 14.72 |
| 39 | 0.844 | 0.860 | 0.940 | 0.762 | 0.964 | 0.967 |
| 40 | 2.475 | 2.350 | 2.595 | 2.406 | 2.699 | 2.721 |

Table 108.

Tables 109 and 110 hereinbelow provide the correlations (R) between the expression levels of yield improving genes and their homologs in various tissues [Expression (Exp) sets, Tables 102-103] and the phenotypic performance [yield, biomass, growth rate and/or vigor components described in Tables 105-108 using the Correlation vector (Corr.) described in Table 104] under normal conditions (Table 109) and defoliation treatment (Table 110) across maize varieties. P=p value.

TABLE 109

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LBY104 | 0.86 | 3.65E−04 | 3 | 46 | LBY104 | 0.70 | 1.62E−02 | 2 | 46 |
| LBY104 | 0.76 | 2.78E−03 | 1 | 13 | LBY105 | 0.81 | 1.39E−03 | 3 | 46 |
| LBY105 | 0.74 | 6.40E−03 | 3 | 10 | LBY107 | 0.71 | 1.34E−02 | 2 | 26 |
| LBY109 | 0.75 | 5.28E−03 | 3 | 23 | LBY111 | 0.70 | 1.11E−02 | 3 | 46 |
| LBY114 | 0.70 | 1.59E−02 | 2 | 9 | LBY115 | 0.74 | 3.61E−03 | 1 | 39 |
| LBY115 | 0.73 | 4.23E−03 | 1 | 40 | LBY116 | 0.84 | 7.06E−04 | 3 | 23 |
| LBY116 | 0.76 | 4.45E−03 | 3 | 25 | LBY116 | 0.75 | 7.63E−03 | 2 | 35 |
| LBY118 | 0.83 | 1.57E−03 | 2 | 1 | LBY120 | 0.73 | 1.12E−02 | 3 | 14 |
| LBY120 | 0.89 | 2.52E−04 | 2 | 37 | LBY120 | 0.73 | 1.09E−02 | 2 | 31 |
| LBY120 | 0.91 | 9.25E−05 | 2 | 30 | LBY120 | 0.74 | 9.23E−03 | 2 | 38 |
| LBY121 | 0.74 | 3.50E−03 | 1 | 33 | LBY121 | 0.84 | 2.95E−04 | 1 | 39 |
| LBY121 | 0.74 | 3.63E−03 | 1 | 40 | LBY121 | 0.76 | 2.73E−03 | 1 | 50 |
| LBY122 | 0.71 | 1.03E−02 | 3 | 10 | LBY122 | 0.76 | 2.69E−03 | 1 | 23 |
| LBY123 | 0.74 | 6.00E−03 | 3 | 18 | LBY233 | 0.73 | 1.08E−02 | 2 | 37 |
| LBY233 | 0.82 | 3.90E−03 | 2 | 8 | LBY5 | 0.70 | 1.05E−02 | 3 | 2 |
| LBY5 | 0.81 | 7.49E−04 | 1 | 42 | LBY5 | 0.73 | 4.29E−03 | 1 | 11 |
| LBY6 | 0.86 | 6.98E−04 | 2 | 43 | LBY6 | 0.73 | 1.12E−02 | 2 | 27 |
| LBY6 | 0.71 | 6.91E−03 | 1 | 48 | LGN24 | 0.70 | 1.11E−02 | 3 | 6 |
| LGN24 | 0.71 | 6.18E−03 | 1 | 33 | LGN24 | 0.74 | 4.09E−03 | 1 | 48 |
| LGN26 | 0.78 | 2.49E−03 | 3 | 15 | LGN26 | 0.77 | 3.48E−03 | 3 | 16 |
| LGN26 | 0.78 | 3.07E−03 | 3 | 25 | LGN26 | 0.76 | 3.86E−03 | 3 | 10 |
| LGN33 | 0.80 | 1.90E−03 | 3 | 26 | LGN35 | 0.72 | 8.40E−03 | 3 | 40 |
| LGN35 | 0.73 | 6.49E−03 | 3 | 10 | LGN35 | 0.71 | 1.01E−02 | 3 | 28 |
| LGN35 | 0.70 | 1.64E−02 | 2 | 31 | LGN36 | 0.74 | 5.86E−03 | 3 | 42 |
| LGN36 | 0.70 | 1.07E−02 | 3 | 19 | LGN36 | 0.71 | 9.84E−03 | 3 | 11 |
| LGN36 | 0.70 | 1.05E−02 | 3 | 20 | LGN36 | 0.70 | 1.07E−02 | 3 | 21 |
| LGN39 | 0.76 | 3.77E−03 | 3 | 45 | LGN39 | 0.71 | 1.38E−02 | 2 | 28 |
| LGN49 | 0.71 | 1.34E−02 | 2 | 18 | LGN49 | 0.73 | 1.71E−02 | 2 | 8 |
| LGN62 | 0.75 | 8.49E−03 | 2 | 28 | | | | | |

Table 109: Provided are the correlations (R) between the genes expression levels in various tissues and the phenotypic performance. "Corr. ID"—correlation set ID according to the correlated parameters specified in Table 104. "Exp. Set"—Expression set specified in Table 102. "R" = Pearson correlation coefficient; "P" = p value.

TABLE 110

Correlation between the expression level of selected genes of some embodiments of the invention in various tissues and the phenotypic performance under defoliation treatment across maize varieties

| Gene Name | R | P value | Exp. set | Corr. Set ID | Gene Name | R | P value | Exp. set | Corr. Set ID |
|---|---|---|---|---|---|---|---|---|---|
| LBY103 | 0.79 | 2.17E−03 | 1 | 30 | LBY105 | 0.73 | 6.78E−03 | 3 | 33 |
| LBY105 | 0.70 | 1.08E−02 | 1 | 34 | LBY105 | 0.72 | 8.24E−03 | 1 | 29 |
| LBY105 | 0.80 | 1.73E−03 | 1 | 27 | LBY107 | 0.77 | 3.31E−03 | 1 | 31 |
| LBY107 | 0.81 | 1.30E−03 | 1 | 5 | LBY107 | 0.74 | 6.04E−03 | 1 | 18 |
| LBY107 | 0.81 | 1.36E−03 | 1 | 7 | LBY107 | 0.72 | 8.14E−03 | 1 | 10 |
| LBY107 | 0.75 | 5.02E−03 | 1 | 19 | LBY107 | 0.72 | 8.33E−03 | 2 | 23 |
| LBY108 | 0.73 | 6.71E−03 | 3 | 1 | LBY108 | 0.76 | 3.96E−03 | 1 | 2 |
| LBY108 | 0.72 | 7.93E−03 | 1 | 9 | LBY109 | 0.72 | 8.23E−03 | 2 | 38 |
| LBY109 | 0.84 | 5.43E−04 | 2 | 28 | LBY110 | 0.72 | 8.37E−03 | 1 | 29 |
| LBY111 | 0.78 | 3.02E−03 | 1 | 27 | LBY111 | 0.88 | 1.90E−04 | 2 | 12 |
| LBY112 | 0.79 | 2.05E−03 | 1 | 21 | LBY115 | 0.81 | 1.54E−03 | 1 | 2 |
| LBY116 | 0.77 | 3.37E−03 | 1 | 9 | LBY116 | 0.71 | 1.02E−02 | 2 | 28 |
| LBY121 | 0.76 | 3.90E−03 | 3 | 37 | LBY121 | 0.72 | 7.83E−03 | 3 | 17 |
| LBY121 | 0.72 | 8.01E−03 | 3 | 9 | LBY122 | 0.72 | 7.74E−03 | 1 | 27 |
| LBY13 | 0.71 | 9.28E−03 | 1 | 39 | LBY13 | 0.74 | 5.59E−03 | 1 | 27 |
| LBY233 | 0.72 | 8.71E−03 | 3 | 33 | LBY233 | 0.74 | 5.79E−03 | 2 | 21 |

TABLE 110-continued

Correlation between the expression level of selected genes of some embodiments of the invention in various tissues and the phenotypic performance under defoliation treatment across maize varieties

| Gene Name | R | P value | Exp. set | Corr. Set ID | Gene Name | R | P value | Exp. set | Corr. Set ID |
|---|---|---|---|---|---|---|---|---|---|
| LBY233 | 0.76 | 3.87E−03 | 2 | 31 | LBY233 | 0.74 | 5.61E−03 | 2 | 5 |
| LBY233 | 0.83 | 9.17E−04 | 2 | 34 | LBY233 | 0.79 | 2.10E−03 | 2 | 25 |
| LBY233 | 0.75 | 4.83E−03 | 2 | 9 | LBY233 | 0.76 | 4.36E−03 | 2 | 7 |
| LBY5 | 0.71 | 9.09E−03 | 1 | 32 | LBY5 | 0.81 | 1.30E−03 | 2 | 12 |
| LBY6 | 0.72 | 8.87E−03 | 1 | 11 | LBY6 | 0.76 | 4.09E−03 | 1 | 18 |
| LBY6 | 0.76 | 3.94E−03 | 1 | 19 | LBY6 | 0.83 | 8.60E−04 | 1 | 20 |
| LGN18 | 0.72 | 8.27E−03 | 2 | 30 | LGN20 | 0.75 | 5.28E−03 | 3 | 29 |
| LGN24 | 0.79 | 2.28E−03 | 3 | 4 | LGN24 | 0.79 | 2.05E−03 | 3 | 3 |
| LGN24 | 0.85 | 5.35E−04 | 3 | 8 | LGN24 | 0.77 | 3.46E−03 | 1 | 11 |
| LGN24 | 0.79 | 2.23E−03 | 1 | 18 | LGN24 | 0.71 | 9.31E−03 | 1 | 10 |
| LGN24 | 0.79 | 2.00E−03 | 1 | 19 | LGN24 | 0.80 | 1.79E−03 | 1 | 20 |
| LGN26 | 0.72 | 8.76E−03 | 3 | 1 | LGN26 | 0.71 | 9.06E−03 | 1 | 18 |
| LGN26 | 0.70 | 1.06E−02 | 1 | 19 | LGN26 | 0.78 | 2.98E−03 | 1 | 20 |
| LGN26 | 0.76 | 3.82E−03 | 2 | 4 | LGN26 | 0.73 | 7.13E−03 | 2 | 13 |
| LGN26 | 0.76 | 3.75E−03 | 2 | 6 | LGN26 | 0.72 | 7.74E−03 | 2 | 18 |
| LGN26 | 0.75 | 5.01E−03 | 2 | 3 | LGN26 | 0.72 | 7.71E−03 | 2 | 19 |
| LGN26 | 0.84 | 6.89E−04 | 2 | 20 | LGN33 | 0.71 | 1.03E−02 | 3 | 1 |
| LGN34 | 0.81 | 1.38E−03 | 1 | 15 | LGN34 | 0.79 | 2.21E−03 | 1 | 17 |
| LGN39 | 0.76 | 4.26E−03 | 3 | 37 | LGN39 | 0.74 | 5.82E−03 | 1 | 30 |
| LGN39 | 0.82 | 1.06E−03 | 2 | 21 | LGN49 | 0.85 | 4.62E−04 | 3 | 29 |
| LGN49 | 0.72 | 7.97E−03 | 1 | 15 | LGN49 | 0.78 | 2.67E−03 | 1 | 17 |

Table 110: Provided are the correlations (R) between the genes expression levels in various tissues and the phenotypic performance. "Corr. ID"—correlation set ID according to the correlated parameters specified in Table 104. "Exp. Set"—Expression set specified in Table 103. "R" = Pearson correlation coefficient; "P" = p value.

Example 13

Production of Maize Transcriptome and High Throughput Correlation Analysis with Yield and NUE Related Parameters Using 60K Maize Oligonucleotide Micro-Arrays In order to produce a high throughput correlation analysis between plant phenotype and gene expression level, the present inventors utilized a maize oligonucleotide microarray, produced by Agilent Technologies [chem. (dot) agilent (dot) com/Scripts/PDS (dot) asp?1Page=50879]. The array oligonucleotide represents about 60,000 maize genes and transcripts.

Correlation of Maize Hybrids Across Ecotypes Grown Under Low Nitrogen Conditions Experimental Procedures 12 Maize hybrids were grown in 3 repetitive plots in field. Maize seeds were planted and plants were grown in the field using commercial fertilization and irrigation protocols, which included 485 $m^3$ water per dunam per entire growth period and fertilization of 30 units of nitrogen (using URAN® 21% fertilization) per dunam per entire growth period (normal conditions) or under low nitrogen conditions which included 50% percent less Nitrogen as compared to the amount of nitrogen provided under the normal conditions. In order to define correlations between the levels of RNA expression with NUE and yield components or vigor related parameters the 12 different maize hybrids were analyzed. Among them, 11 hybrids encompassing the observed variance were selected for RNA expression analysis. The correlation between the RNA levels and the characterized parameters was analyzed using Pearson correlation test [davidmlane (dot) com/hyperstat/A34739 (dot) html].

Analyzed Maize tissues—All 10 selected maize hybrids were sampled per each treatment (low N and normal conditions), in three time points (TP2=V6-V8 (six to eight collar leaf are visible, rapid growth phase and kernel row determination begins), TP5=R1-R2 (silking-blister), TP6=R3-R4 (milk-dough). Four types of plant tissues [Ear, "flag leaf" indicated in Table as "leaf", grain distal part, and internode] were sampled and RNA was extracted as described above. Each micro-array expression information tissue type has received a Set ID as summarized in Tables 111-112 below.

TABLE 111

| Maize transcriptome expression sets under low nitrogen conditions | |
|---|---|
| Expression Set | Set ID |
| Ear under low nitrogen conditions at reproductive stage: R1-R2 | 1 |
| Ear under low nitrogen conditions at reproductive stage: R3-R4 | 2 |
| Internode under low nitrogen conditions at vegetative stage: V6-V8 | 3 |
| Internode under low nitrogen conditions at reproductive stage: R1-R2 | 4 |
| Internode under low nitrogen conditions at reproductive stage: R3-R4 | 5 |
| Leaf under low nitrogen conditions at vegetative stage: V6-V8 | 6 |
| Leaf under low nitrogen conditions at reproductive stage: R1-R2 | 7 |
| Leaf under low nitrogen conditions at reproductive stage: R3-R4 | 8 |

Table 111: Provided are the maize transcriptome expression sets under low nitrogen conditions Leaf = the leaf below the main ear; Flower meristem = Apical meristem following male flower initiation; Ear = the female flower at the anthesis day. Grain Distal = maize developing grains from the cob extreme area, Grain Basal = maize developing grains from the cob basal area; Internodes = internodes located above and below the main ear in the plant.

TABLE 112

| Maize transcriptome expression sets under normal growth conditions | |
|---|---|
| Expression Set | Set ID |
| Ear at R1-R2 stage under normal conditions | 1 |
| Grain distal at R4-R5 stage under normal conditions | 2 |
| Internode at R3-R4 stage under normal conditions | 3 |
| Leaf at R1-R2 stage under normal conditions | 4 |
| Ear at R3-R4 stage under normal conditions | 5 |

TABLE 112-continued

Maize transcriptome expression sets under normal growth conditions

| Expression Set | Set ID |
|---|---|
| Internode at R1-R2 stage under normal conditions | 6 |
| Internode at V6-V8 stage under normal conditions | 7 |
| Leaf at V6-V8 stage under normal conditions | 8 |

Table 112: Provided are the maize transcriptome expression sets under normal growth conditions. Leaf = the leaf below the main ear; Flower meristem = Apical meristem following male flower initiation; Ear = the female flower at the anthesis day. Grain Distal = maize developing grains from the cob extreme area, Grain Basal = maize developing grains from the cob basal area; Internodes = internodes located above and below the main ear in the plant.

The following parameters were collected using digital imaging system:

Grain Area ($cm^2$)—At the end of the growing period the grains were separated from the ear. A sample of ~200 grains were weighted, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 5 ears were photographed and images were processed using the below described image processing system. The Ear area was measured from those images and was divided by the number of Ears.

Ear Length and Ear Width (cm)—At the end of the growing period 5 ears were photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants (total and 6) were weighted (gr.) separately and the average ear per plant was calculated for total (Ear FW per plot) and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located.

Leaf number per plant—Plants were characterized for leaf number during growing period at 5 time points. In each measure, plants were measured for their leaf number by counting all the leaves of 3 selected plants per plot.

Relative Growth Rate was calculated using Formulas II-XIII, XXVIII, and/or XXXIV (described above).

SPAD—Chlorophyll content was determined using a Minolta SPAD 502 chlorophyll meter and measurement was performed at early stages of grain filling (R1-R2) and late stage of grain filling (R3-R4). SPAD meter readings were done on young fully developed leaf. Three measurements per leaf were taken per plot. Data were taken after 46 and 54 days after sowing (DPS).

Dry weight per plant—At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—The harvest index per plant was calculated using Formula XVII above.

Percent Filled Ear [%]—The percent of filled ear was calculated as the percentage of the Ear area with grains out of the total ear.

Cob diameter [cm]—The diameter of the cob without grains was measured using a ruler.

Kernel Row Number per Ear—The number of rows in each ear was counted.

Experimental Results 11 different maize hybrids were grown and characterized for different parameters. Tables 111-112 describe the Maize expression sets, and Tables 113-114 below describe the Maize correlated parameters. The average for each of the measured parameters was calculated using the JMP software (Tables 115-118) and a subsequent correlation analysis was performed (Table 119-120). Results were then integrated to the database.

TABLE 113

Maize correlated parameters (vectors) under low nitrogen conditions

| Correlated parameter with | Correlation ID |
|---|---|
| Ear Length under Low N conditions [cm] | 1 |
| Ear Length of filled area under Low N conditions [cm] | 2 |
| Ear width under Low N conditions [mm] | 3 |
| Final Leaf Number under Low N conditions [num] | 4 |
| Final Main Ear Height under Low N conditions [cm] | 5 |
| Final Plant Height under Low N conditions [cm] | 6 |
| No of rows per ear under Low N conditions [num] | 7 |
| SPAD at R1-R2 under Low N conditions [SPAD unit] | 8 |
| SPAD at R3-R4 under Low N conditions [SPAD unit] | 9 |
| Stalk width at TP5 under Low N conditions [mm] | 10 |
| Ears weight per plot under Low N conditions [kg] | 11 |
| Final Plant DW under Low N conditions [kg] | 12 |
| NUE yield/N applied in soil under Low N conditions [ratio] | 13 |
| NUE at early grain filling (R1-R2) yield [kg]/N in plant per SPAD under Low N conditions | 14 |
| NUE at grain filling (R3-R4) yield [kg]/N in plant per SPAD under Low N conditions | 15 |

TABLE 113-continued

Maize correlated parameters (vectors) under low nitrogen conditions

| Correlated parameter with | Correlation ID |
|---|---|
| NUpE under Low N conditions [biomass/N applied] | 16 |
| Seed yield per dunam under Low N conditions [kg] | 17 |
| Yield/LAI under Low N conditions [ratio] | 18 |
| Yield/stalk width under Low N conditions [ratio] | 19 |
| seed yield per plant under Low N conditions [kg] | 20 |

Table 113. "cm" = centimeters' "mm" = millimeters; "kg" = kilograms; SPAD at R1-R2 and SPAD R3-R4: Chlorophyll level after early and late stages of grain filling; "NUE" = nitrogen use efficiency; "NUpE" = nitrogen uptake efficiency; "LAI" = leaf area index; "N" = nitrogen; Low N = under low Nitrogen conditions; "dunam" = 1000 $m^2$.

TABLE 114

Maize correlated parameters (vectors) under normal conditions

| Correlated parameter with | Corr. ID |
|---|---|
| Final Plant DW under Normal conditions [kg] | 1 |
| Ear Length under Normal conditions [cm] | 2 |
| Ear Length of filled area under Normal conditions [cm] | 3 |
| Ear width under Normal conditions [mm] | 4 |
| Final Leaf Number under Normal conditions [num] | 5 |
| Final Main Ear Height under Normal conditions [cm] | 6 |
| Final Plant Height under Normal conditions [cm] | 7 |
| No of rows per ear under Normal conditions [num] | 8 |
| SPAD at R1-R2 under Normal conditions [SPAD unit] | 9 |
| SPAD at R3-R4 under Normal conditions [SPAD unit] | 10 |
| Stalk width at TP5 under Normal conditions [cm] | 11 |
| Ears weight per plot under Normal conditions [kg] | 12 |
| NUE yield/N applied in soil under Normal conditions [ratio] | 13 |
| NUE at early grain filling [R1-R2] yield [kg]/N in plant per SPAD under Normal conditions [ratio] | 14 |
| NUE at grain filling [R3-R4] yield [kg]/N in plant per SPAD under Normal conditions [ratio] | 15 |
| NUpE under Normal conditions [biomass/N applied] | 16 |
| Seed yield per dunam [kg]under Normal conditions [kg] | 17 |
| Yield/LAI under Normal conditions [ratio] | 18 |
| Yield/stalk width under Normal conditions [ratio] | 19 |
| Seed yield per plant under Normal conditions [kg] | 20 |

Table 114. "cm" = centimeters' "mm" = millimeters; "kg" = kilograms; SPAD at R1-R2 and SPAD R3-R4: Chlorophyll level after early and late stages of grain filling; "NUE" = nitrogen use efficiency; "NUpE" = nitrogen uptake efficiency; "LAI" = leaf area index; "N" = nitrogen; "Normal" = under normal conditions; "dunam" = 1000 $m^2$.

TABLE 115

Measured parameters in Maize accessions under Low nitrogen conditions

| Line/Corr. ID | 1 | 2 | 3 | 4 | 5 | 6 | 7 | 8 | 9 | 10 |
|---|---|---|---|---|---|---|---|---|---|---|
| Line-1 | 20.614 | 18.398 | 46.713 | 15.024 | 158.076 | 305.836 | 14.181 | 60.236 | 59.286 | 2.764 |
| Line-2 | 20.976 | 18.417 | 48.222 | 11.643 | 136.238 | 270.929 | 15.214 | 57.938 | 57.621 | 2.419 |
| Line-3 | 20.222 | 19.778 | 48.323 | 13.500 | 128.389 | 290.611 | 15.000 | 58.761 | 58.400 | 2.650 |
| Line-4 | 20.111 | 18.833 | 49.863 | 11.611 | 133.056 | 252.167 | 15.667 | 59.478 | 59.189 | 2.767 |
| Line-5 | 20.111 | 16.222 | 52.873 | 11.833 | 137.833 | 260.222 | 16.000 | 58.500 | 58.194 | 2.672 |
| Line-6 | 18.500 | 16.000 | 47.436 | 11.889 | 99.556 | 227.222 | 15.944 | 64.039 | 62.667 | 2.594 |
| Line-7 | 19.056 | 15.278 | 49.609 | 12.556 | 130.167 | 271.722 | 15.556 | 56.422 | 61.044 | 2.983 |
| Line-8 | 18.250 | 15.694 | 48.567 | 11.667 | 114.611 | 248.611 | 14.500 | 60.000 | 59.867 | 2.611 |
| Line-9 | 20.095 | 16.771 | 52.406 | 12.443 | 143.862 | 279.329 | 16.410 | 58.317 | 57.467 | 2.650 |
| Line-10 | 17.806 | 14.056 | 42.634 | 9.278 | 61.611 | 171.278 | 14.367 | 53.061 | 49.611 | 2.278 |
| Line-11 | 21.250 | 19.556 | 50.003 | 13.167 | 114.444 | 269.778 | 15.744 | 61.717 | 61.867 | 2.817 |

Table 115. Provided are the values of each of the parameters (as described above) measured in maize accessions (line) under low nitrogen growth conditions. Growth conditions are specified in the experimental procedure section.

TABLE 116

Additional parameters in Maize accessions under Low nitrogen conditions

| Line/Corr. ID | 11 | 12 | 13 | 14 | 15 | 16 | 17 | 19 | 20 | 18 |
|---|---|---|---|---|---|---|---|---|---|---|
| Line-1 | 6.605 | 1.593 | 7.225 | 18.023 | 18.352 | 0.0106 | 1083.749 | 416.532 | 0.135 | 341.501 |
| Line-2 | 7.974 | 1.429 | 8.411 | 21.787 | 21.919 | 0.0095 | 1261.635 | 528.383 | 0.158 | 408.093 |
| Line-3 | 9.634 | 1.533 | 10.328 | 26.335 | 26.479 | 0.0102 | 1549.245 | 583.458 | 0.194 | 464.768 |
| Line-4 | 9.222 | 1.950 | 9.986 | 25.144 | 25.333 | 0.0130 | 1497.865 | 541.017 | 0.187 | 522.258 |
| Line-5 | 7.630 | 1.483 | 7.626 | 19.547 | 19.685 | 0.0099 | 1143.850 | 428.089 | 0.143 | 439.525 |
| Line-6 | 7.215 | 1.600 | 7.728 | 18.049 | 18.541 | 0.0107 | 1159.260 | 444.294 | 0.145 | 312.581 |
| Line-7 | 7.917 | 1.583 | 8.049 | 21.388 | 19.785 | 0.0106 | 1207.424 | 407.200 | 0.151 | 345.901 |
| Line-8 | 28.961 | 1.283 | 8.334 | 20.788 | 20.917 | 0.0086 | 1250.052 | 477.438 | 0.156 | 287.735 |
| Line-9 | 7.797 | 1.514 | 7.640 | 19.676 | 19.935 | 0.0101 | 1146.036 | 445.604 | 0.143 | |
| Line-10 | 2.410 | 0.433 | 2.555 | 7.213 | 7.722 | 0.0029 | 383.219 | 167.902 | 0.048 | |
| Line-11 | 9.775 | 1.517 | 10.599 | 25.702 | 25.902 | 0.0101 | 1589.914 | 562.294 | 0.199 | 501.239 |

Table 116. Provided are the values of each of the parameters (as described above) measured in maize accessions (line) under low nitrogen growth conditions. Growth conditions are specified in the experimental procedure section.

TABLE 117

Measured parameters in Maize accessions under normal growth conditions

| Line/Corr. ID | 1 | 2 | 3 | 4 | 5 | 6 | 7 | 8 | 9 | 10 |
|---|---|---|---|---|---|---|---|---|---|---|
| Line-1 | 1.267 | 19.944 | 16.233 | 51.075 | 11.800 | 130.311 | 273.456 | 16.111 | 56.889 | 59.933 |
| Line-2 | 1.300 | 20.167 | 17.500 | 46.290 | 11.111 | 122.333 | 260.500 | 14.667 | 57.161 | 60.900 |
| Line-3 | 1.333 | 18.111 | 17.722 | 45.919 | 13.278 | 127.667 | 288.000 | 15.444 | 59.272 | 56.892 |
| Line-4 | 1.500 | 19.889 | 18.444 | 47.632 | 11.778 | 113.022 | 238.500 | 15.889 | 61.611 | 58.700 |
| Line-5 | 1.300 | 19.500 | 15.667 | 51.407 | 11.944 | 135.278 | 286.944 | 16.167 | 58.628 | 58.700 |
| Line-6 | 1.583 | 17.722 | 14.667 | 47.420 | 12.333 | 94.278 | 224.833 | 15.167 | 61.228 | 63.158 |
| Line-7 | 1.417 | 17.667 | 12.944 | 47.253 | 12.444 | 120.944 | 264.444 | 16.000 | 60.167 | 59.750 |
| Line-8 | 1.367 | 17.278 | 14.028 | 46.846 | 12.222 | 107.722 | 251.611 | 14.833 | 61.089 | 62.350 |
| Line-9 | 11.383 | 20.500 | 18.778 | 49.275 | 12.556 | 112.500 | 278.444 | 15.389 | 62.200 | 61.925 |
| Line-10 | 1.700 | 17.500 | 12.333 | 48.283 | 11.667 | 139.667 | 279.000 | 17.667 | 57.506 | 57.225 |
| Line-11 | 0.417 | 19.856 | 16.067 | 41.837 | 9.278 | 60.444 | 163.778 | 14.267 | 52.044 | 49.342 |

Table 117. Provided are the values of each of the parameters (as described above) measured in maize accessions (line) under normal growth conditions. Growth conditions are specified in the experimental procedure section.

TABLE 118

Additional measured parameters in Maize accessions under normal growth conditions

| Line/Corr. ID | 11 | 12 | 13 | 14 | 15 | 16 | 17 | 19 | 20 | 18 |
|---|---|---|---|---|---|---|---|---|---|---|
| Line-1 | 2.911 | 8.943 | 4.452 | 23.431 | 24.978 | 0.0084 | 1335.625 | 456.707 | 0.167 | 426.086 |
| Line-2 | 2.644 | 7.023 | 3.624 | 19.052 | 17.807 | 0.0087 | 1087.058 | 412.443 | 0.136 | 312.975 |
| Line-3 | 2.711 | 7.533 | 4.008 | 20.293 | 20.332 | 0.0089 | 1202.532 | 443.368 | 0.150 | 307.277 |
| Line-4 | 2.900 | 7.991 | 4.237 | 20.719 | 19.957 | 0.0100 | 1271.204 | 438.705 | 0.159 | 362.442 |
| Line-5 | 2.700 | 8.483 | 4.010 | 20.486 | 19.026 | 0.0087 | 1202.966 | 446.659 | 0.150 | 314.138 |
| Line-6 | 2.622 | 5.632 | 3.124 | 15.360 | 13.904 | 0.0106 | 937.083 | 356.950 | 0.117 | 224.582 |
| Line-7 | 2.922 | 6.100 | 3.286 | 16.383 | 16.234 | 0.0094 | 985.893 | 337.486 | 0.123 | 266.437 |
| Line-8 | 2.722 | 6.659 | 3.500 | 17.191 | 17.214 | 0.0091 | 1050.131 | 385.790 | 0.131 | 261.664 |
| Line-9 | 2.844 | 8.402 | 4.551 | 21.955 | 21.017 | 0.0759 | 1365.293 | 481.942 | 0.171 | 482.329 |
| Line-10 | 2.656 | 8.215 | 4.087 | 20.994 | 21.529 | 0.0038 | 1226.077 | 471.568 | 0.153 | |
| Line-11 | 2.256 | 1.879 | 1.003 | 5.725 | 5.519 | 0.0028 | 300.928 | 139.728 | 0.038 | |

Table 118. Provided are the values of each of the parameters (as described above) measured in maize accessions (line) under normal growth conditions. Growth conditions are specified in the experimental procedure section.

TABLE 119

Correlation between the expression level of selected genes of some embodiments of the invention in various tissues and the phenotypic performance under low nitrogen conditions across maize accession

| Gene Name | R | P value | Exp. set | Corr. Set ID | Gene Name | R | P value | Exp. set | Corr. Set ID |
|---|---|---|---|---|---|---|---|---|---|
| LBY103 | 0.77 | 1.56E−02 | 5 | 10 | LBY103 | 0.80 | 9.38E−03 | 5 | 16 |
| LBY103 | 0.92 | 4.29E−04 | 5 | 9 | LBY103 | 0.71 | 3.27E−02 | 5 | 3 |
| LBY103 | 0.80 | 9.37E−03 | 5 | 8 | LBY103 | 0.80 | 9.38E−03 | 5 | 12 |
| LBY103 | 0.85 | 3.33E−02 | 6 | 5 | LBY103 | 0.72 | 1.03E−01 | 6 | 6 |
| LBY103 | 0.71 | 2.18E−02 | 3 | 17 | LBY103 | 0.71 | 2.18E−02 | 3 | 13 |
| LBY103 | 0.71 | 2.18E−02 | 3 | 20 | LBY103 | 0.87 | 1.02E−02 | 8 | 18 |
| LBY103 | 0.74 | 3.46E−02 | 8 | 2 | LBY103 | 0.70 | 5.20E−02 | 8 | 1 |
| LBY103 | 0.73 | 3.86E−02 | 2 | 10 | LBY103 | 0.72 | 4.41E−02 | 2 | 9 |
| LBY103 | 0.75 | 3.05E−02 | 2 | 3 | LBY103 | 0.84 | 9.84E−03 | 2 | 11 |
| LBY103 | 0.74 | 5.68E−02 | 4 | 11 | LBY103 | 0.96 | 5.49E−04 | 1 | 10 |
| LBY104 | 0.71 | 7.37E−02 | 1 | 16 | LBY104 | 0.83 | 2.05E−02 | 1 | 9 |
| LBY104 | 0.88 | 9.55E−03 | 1 | 3 | LBY104 | 0.75 | 5.31E−02 | 1 | 5 |
| LBY104 | 0.74 | 5.97E−02 | 1 | 11 | LBY104 | 0.71 | 7.11E−02 | 1 | 6 |
| LBY104 | 0.71 | 7.37E−02 | 1 | 12 | LBY104 | 0.96 | 2.61E−03 | 6 | 5 |
| LBY104 | 0.90 | 1.48E−02 | 6 | 6 | LBY104 | 0.72 | 6.67E−02 | 4 | 5 |
| LBY104 | 0.87 | 1.02E−02 | 4 | 8 | LBY104 | 0.85 | 1.60E−02 | 4 | 7 |
| LBY105 | 0.81 | 2.73E−02 | 1 | 17 | LBY105 | 0.70 | 7.80E−02 | 1 | 16 |
| LBY105 | 0.77 | 4.13E−02 | 1 | 5 | LBY105 | 0.81 | 2.73E−02 | 1 | 13 |
| LBY105 | 0.90 | 6.26E−03 | 1 | 19 | LBY105 | 0.78 | 3.75E−02 | 1 | 6 |
| LBY105 | 0.82 | 2.43E−02 | 1 | 14 | LBY105 | 0.70 | 7.80E−02 | 1 | 12 |
| LBY105 | 0.74 | 9.58E−02 | 1 | 18 | LBY105 | 0.97 | 3.17E−04 | 1 | 2 |
| LBY105 | 0.91 | 4.16E−03 | 1 | 1 | LBY105 | 0.81 | 2.73E−02 | 1 | 20 |
| LBY105 | 0.86 | 1.40E−02 | 1 | 15 | LBY105 | 0.72 | 2.97E−02 | 5 | 4 |

TABLE 119-continued

Correlation between the expression level of selected genes of some embodiments of the invention in various tissues and the phenotypic performance under low nitrogen conditions across maize accession

| Gene Name | R | P value | Exp. set | Corr. Set ID | Gene Name | R | P value | Exp. set | Corr. Set ID |
|---|---|---|---|---|---|---|---|---|---|
| LBY105 | 0.91 | 1.29E−02 | 6 | 5 | LBY105 | 0.81 | 5.33E−02 | 6 | 6 |
| LBY105 | 0.73 | 1.58E−02 | 3 | 10 | LBY105 | 0.81 | 1.38E−02 | 8 | 16 |
| LBY105 | 0.83 | 1.11E−02 | 8 | 9 | LBY105 | 0.86 | 5.96E−03 | 8 | 5 |
| LBY105 | 0.80 | 1.70E−02 | 8 | 8 | LBY105 | 0.74 | 3.71E−02 | 8 | 7 |
| LBY105 | 0.81 | 1.52E−02 | 8 | 6 | LBY105 | 0.81 | 1.38E−02 | 8 | 12 |
| LBY105 | 0.74 | 5.58E−02 | 8 | 18 | LBY105 | 0.89 | 3.15E−03 | 7 | 17 |
| LBY105 | 0.75 | 3.33E−02 | 7 | 9 | LBY105 | 0.94 | 5.63E−04 | 7 | 4 |
| LBY105 | 0.76 | 2.87E−02 | 7 | 3 | LBY105 | 0.89 | 3.15E−03 | 7 | 13 |
| LBY105 | 0.84 | 9.72E−03 | 7 | 19 | LBY105 | 0.78 | 2.14E−02 | 7 | 6 |
| LBY105 | 0.86 | 6.76E−03 | 7 | 14 | LBY105 | 0.75 | 3.16E−02 | 7 | 2 |
| LBY105 | 0.89 | 3.15E−03 | 7 | 20 | LBY105 | 0.86 | 5.79E−03 | 7 | 15 |
| LBY105 | 0.70 | 7.97E−02 | 4 | 16 | LBY105 | 0.81 | 2.78E−02 | 4 | 5 |
| LBY105 | 0.93 | 2.02E−03 | 4 | 6 | LBY105 | 0.79 | 3.36E−02 | 4 | 14 |
| LBY105 | 0.70 | 7.97E−02 | 4 | 12 | LBY106 | 0.96 | 5.18E−04 | 8 | 18 |
| LBY106 | 0.76 | 2.73E−02 | 8 | 2 | LBY107 | 0.73 | 1.02E−01 | 6 | 17 |
| LBY107 | 0.72 | 1.08E−01 | 6 | 4 | LBY107 | 0.76 | 8.05E−02 | 6 | 3 |
| LBY107 | 0.85 | 3.20E−02 | 6 | 8 | LBY107 | 0.71 | 1.15E−01 | 6 | 7 |
| LBY107 | 0.73 | 1.02E−01 | 6 | 13 | LBY107 | 0.73 | 1.02E−01 | 6 | 20 |
| LBY107 | 0.75 | 3.21E−02 | 8 | 17 | LBY107 | 0.80 | 1.62E−02 | 8 | 9 |
| LBY107 | 0.78 | 2.29E−02 | 8 | 3 | LBY107 | 0.70 | 5.31E−02 | 8 | 7 |
| LBY107 | 0.75 | 3.21E−02 | 8 | 13 | LBY107 | 0.73 | 4.08E−02 | 8 | 14 |
| LBY107 | 0.75 | 3.21E−02 | 8 | 20 | LBY107 | 0.73 | 3.98E−02 | 7 | 17 |
| LBY107 | 0.77 | 2.47E−02 | 7 | 4 | LBY107 | 0.79 | 1.84E−02 | 7 | 8 |
| LBY107 | 0.73 | 3.98E−02 | 7 | 13 | LBY107 | 0.74 | 3.57E−02 | 7 | 19 |
| LBY107 | 0.81 | 1.39E−02 | 7 | 2 | LBY107 | 0.89 | 3.43E−03 | 7 | 1 |
| LBY107 | 0.73 | 3.98E−02 | 7 | 20 | LBY107 | 0.70 | 5.13E−02 | 7 | 15 |
| LBY107 | 0.80 | 1.78E−02 | 2 | 9 | LBY107 | 0.74 | 5.79E−02 | 4 | 9 |
| LBY107 | 0.73 | 6.09E−02 | 4 | 4 | LBY107 | 0.81 | 2.70E−02 | 4 | 7 |
| LBY108 | 0.80 | 2.97E−02 | 4 | 4 | LBY108 | 0.92 | 3.40E−03 | 4 | 6 |
| LBY109 | 0.70 | 7.92E−02 | 1 | 8 | LBY109 | 0.83 | 1.97E−02 | 1 | 11 |
| LBY109 | 0.74 | 5.94E−02 | 4 | 6 | LBY110 | 0.77 | 4.48E−02 | 1 | 8 |
| LBY110 | 0.73 | 1.62E−02 | 3 | 8 | LBY110 | 0.72 | 4.38E−02 | 7 | 11 |
| LBY110 | 0.79 | 1.95E−02 | 2 | 9 | LBY110 | 0.86 | 6.62E−03 | 2 | 8 |
| LBY110 | 0.74 | 5.53E−02 | 4 | 9 | LBY111 | 0.87 | 2.44E−02 | 1 | 18 |
| LBY111 | 0.71 | 1.16E−01 | 6 | 10 | LBY111 | 0.78 | 6.66E−02 | 6 | 5 |
| LBY111 | 0.72 | 1.08E−01 | 6 | 6 | LBY111 | 0.74 | 3.55E−02 | 8 | 1 |
| LBY111 | 0.75 | 3.35E−02 | 2 | 8 | LBY112 | 0.70 | 7.69E−02 | 1 | 9 |
| LBY112 | 0.81 | 2.70E−02 | 1 | 3 | LBY112 | 0.82 | 2.35E−02 | 1 | 5 |
| LBY112 | 0.77 | 4.24E−02 | 1 | 6 | LBY112 | 0.70 | 1.19E−01 | 6 | 3 |
| LBY113 | 0.88 | 8.41E−03 | 1 | 10 | LBY114 | 0.73 | 9.84E−02 | 1 | 18 |
| LBY114 | 0.76 | 4.76E−02 | 1 | 1 | LBY114 | 0.75 | 2.08E−02 | 5 | 10 |
| LBY114 | 0.76 | 1.64E−02 | 5 | 16 | LBY114 | 0.77 | 1.55E−02 | 5 | 4 |
| LBY114 | 0.71 | 3.18E−02 | 5 | 6 | LBY114 | 0.76 | 1.64E−02 | 5 | 12 |
| LBY114 | 0.76 | 1.65E−02 | 5 | 2 | LBY114 | 0.70 | 3.57E−02 | 5 | 1 |
| LBY114 | 0.83 | 4.29E−02 | 6 | 5 | LBY114 | 0.73 | 9.64E−02 | 6 | 6 |
| LBY114 | 0.74 | 3.48E−02 | 8 | 10 | LBY114 | 0.82 | 2.37E−02 | 4 | 5 |
| LBY116 | 0.79 | 6.12E−02 | 6 | 5 | LBY116 | 0.75 | 5.31E−02 | 8 | 18 |
| LBY116 | 0.88 | 9.23E−03 | 4 | 17 | LBY116 | 0.80 | 2.97E−02 | 4 | 3 |
| LBY116 | 0.88 | 9.84E−03 | 4 | 5 | LBY116 | 0.88 | 9.23E−03 | 4 | 13 |
| LBY116 | 0.75 | 5.01E−02 | 4 | 6 | LBY116 | 0.90 | 5.51E−03 | 4 | 14 |
| LBY116 | 0.86 | 1.23E−02 | 4 | 18 | LBY116 | 0.88 | 9.23E−03 | 4 | 20 |
| LBY116 | 0.84 | 1.71E−02 | 4 | 15 | LBY117 | 0.77 | 4.09E−02 | 1 | 10 |
| LBY117 | 0.90 | 6.40E−03 | 1 | 11 | LBY117 | 0.81 | 8.68E−03 | 5 | 17 |
| LBY117 | 0.81 | 7.98E−03 | 5 | 10 | LBY117 | 0.75 | 2.07E−02 | 5 | 16 |
| LBY117 | 0.78 | 1.35E−02 | 5 | 3 | LBY117 | 0.81 | 8.68E−03 | 5 | 13 |
| LBY117 | 0.79 | 1.05E−02 | 5 | 14 | LBY117 | 0.75 | 2.07E−02 | 5 | 12 |
| LBY117 | 0.71 | 4.81E−02 | 5 | 18 | LBY117 | 0.81 | 8.68E−03 | 5 | 20 |
| LBY117 | 0.78 | 1.33E−02 | 5 | 15 | LBY118 | 0.81 | 2.74E−02 | 1 | 10 |
| LBY118 | 0.71 | 7.65E−02 | 1 | 5 | LBY118 | 0.83 | 4.19E−02 | 6 | 1 |
| LBY119 | 0.81 | 2.69E−02 | 1 | 10 | LBY119 | 0.75 | 5.24E−02 | 1 | 16 |
| LBY119 | 0.80 | 3.20E−02 | 1 | 9 | LBY119 | 0.71 | 7.15E−02 | 1 | 4 |
| LBY119 | 0.80 | 3.12E−02 | 1 | 3 | LBY119 | 0.75 | 5.46E−02 | 1 | 5 |
| LBY119 | 0.74 | 5.86E−02 | 1 | 7 | LBY119 | 0.72 | 6.95E−02 | 1 | 6 |
| LBY119 | 0.75 | 5.24E−02 | 1 | 12 | LBY120 | 0.85 | 1.55E−02 | 1 | 11 |
| LBY120 | 0.86 | 2.91E−02 | 6 | 5 | LBY120 | 0.78 | 2.33E−02 | 8 | 5 |
| LBY120 | 0.84 | 1.89E−02 | 7 | 18 | LBY120 | 0.87 | 1.08E−02 | 4 | 8 |
| LBY121 | 0.93 | 2.68E−03 | 1 | 17 | LBY121 | 0.89 | 7.74E−03 | 1 | 16 |
| LBY121 | 0.74 | 5.51E−02 | 1 | 9 | LBY121 | 0.78 | 3.72E−02 | 1 | 4 |
| LBY121 | 0.84 | 1.89E−02 | 1 | 3 | LBY121 | 0.78 | 3.83E−02 | 1 | 5 |
| LBY121 | 0.71 | 7.14E−02 | 1 | 7 | LBY121 | 0.93 | 2.68E−03 | 1 | 13 |
| LBY121 | 0.85 | 1.44E−02 | 1 | 19 | LBY121 | 0.71 | 7.49E−02 | 1 | 6 |
| LBY121 | 0.90 | 6.39E−03 | 1 | 14 | LBY121 | 0.89 | 7.74E−03 | 1 | 12 |
| LBY121 | 0.70 | 7.74E−02 | 1 | 2 | LBY121 | 0.87 | 1.15E−02 | 1 | 1 |

TABLE 119-continued

Correlation between the expression level of selected genes of some embodiments of the invention in various tissues and the phenotypic performance under low nitrogen conditions across maize accession

| Gene Name | R | P value | Exp. set | Corr. Set ID | Gene Name | R | P value | Exp. set | Corr. Set ID |
|---|---|---|---|---|---|---|---|---|---|
| LBY121 | 0.93 | 2.68E−03 | 1 | 20 | LBY121 | 0.91 | 5.00E−03 | 1 | 15 |
| LBY121 | 0.74 | 2.32E−02 | 5 | 4 | LBY121 | 0.72 | 1.04E−01 | 6 | 10 |
| LBY121 | 0.90 | 1.55E−02 | 6 | 5 | LBY121 | 0.86 | 2.81E−02 | 6 | 6 |
| LBY121 | 0.70 | 5.28E−02 | 7 | 11 | LBY121 | 0.70 | 5.29E−02 | 2 | 9 |
| LBY121 | 0.75 | 5.30E−02 | 4 | 9 | LBY121 | 0.72 | 6.88E−02 | 4 | 5 |
| LBY122 | 0.90 | 1.39E−02 | 1 | 18 | LBY122 | 0.78 | 3.69E−02 | 1 | 2 |
| LBY122 | 0.78 | 3.81E−02 | 1 | 1 | LBY122 | 0.72 | 4.41E−02 | 8 | 6 |
| LBY123 | 0.74 | 5.70E−02 | 1 | 17 | LBY123 | 0.76 | 4.76E−02 | 1 | 4 |
| LBY123 | 0.80 | 3.26E−02 | 1 | 5 | LBY123 | 0.74 | 5.70E−02 | 1 | 13 |
| LBY123 | 0.83 | 2.16E−02 | 1 | 19 | LBY123 | 0.84 | 1.74E−02 | 1 | 6 |
| LBY123 | 0.77 | 4.33E−02 | 1 | 14 | LBY123 | 0.70 | 1.20E−01 | 1 | 18 |
| LBY123 | 0.73 | 6.17E−02 | 1 | 2 | LBY123 | 0.80 | 3.01E−02 | 1 | 1 |
| LBY123 | 0.74 | 5.70E−02 | 1 | 20 | LBY123 | 0.74 | 5.67E−02 | 1 | 15 |
| LBY123 | 0.79 | 3.33E−02 | 4 | 6 | LBY123 | 0.70 | 7.91E−02 | 1 | 10 |
| LBY13 | 0.72 | 6.86E−02 | 1 | 3 | LBY13 | 0.75 | 5.46E−02 | 1 | 5 |
| LBY13 | 0.84 | 4.63E−03 | 5 | 16 | LBY13 | 0.80 | 9.98E−03 | 5 | 5 |
| LBY13 | 0.84 | 4.63E−03 | 5 | 12 | LBY13 | 0.80 | 5.81E−02 | 6 | 5 |
| LBY13 | 0.77 | 2.51E−02 | 8 | 16 | LBY13 | 0.78 | 2.36E−02 | 8 | 5 |
| LBY13 | 0.77 | 2.51E−02 | 8 | 12 | LBY13 | 0.71 | 4.65E−02 | 2 | 16 |
| LBY13 | 0.71 | 4.65E−02 | 2 | 12 | LBY233 | 0.87 | 2.31E−02 | 6 | 4 |
| LBY233 | 0.72 | 1.09E−01 | 6 | 6 | LBY233 | 0.80 | 3.06E−02 | 2 | 18 |
| LBY233 | 0.87 | 1.07E−02 | 4 | 9 | LBY5 | 0.71 | 1.11E−01 | 1 | 18 |
| LBY5 | 0.76 | 1.69E−02 | 5 | 10 | LBY5 | 0.79 | 1.08E−02 | 5 | 3 |
| LBY5 | 0.87 | 2.56E−02 | 6 | 10 | LBY5 | 0.94 | 6.07E−03 | 6 | 3 |
| LBY5 | 0.76 | 1.11E−02 | 3 | 10 | LBY5 | 0.89 | 3.02E−03 | 8 | 16 |
| LBY5 | 0.72 | 4.53E−02 | 8 | 5 | LBY5 | 0.89 | 3.02E−03 | 8 | 12 |
| LBY5 | 0.78 | 2.36E−02 | 7 | 16 | LBY5 | 0.86 | 5.74E−03 | 7 | 9 |
| LBY5 | 0.85 | 6.96E−03 | 7 | 8 | LBY5 | 0.77 | 2.49E−02 | 7 | 7 |
| LBY5 | 0.78 | 2.36E−02 | 7 | 12 | LBY6 | 0.90 | 1.35E−02 | 6 | 9 |
| LBY6 | 0.72 | 6.74E−02 | 8 | 18 | LBY6 | 0.80 | 3.16E−02 | 2 | 18 |
| LBY6 | 0.84 | 8.43E−03 | 2 | 2 | LBY6 | 0.71 | 4.77E−02 | 2 | 1 |
| LGN17 | 0.75 | 5.26E−02 | 1 | 4 | LGN17 | 0.72 | 6.62E−02 | 1 | 19 |
| LGN17 | 0.79 | 3.65E−02 | 1 | 2 | LGN17 | 0.70 | 7.78E−02 | 1 | 15 |
| LGN17 | 0.75 | 1.34E−02 | 3 | 5 | LGN17 | 0.83 | 2.75E−03 | 3 | 1 |
| LGN18 | 0.82 | 2.48E−02 | 1 | 8 | LGN18 | 0.73 | 1.03E−01 | 6 | 17 |
| LGN18 | 0.73 | 1.03E−01 | 6 | 13 | LGN18 | 0.77 | 7.38E−02 | 6 | 18 |
| LGN18 | 0.78 | 6.48E−02 | 6 | 1 | LGN18 | 0.73 | 1.03E−01 | 6 | 20 |
| LGN18 | 0.74 | 3.59E−02 | 8 | 11 | LGN18 | 0.72 | 4.32E−02 | 7 | 4 |
| LGN18 | 0.76 | 2.73E−02 | 7 | 2 | LGN18 | 0.75 | 3.32E−02 | 7 | 1 |
| LGN18 | 0.81 | 2.81E−02 | 4 | 11 | LGN20 | 0.76 | 4.59E−02 | 1 | 5 |
| LGN20 | 0.76 | 4.88E−02 | 1 | 19 | LGN20 | 0.74 | 5.47E−02 | 1 | 2 |
| LGN20 | 0.83 | 1.98E−02 | 1 | 1 | LGN20 | 0.70 | 7.84E−02 | 1 | 15 |
| LGN20 | 0.73 | 2.51E−02 | 5 | 11 | LGN20 | 0.75 | 8.85E−02 | 6 | 1 |
| LGN20 | 0.90 | 2.30E−03 | 8 | 4 | LGN20 | 0.82 | 1.34E−02 | 8 | 5 |
| LGN20 | 0.91 | 1.50E−03 | 8 | 6 | LGN20 | 0.74 | 3.48E−02 | 7 | 17 |
| LGN20 | 0.78 | 2.31E−02 | 7 | 3 | LGN20 | 0.70 | 5.11E−02 | 7 | 5 |
| LGN20 | 0.74 | 3.48E−02 | 7 | 13 | LGN20 | 0.74 | 3.44E−02 | 7 | 19 |
| LGN20 | 0.73 | 3.83E−02 | 7 | 14 | LGN20 | 0.73 | 4.14E−02 | 7 | 2 |
| LGN20 | 0.86 | 5.55E−03 | 7 | 1 | LGN20 | 0.74 | 3.48E−02 | 7 | 20 |
| LGN20 | 0.75 | 3.13E−02 | 7 | 15 | LGN20 | 0.78 | 3.79E−02 | 4 | 3 |
| LGN23 | 0.81 | 5.02E−02 | 6 | 16 | LGN23 | 0.81 | 5.02E−02 | 6 | 12 |
| LGN23 | 0.92 | 3.11E−03 | 8 | 18 | LGN23 | 0.90 | 5.96E−03 | 7 | 18 |
| LGN23 | 0.74 | 5.74E−02 | 4 | 7 | LGN24 | 0.92 | 2.90E−03 | 4 | 5 |
| LGN24 | 0.79 | 3.56E−02 | 4 | 6 | LGN26 | 0.99 | 1.68E−04 | 1 | 18 |
| LGN26 | 0.78 | 3.69E−02 | 4 | 17 | LGN26 | 0.78 | 3.69E−02 | 4 | 13 |
| LGN26 | 0.88 | 8.52E−03 | 4 | 19 | LGN26 | 0.72 | 7.03E−02 | 4 | 6 |
| LGN26 | 0.87 | 1.11E−02 | 4 | 14 | LGN26 | 0.79 | 3.36E−02 | 4 | 18 |
| LGN26 | 0.85 | 1.45E−02 | 4 | 2 | LGN26 | 0.79 | 3.37E−02 | 4 | 1 |
| LGN26 | 0.78 | 3.69E−02 | 4 | 20 | LGN26 | 0.88 | 8.31E−03 | 4 | 15 |
| LGN33 | 0.91 | 1.27E−02 | 6 | 5 | LGN33 | 0.73 | 9.89E−02 | 6 | 6 |
| LGN33 | 0.91 | 1.93E−03 | 8 | 5 | LGN33 | 0.83 | 1.08E−02 | 8 | 6 |
| LGN33 | 0.84 | 9.65E−03 | 7 | 5 | LGN34 | 0.94 | 1.42E−03 | 1 | 17 |
| LGN34 | 0.76 | 4.79E−02 | 1 | 10 | LGN34 | 0.87 | 1.11E−02 | 1 | 16 |
| LGN34 | 0.83 | 1.94E−02 | 1 | 9 | LGN34 | 0.84 | 1.94E−02 | 1 | 4 |
| LGN34 | 0.94 | 1.72E−03 | 1 | 3 | LGN34 | 0.97 | 3.64E−04 | 1 | 5 |
| LGN34 | 0.94 | 1.80E−03 | 1 | 8 | LGN34 | 0.94 | 1.42E−03 | 1 | 13 |
| LGN34 | 0.94 | 1.58E−03 | 1 | 19 | LGN34 | 0.94 | 1.98E−03 | 1 | 6 |
| LGN34 | 0.95 | 1.16E−03 | 1 | 14 | LGN34 | 0.87 | 1.11E−02 | 1 | 12 |
| LGN34 | 0.72 | 6.72E−02 | 1 | 2 | LGN34 | 0.84 | 1.73E−02 | 1 | 1 |
| LGN34 | 0.94 | 1.42E−03 | 1 | 20 | LGN34 | 0.93 | 2.14E−03 | 1 | 15 |
| LGN34 | 0.78 | 1.33E−02 | 5 | 16 | LGN34 | 0.77 | 1.62E−02 | 5 | 9 |
| LGN34 | 0.78 | 1.33E−02 | 5 | 12 | LGN34 | 0.75 | 2.09E−02 | 5 | 1 |
| LGN34 | 0.86 | 1.47E−03 | 3 | 17 | LGN34 | 0.79 | 6.21E−03 | 3 | 16 |

TABLE 119-continued

Correlation between the expression level of selected genes of some embodiments of the invention in various tissues and the phenotypic performance under low nitrogen conditions across maize accession

| Gene Name | R | P value | Exp. set | Corr. Set ID | Gene Name | R | P value | Exp. set | Corr. Set ID |
|---|---|---|---|---|---|---|---|---|---|
| LGN34 | 0.79 | 6.29E-03 | 3 | 9 | LGN34 | 0.81 | 4.15E-03 | 3 | 8 |
| LGN34 | 0.86 | 1.47E-03 | 3 | 13 | LGN34 | 0.87 | 1.15E-03 | 3 | 19 |
| LGN34 | 0.75 | 1.33E-02 | 3 | 11 | LGN34 | 0.81 | 4.89E-03 | 3 | 14 |
| LGN34 | 0.79 | 6.21E-03 | 3 | 12 | LGN34 | 0.77 | 9.35E-03 | 3 | 2 |
| LGN34 | 0.78 | 7.88E-03 | 3 | 1 | LGN34 | 0.86 | 1.47E-03 | 3 | 20 |
| LGN34 | 0.84 | 2.58E-03 | 3 | 15 | LGN34 | 0.70 | 5.09E-02 | 8 | 11 |
| LGN34 | 0.75 | 3.06E-02 | 7 | 8 | LGN34 | 0.79 | 2.08E-02 | 7 | 7 |
| LGN34 | 0.76 | 3.00E-02 | 7 | 2 | LGN34 | 0.74 | 3.43E-02 | 7 | 1 |
| LGN34 | 0.91 | 1.70E-03 | 2 | 10 | LGN34 | 0.93 | 9.01E-04 | 2 | 16 |
| LGN34 | 0.91 | 1.73E-03 | 2 | 9 | LGN34 | 0.71 | 4.74E-02 | 2 | 4 |
| LGN34 | 0.81 | 1.51E-02 | 2 | 3 | LGN34 | 0.90 | 2.66E-03 | 2 | 5 |
| LGN34 | 0.77 | 2.58E-02 | 2 | 6 | LGN34 | 0.93 | 9.01E-04 | 2 | 12 |
| LGN34 | 0.70 | 7.84E-02 | 4 | 17 | LGN34 | 0.70 | 7.84E-02 | 4 | 13 |
| LGN34 | 0.83 | 2.13E-02 | 4 | 19 | LGN34 | 0.87 | 1.06E-02 | 4 | 2 |
| LGN34 | 0.84 | 1.86E-02 | 4 | 1 | LGN34 | 0.70 | 7.84E-02 | 4 | 20 |
| LGN35 | 0.76 | 4.54E-02 | 1 | 11 | LGN35 | 0.73 | 9.65E-02 | 6 | 10 |
| LGN35 | 0.88 | 2.20E-02 | 6 | 3 | LGN35 | 0.93 | 7.85E-03 | 6 | 5 |
| LGN35 | 0.73 | 1.02E-01 | 6 | 6 | LGN35 | 0.75 | 5.38E-02 | 4 | 5 |
| LGN35 | 0.86 | 1.29E-02 | 4 | 1 | LGN36 | 0.80 | 5.60E-02 | 6 | 17 |
| LGN36 | 0.80 | 5.60E-02 | 6 | 13 | LGN36 | 0.85 | 3.21E-02 | 6 | 19 |
| LGN36 | 0.90 | 1.55E-02 | 6 | 6 | LGN36 | 0.90 | 1.32E-02 | 6 | 14 |
| LGN36 | 0.79 | 6.42E-02 | 6 | 18 | LGN36 | 0.84 | 3.47E-02 | 6 | 2 |
| LGN36 | 0.80 | 5.60E-02 | 6 | 20 | LGN36 | 0.90 | 1.49E-02 | 6 | 15 |
| LGN36 | 0.70 | 7.74E-02 | 4 | 4 | LGN36 | 0.90 | 6.28E-03 | 4 | 8 |
| LGN36 | 0.71 | 7.47E-02 | 4 | 6 | LGN39 | 0.73 | 6.51E-02 | 1 | 19 |
| LGN39 | 0.78 | 6.87E-02 | 1 | 18 | LGN39 | 0.87 | 1.06E-02 | 1 | 2 |
| LGN39 | 0.88 | 9.78E-03 | 1 | 1 | LGN39 | 0.84 | 3.85E-02 | 6 | 19 |
| LGN39 | 0.78 | 6.56E-02 | 6 | 18 | LGN39 | 0.75 | 8.58E-02 | 6 | 2 |
| LGN39 | 0.73 | 9.65E-02 | 6 | 1 | LGN39 | 0.76 | 8.15E-02 | 6 | 15 |
| LGN39 | 0.73 | 4.04E-02 | 8 | 4 | LGN39 | 0.77 | 2.63E-02 | 7 | 11 |
| LGN39 | 0.87 | 5.35E-03 | 2 | 10 | LGN39 | 0.83 | 1.16E-02 | 2 | 16 |
| LGN39 | 0.86 | 5.63E-03 | 2 | 5 | LGN39 | 0.73 | 3.89E-02 | 2 | 6 |
| LGN39 | 0.83 | 1.16E-02 | 2 | 12 | LGN39 | 0.83 | 2.01E-02 | 4 | 5 |
| LGN39 | 0.70 | 7.99E-02 | 4 | 19 | LGN49 | 0.81 | 2.66E-02 | 1 | 17 |
| LGN49 | 0.77 | 4.42E-02 | 1 | 10 | LGN49 | 0.71 | 7.31E-02 | 1 | 16 |
| LGN49 | 0.80 | 3.26E-02 | 1 | 4 | LGN49 | 0.89 | 7.61E-03 | 1 | 3 |
| LGN49 | 0.95 | 1.20E-03 | 1 | 5 | LGN49 | 0.81 | 2.66E-02 | 1 | 13 |
| LGN49 | 0.75 | 5.30E-02 | 1 | 19 | LGN49 | 0.92 | 3.41E-03 | 1 | 6 |
| LGN49 | 0.87 | 1.07E-02 | 1 | 14 | LGN49 | 0.71 | 7.31E-02 | 1 | 12 |
| LGN49 | 0.81 | 2.81E-02 | 1 | 1 | LGN49 | 0.81 | 2.66E-02 | 1 | 20 |
| LGN49 | 0.82 | 2.44E-02 | 1 | 15 | LGN49 | 0.88 | 6.75E-04 | 3 | 10 |
| LGN49 | 0.75 | 1.23E-02 | 3 | 16 | LGN49 | 0.75 | 1.23E-02 | 3 | 12 |
| LGN49 | 0.91 | 1.95E-03 | 7 | 11 | LGN49 | 0.84 | 1.94E-02 | 4 | 11 |
| LGN61 | 0.79 | 3.41E-02 | 1 | 4 | LGN61 | 0.70 | 7.75E-02 | 1 | 6 |
| LGN61 | 0.77 | 2.47E-02 | 2 | 16 | LGN61 | 0.70 | 5.12E-02 | 2 | 4 |
| LGN61 | 0.79 | 2.00E-02 | 2 | 5 | LGN61 | 0.77 | 2.47E-02 | 2 | 12 |

Table 119. Correlations (R) between the genes expression levels in various tissues and the phenotypic performance under low nitrogen conditions. "Corr. ID" = correlation set ID according to the correlated parameters Table 113 above. "Exp. Set" = Expression set (According to Table 111). "R" = Pearson correlation coefficient; "P" = p value.

TABLE 120

Correlation between the expression level of selected genes of some embodiments of the invention in various tissues and the phenotypic performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LBY103 | 0.75 | 3.25E-02 | 2 | 12 | LBY103 | 0.88 | 3.76E-03 | 2 | 4 |
| LBY104 | 0.86 | 1.35E-02 | 1 | 7 | LBY104 | 0.77 | 4.18E-02 | 1 | 12 |
| LBY104 | 0.71 | 7.30E-02 | 1 | 11 | LBY104 | 0.73 | 6.09E-02 | 1 | 5 |
| LBY104 | 0.80 | 3.01E-02 | 1 | 14 | LBY104 | 0.76 | 4.77E-02 | 1 | 13 |
| LBY104 | 0.78 | 3.95E-02 | 1 | 15 | LBY104 | 0.90 | 5.25E-03 | 1 | 10 |
| LBY104 | 0.90 | 5.22E-03 | 1 | 6 | LBY104 | 0.76 | 4.77E-02 | 1 | 17 |
| LBY104 | 0.76 | 4.77E-02 | 1 | 20 | LBY104 | 0.79 | 3.53E-02 | 1 | 9 |
| LBY104 | 0.82 | 2.51E-02 | 1 | 19 | LBY104 | 0.80 | 5.74E-02 | 5 | 11 |
| LBY104 | 0.80 | 5.36E-02 | 5 | 6 | LBY104 | 0.93 | 7.49E-03 | 5 | 8 |
| LBY104 | 0.72 | 4.61E-02 | 2 | 13 | LBY104 | 0.72 | 4.61E-02 | 2 | 17 |
| LBY104 | 0.72 | 4.61E-02 | 2 | 20 | LBY104 | 0.71 | 4.78E-02 | 2 | 19 |
| LBY104 | 0.85 | 3.11E-02 | 4 | 18 | LBY104 | 0.81 | 1.52E-02 | 3 | 5 |

TABLE 120-continued

Correlation between the expression level of selected genes of some embodiments of the invention in various tissues and the phenotypic performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LBY104 | 0.74 | 9.02E−02 | 6 | 18 | LBY105 | 0.75 | 5.16E−02 | 1 | 11 |
| LBY105 | 0.73 | 6.14E−02 | 1 | 5 | LBY105 | 0.80 | 3.00E−02 | 1 | 8 |
| LBY105 | 0.71 | 7.13E−02 | 1 | 9 | LBY105 | 0.95 | 4.44E−03 | 5 | 5 |
| LBY105 | 0.86 | 5.88E−03 | 2 | 5 | LBY105 | 0.71 | 4.69E−02 | 3 | 7 |
| LBY105 | 0.84 | 1.88E−02 | 6 | 7 | LBY105 | 0.71 | 7.13E−02 | 6 | 12 |
| LBY105 | 0.77 | 4.35E−02 | 6 | 5 | LBY105 | 0.75 | 5.00E−02 | 6 | 14 |
| LBY105 | 0.71 | 7.46E−02 | 6 | 13 | LBY105 | 0.77 | 4.48E−02 | 6 | 15 |
| LBY105 | 0.86 | 1.39E−02 | 6 | 6 | LBY105 | 0.71 | 7.46E−02 | 6 | 17 |
| LBY105 | 0.71 | 7.46E−02 | 6 | 20 | LBY105 | 0.74 | 5.63E−02 | 6 | 19 |
| LBY105 | 0.70 | 3.50E−02 | 7 | 7 | LBY105 | 0.80 | 9.87E−03 | 7 | 12 |
| LBY105 | 0.72 | 2.83E−02 | 7 | 5 | LBY105 | 0.81 | 8.79E−03 | 7 | 14 |
| LBY105 | 0.75 | 2.05E−02 | 7 | 13 | LBY105 | 0.87 | 2.08E−03 | 7 | 15 |
| LBY105 | 0.72 | 2.72E−02 | 7 | 6 | LBY105 | 0.75 | 2.05E−02 | 7 | 17 |
| LBY105 | 0.75 | 2.05E−02 | 7 | 20 | LBY105 | 0.72 | 2.78E−02 | 7 | 19 |
| LBY105 | 0.79 | 1.06E−02 | 7 | 2 | LBY106 | 0.86 | 2.92E−02 | 5 | 5 |
| LBY106 | 0.72 | 1.07E−01 | 4 | 18 | LBY107 | 0.88 | 1.98E−02 | 1 | 18 |
| LBY107 | 0.86 | 2.81E−02 | 5 | 10 | LBY107 | 0.92 | 8.90E−03 | 5 | 9 |
| LBY107 | 0.72 | 1.99E−02 | 8 | 12 | LBY107 | 0.75 | 1.23E−02 | 8 | 14 |
| LBY107 | 0.76 | 1.11E−02 | 8 | 13 | LBY107 | 0.76 | 1.11E−02 | 8 | 17 |
| LBY107 | 0.76 | 1.11E−02 | 8 | 20 | LBY107 | 0.75 | 1.25E−02 | 8 | 19 |
| LBY107 | 0.94 | 1.42E−03 | 4 | 10 | LBY107 | 0.72 | 4.29E−02 | 3 | 10 |
| LBY107 | 0.71 | 7.42E−02 | 6 | 7 | LBY107 | 0.77 | 4.20E−02 | 6 | 4 |
| LBY107 | 0.81 | 2.80E−02 | 6 | 10 | LBY107 | 0.75 | 5.42E−02 | 6 | 6 |
| LBY107 | 0.74 | 5.66E−02 | 6 | 8 | LBY107 | 0.71 | 7.22E−02 | 6 | 19 |
| LBY108 | 0.85 | 3.24E−02 | 5 | 5 | LBY108 | 0.92 | 1.42E−03 | 2 | 16 |
| LBY108 | 0.92 | 1.42E−03 | 2 | 1 | LBY109 | 0.85 | 3.02E−02 | 5 | 8 |
| LBY109 | 0.72 | 4.52E−02 | 2 | 11 | LBY110 | 0.78 | 6.65E−02 | 5 | 10 |
| LBY110 | 0.71 | 4.64E−02 | 2 | 12 | LBY110 | 0.93 | 8.42E−04 | 2 | 4 |
| LBY110 | 0.78 | 3.86E−02 | 4 | 12 | LBY110 | 0.75 | 5.19E−02 | 4 | 16 |
| LBY110 | 0.85 | 1.62E−02 | 4 | 11 | LBY110 | 0.75 | 5.06E−02 | 4 | 14 |
| LBY110 | 0.80 | 3.23E−02 | 4 | 13 | LBY110 | 0.78 | 3.75E−02 | 4 | 4 |
| LBY110 | 0.76 | 4.88E−02 | 4 | 15 | LBY110 | 0.80 | 3.23E−02 | 4 | 17 |
| LBY110 | 0.77 | 4.13E−02 | 4 | 8 | LBY110 | 0.80 | 3.23E−02 | 4 | 20 |
| LBY110 | 0.75 | 5.19E−02 | 4 | 1 | LBY110 | 0.73 | 6.05E−02 | 4 | 9 |
| LBY110 | 0.89 | 1.79E−02 | 4 | 18 | LBY110 | 0.74 | 5.65E−02 | 4 | 19 |
| LBY110 | 0.78 | 1.38E−02 | 7 | 10 | LBY111 | 0.86 | 2.79E−02 | 5 | 16 |
| LBY111 | 0.86 | 2.79E−02 | 5 | 1 | LBY111 | 0.90 | 1.32E−02 | 5 | 9 |
| LBY111 | 0.74 | 5.85E−02 | 4 | 2 | LBY112 | 0.76 | 4.86E−02 | 1 | 5 |
| LBY112 | 0.73 | 6.41E−02 | 1 | 4 | LBY112 | 0.87 | 1.08E−02 | 1 | 10 |
| LBY112 | 0.71 | 7.51E−02 | 1 | 6 | LBY112 | 0.78 | 3.70E−02 | 1 | 9 |
| LBY112 | 0.73 | 6.40E−02 | 1 | 19 | LBY112 | 0.74 | 9.50E−02 | 5 | 11 |
| LBY112 | 0.83 | 4.09E−02 | 5 | 8 | LBY112 | 0.72 | 4.34E−02 | 2 | 5 |
| LBY112 | 0.78 | 3.91E−02 | 6 | 12 | LBY112 | 0.77 | 4.31E−02 | 6 | 11 |
| LBY112 | 0.80 | 3.20E−02 | 6 | 14 | LBY112 | 0.79 | 3.46E−02 | 6 | 13 |
| LBY112 | 0.71 | 7.54E−02 | 6 | 4 | LBY112 | 0.75 | 5.11E−02 | 6 | 15 |
| LBY112 | 0.79 | 3.46E−02 | 6 | 17 | LBY112 | 0.85 | 1.59E−02 | 6 | 8 |
| LBY112 | 0.79 | 3.46E−02 | 6 | 20 | LBY112 | 0.78 | 3.83E−02 | 6 | 19 |
| LBY113 | 0.85 | 1.51E−02 | 1 | 10 | LBY113 | 0.83 | 4.24E−02 | 5 | 11 |
| LBY113 | 0.95 | 3.52E−03 | 5 | 8 | LBY113 | 0.81 | 1.48E−02 | 2 | 12 |
| LBY113 | 0.92 | 1.08E−03 | 2 | 4 | LBY113 | 0.72 | 4.45E−02 | 2 | 8 |
| LBY114 | 0.91 | 1.16E−02 | 5 | 5 | LBY114 | 0.83 | 1.15E−02 | 2 | 16 |
| LBY114 | 0.83 | 1.15E−02 | 2 | 1 | LBY114 | 0.72 | 6.98E−02 | 6 | 6 |
| LBY115 | 0.91 | 1.29E−02 | 5 | 5 | LBY115 | 0.71 | 4.64E−02 | 2 | 5 |
| LBY116 | 0.93 | 7.12E−03 | 5 | 8 | LBY116 | 0.75 | 3.34E−02 | 3 | 11 |
| LBY116 | 0.82 | 2.24E−02 | 6 | 2 | LBY117 | 0.86 | 1.34E−02 | 1 | 10 |
| LBY117 | 0.80 | 5.39E−02 | 5 | 5 | LBY117 | 0.86 | 2.87E−02 | 5 | 6 |
| LBY117 | 0.79 | 6.30E−02 | 5 | 8 | LBY117 | 0.75 | 3.07E−02 | 2 | 16 |
| LBY117 | 0.75 | 3.07E−02 | 2 | 1 | LBY117 | 0.71 | 4.98E−02 | 2 | 9 |
| LBY118 | 0.72 | 7.00E−02 | 1 | 6 | LBY118 | 0.70 | 1.18E−01 | 5 | 8 |
| LBY118 | 0.72 | 4.54E−02 | 2 | 4 | LBY119 | 0.73 | 6.00E−02 | 1 | 7 |
| LBY119 | 0.76 | 4.66E−02 | 1 | 12 | LBY119 | 0.77 | 4.14E−02 | 1 | 14 |
| LBY119 | 0.76 | 4.94E−02 | 1 | 13 | LBY119 | 0.78 | 4.01E−02 | 1 | 4 |
| LBY119 | 0.73 | 6.08E−02 | 1 | 15 | LBY119 | 0.93 | 2.78E−03 | 1 | 10 |
| LBY119 | 0.79 | 3.44E−02 | 1 | 6 | LBY119 | 0.76 | 4.94E−02 | 1 | 17 |
| LBY119 | 0.76 | 4.94E−02 | 1 | 20 | LBY119 | 0.72 | 6.77E−02 | 1 | 9 |
| LBY119 | 0.80 | 3.17E−02 | 1 | 19 | LBY119 | 0.73 | 9.89E−02 | 5 | 11 |
| LBY119 | 0.83 | 4.24E−02 | 5 | 8 | LBY121 | 0.80 | 2.99E−02 | 1 | 7 |
| LBY121 | 0.86 | 1.28E−02 | 1 | 12 | LBY121 | 0.89 | 7.02E−03 | 1 | 11 |
| LBY121 | 0.71 | 7.45E−02 | 1 | 5 | LBY121 | 0.85 | 1.66E−02 | 1 | 14 |
| LBY121 | 0.86 | 1.39E−02 | 1 | 13 | LBY121 | 0.87 | 1.14E−02 | 1 | 15 |
| LBY121 | 0.78 | 3.74E−02 | 1 | 10 | LBY121 | 0.84 | 1.67E−02 | 1 | 6 |
| LBY121 | 0.86 | 1.39E−02 | 1 | 17 | LBY121 | 0.86 | 1.38E−02 | 1 | 8 |
| LBY121 | 0.86 | 1.39E−02 | 1 | 20 | LBY121 | 0.73 | 9.72E−02 | 1 | 18 |

TABLE 120-continued

Correlation between the expression level of selected genes of some embodiments of the invention in various tissues and the phenotypic performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LBY121 | 0.81 | 2.66E-02 | 1 | 19 | LBY121 | 0.76 | 7.70E-02 | 5 | 16 |
| LBY121 | 0.71 | 1.15E-01 | 5 | 8 | LBY121 | 0.76 | 7.70E-02 | 5 | 1 |
| LBY121 | 0.97 | 1.37E-03 | 5 | 9 | LBY121 | 0.91 | 1.69E-03 | 2 | 4 |
| LBY121 | 0.82 | 2.53E-02 | 4 | 7 | LBY121 | 0.74 | 5.68E-02 | 4 | 12 |
| LBY121 | 0.73 | 6.20E-02 | 4 | 14 | LBY121 | 0.71 | 7.30E-02 | 4 | 13 |
| LBY121 | 0.76 | 4.68E-02 | 4 | 15 | LBY121 | 0.77 | 4.09E-02 | 4 | 6 |
| LBY121 | 0.71 | 7.30E-02 | 4 | 17 | LBY121 | 0.71 | 7.30E-02 | 4 | 20 |
| LBY121 | 0.73 | 6.27E-02 | 4 | 19 | LBY122 | 0.71 | 1.10E-01 | 5 | 5 |
| LBY123 | 0.73 | 6.37E-02 | 1 | 7 | LBY123 | 0.71 | 7.26E-02 | 1 | 12 |
| LBY123 | 0.80 | 3.01E-02 | 1 | 5 | LBY123 | 0.73 | 6.44E-02 | 1 | 14 |
| LBY123 | 0.73 | 6.01E-02 | 1 | 13 | LBY123 | 0.74 | 5.82E-02 | 1 | 15 |
| LBY123 | 0.73 | 6.34E-02 | 1 | 3 | LBY123 | 0.73 | 6.01E-02 | 1 | 17 |
| LBY123 | 0.77 | 4.40E-02 | 1 | 8 | LBY123 | 0.73 | 6.01E-02 | 1 | 20 |
| LBY123 | 0.72 | 6.63E-02 | 1 | 19 | LBY123 | 0.75 | 3.09E-02 | 2 | 11 |
| LBY123 | 0.85 | 7.42E-03 | 2 | 4 | LBY123 | 0.75 | 3.14E-02 | 2 | 8 |
| LBY123 | 0.99 | 6.95E-09 | 8 | 16 | LBY123 | 0.99 | 6.95E-09 | 8 | 1 |
| LBY123 | 0.72 | 3.03E-02 | 8 | 18 | LBY123 | 0.90 | 5.18E-03 | 6 | 8 |
| LBY123 | 0.81 | 7.80E-03 | 7 | 7 | LBY123 | 0.73 | 2.45E-02 | 7 | 6 |
| LBY123 | 0.71 | 3.19E-02 | 7 | 19 | LBY13 | 0.75 | 8.76E-02 | 5 | 4 |
| LBY13 | 0.72 | 4.33E-02 | 2 | 12 | LBY13 | 0.80 | 1.67E-02 | 2 | 4 |
| LBY13 | 0.71 | 4.95E-02 | 2 | 15 | LBY13 | 0.76 | 3.03E-02 | 2 | 18 |
| LBY233 | 0.78 | 6.46E-02 | 5 | 5 | LBY5 | 0.75 | 5.37E-02 | 4 | 5 |
| LBY6 | 0.71 | 7.39E-02 | 1 | 11 | LBY6 | 0.71 | 7.28E-02 | 1 | 8 |
| LBY6 | 0.81 | 1.49E-02 | 2 | 5 | LBY6 | 0.95 | 9.24E-04 | 4 | 16 |
| LBY6 | 0.95 | 9.24E-04 | 4 | 1 | LBY6 | 0.83 | 4.31E-02 | 4 | 18 |
| LBY6 | 0.89 | 6.72E-03 | 6 | 16 | LBY6 | 0.89 | 6.72E-03 | 6 | 1 |
| LBY6 | 0.85 | 3.03E-02 | 6 | 18 | LGN17 | 0.71 | 2.02E-02 | 8 | 3 |
| LGN17 | 0.74 | 1.35E-02 | 8 | 2 | LGN17 | 0.75 | 3.12E-02 | 3 | 16 |
| LGN17 | 0.75 | 3.12E-02 | 3 | 1 | LGN17 | 0.73 | 6.02E-02 | 6 | 7 |
| LGN17 | 0.70 | 7.71E-02 | 6 | 3 | LGN17 | 0.74 | 5.73E-02 | 6 | 6 |
| LGN20 | 0.70 | 1.19E-01 | 5 | 12 | LGN20 | 0.71 | 1.17E-01 | 5 | 13 |
| LGN20 | 0.83 | 3.97E-02 | 5 | 4 | LGN20 | 0.71 | 1.17E-01 | 5 | 17 |
| LGN20 | 0.71 | 1.17E-01 | 5 | 20 | LGN20 | 0.81 | 5.18E-02 | 5 | 19 |
| LGN20 | 0.81 | 1.48E-02 | 2 | 16 | LGN20 | 0.70 | 5.09E-02 | 2 | 10 |
| LGN20 | 0.81 | 1.48E-02 | 2 | 1 | LGN20 | 0.73 | 4.01E-02 | 2 | 9 |
| LGN20 | 0.73 | 6.45E-02 | 4 | 6 | LGN20 | 0.76 | 2.94E-02 | 3 | 2 |
| LGN20 | 0.84 | 1.85E-02 | 6 | 3 | LGN20 | 0.79 | 6.32E-02 | 6 | 18 |
| LGN20 | 0.79 | 3.44E-02 | 6 | 2 | LGN20 | 0.79 | 1.07E-02 | 7 | 12 |
| LGN20 | 0.76 | 1.66E-02 | 7 | 14 | LGN20 | 0.71 | 3.15E-02 | 7 | 13 |
| LGN20 | 0.79 | 1.10E-02 | 7 | 4 | LGN20 | 0.81 | 7.58E-03 | 7 | 15 |
| LGN20 | 0.72 | 2.79E-02 | 7 | 6 | LGN20 | 0.71 | 3.15E-02 | 7 | 17 |
| LGN20 | 0.71 | 3.15E-02 | 7 | 20 | LGN23 | 0.76 | 7.90E-02 | 1 | 18 |
| LGN23 | 0.70 | 7.80E-02 | 1 | 2 | LGN23 | 0.95 | 4.30E-03 | 5 | 5 |
| LGN24 | 0.77 | 7.61E-02 | 4 | 18 | LGN26 | 0.87 | 5.49E-03 | 2 | 12 |
| LGN26 | 0.79 | 1.99E-02 | 2 | 14 | LGN26 | 0.78 | 2.28E-02 | 2 | 13 |
| LGN26 | 0.90 | 2.39E-03 | 2 | 4 | LGN26 | 0.78 | 2.33E-02 | 2 | 15 |
| LGN26 | 0.70 | 5.20E-02 | 2 | 6 | LGN26 | 0.78 | 2.28E-02 | 2 | 17 |
| LGN26 | 0.83 | 1.00E-02 | 2 | 8 | LGN26 | 0.78 | 2.28E-02 | 2 | 20 |
| LGN26 | 0.76 | 2.73E-02 | 2 | 18 | LGN26 | 0.86 | 1.21E-02 | 6 | 16 |
| LGN26 | 0.86 | 1.21E-02 | 6 | 1 | LGN26 | 0.80 | 5.36E-02 | 6 | 18 |
| LGN33 | 0.83 | 1.06E-02 | 2 | 10 | LGN33 | 0.72 | 6.57E-02 | 4 | 8 |
| LGN34 | 0.93 | 2.19E-03 | 1 | 7 | LGN34 | 0.93 | 2.40E-03 | 1 | 12 |
| LGN34 | 0.87 | 1.19E-02 | 1 | 11 | LGN34 | 0.93 | 2.53E-03 | 1 | 5 |
| LGN34 | 0.95 | 1.28E-03 | 1 | 14 | LGN34 | 0.94 | 1.59E-03 | 1 | 13 |
| LGN34 | 0.93 | 2.60E-03 | 1 | 4 | LGN34 | 0.94 | 1.80E-03 | 1 | 15 |
| LGN34 | 0.87 | 1.11E-02 | 1 | 10 | LGN34 | 0.90 | 5.48E-03 | 1 | 6 |
| LGN34 | 0.94 | 1.59E-03 | 1 | 17 | LGN34 | 0.78 | 4.07E-02 | 1 | 8 |
| LGN34 | 0.94 | 1.59E-03 | 1 | 20 | LGN34 | 0.90 | 5.43E-03 | 1 | 9 |
| LGN34 | 0.96 | 7.23E-04 | 1 | 19 | LGN34 | 0.72 | 4.41E-02 | 2 | 12 |
| LGN34 | 0.97 | 5.99E-05 | 2 | 4 | LGN34 | 0.93 | 2.18E-03 | 4 | 16 |
| LGN34 | 0.93 | 2.18E-03 | 4 | 1 | LGN34 | 0.76 | 7.81E-02 | 4 | 18 |
| LGN34 | 0.75 | 3.27E-02 | 3 | 11 | LGN34 | 0.79 | 1.88E-02 | 3 | 10 |
| LGN34 | 0.92 | 3.33E-03 | 6 | 7 | LGN34 | 0.92 | 3.51E-03 | 6 | 12 |
| LGN34 | 0.83 | 2.22E-02 | 6 | 11 | LGN34 | 0.82 | 2.33E-02 | 6 | 5 |
| LGN34 | 0.93 | 2.12E-03 | 6 | 14 | LGN34 | 0.92 | 3.53E-03 | 6 | 13 |
| LGN34 | 0.86 | 1.40E-02 | 6 | 4 | LGN34 | 0.91 | 4.76E-03 | 6 | 15 |
| LGN34 | 0.84 | 1.71E-02 | 6 | 10 | LGN34 | 0.92 | 3.31E-03 | 6 | 6 |
| LGN34 | 0.92 | 3.53E-03 | 6 | 17 | LGN34 | 0.80 | 3.26E-02 | 6 | 8 |
| LGN34 | 0.92 | 3.53E-03 | 6 | 20 | LGN34 | 0.78 | 3.69E-02 | 6 | 9 |
| LGN34 | 0.95 | 1.07E-03 | 6 | 19 | LGN34 | 0.82 | 6.64E-03 | 7 | 7 |
| LGN34 | 0.89 | 1.15E-03 | 7 | 12 | LGN34 | 0.84 | 4.23E-03 | 7 | 11 |
| LGN34 | 0.75 | 1.87E-02 | 7 | 5 | LGN34 | 0.89 | 1.31E-03 | 7 | 14 |
| LGN34 | 0.90 | 1.00E-03 | 7 | 13 | LGN34 | 0.82 | 6.32E-03 | 7 | 4 |

TABLE 120-continued

Correlation between the expression level of selected genes of some embodiments of the invention in various tissues and the phenotypic performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LGN34 | 0.86 | 3.21E−03 | 7 | 15 | LGN34 | 0.80 | 9.97E−03 | 7 | 10 |
| LGN34 | 0.75 | 2.00E−02 | 7 | 6 | LGN34 | 0.90 | 1.00E−03 | 7 | 17 |
| LGN34 | 0.90 | 1.00E−03 | 7 | 20 | LGN34 | 0.73 | 2.62E−02 | 7 | 9 |
| LGN34 | 0.93 | 2.40E−04 | 7 | 19 | LGN35 | 0.81 | 5.27E−02 | 1 | 18 |
| LGN35 | 0.97 | 1.69E−03 | 5 | 5 | LGN35 | 0.94 | 5.78E−04 | 7 | 18 |
| LGN35 | 0.83 | 6.16E−03 | 7 | 2 | LGN36 | 0.72 | 2.00E−02 | 8 | 16 |
| LGN36 | 0.72 | 2.00E−02 | 8 | 1 | LGN39 | 0.84 | 1.69E−02 | 1 | 3 |
| LGN39 | 0.76 | 7.95E−02 | 1 | 18 | LGN39 | 0.78 | 6.69E−02 | 5 | 10 |
| LGN39 | 0.72 | 4.50E−02 | 2 | 12 | LGN39 | 0.80 | 1.82E−02 | 2 | 4 |
| LGN39 | 0.79 | 2.04E−02 | 2 | 6 | LGN39 | 0.73 | 3.82E−02 | 2 | 2 |
| LGN39 | 0.78 | 3.73E−02 | 4 | 7 | LGN39 | 0.71 | 7.21E−02 | 4 | 12 |
| LGN39 | 0.74 | 5.61E−02 | 4 | 14 | LGN39 | 0.71 | 7.67E−02 | 4 | 15 |
| LGN39 | 0.76 | 4.64E−02 | 4 | 10 | LGN39 | 0.84 | 1.68E−02 | 4 | 6 |
| LGN39 | 0.76 | 4.88E−02 | 4 | 19 | LGN39 | 0.72 | 4.28E−02 | 3 | 2 |
| LGN39 | 0.74 | 5.69E−02 | 6 | 7 | LGN39 | 0.75 | 5.24E−02 | 6 | 12 |
| LGN39 | 0.93 | 2.44E−03 | 6 | 16 | LGN39 | 0.72 | 7.03E−02 | 6 | 5 |
| LGN39 | 0.77 | 4.43E−02 | 6 | 14 | LGN39 | 0.78 | 3.97E−02 | 6 | 13 |
| LGN39 | 0.87 | 1.08E−02 | 6 | 4 | LGN39 | 0.72 | 7.06E−02 | 6 | 15 |
| LGN39 | 0.92 | 3.65E−03 | 6 | 10 | LGN39 | 0.78 | 3.97E−02 | 6 | 17 |
| LGN39 | 0.78 | 3.97E−02 | 6 | 20 | LGN39 | 0.93 | 2.44E−03 | 6 | 1 |
| LGN39 | 0.73 | 6.20E−02 | 6 | 9 | LGN39 | 0.76 | 8.17E−02 | 6 | 18 |
| LGN39 | 0.80 | 3.04E−02 | 6 | 19 | LGN39 | 0.71 | 4.78E−02 | 7 | 18 |
| LGN49 | 0.76 | 7.74E−02 | 5 | 11 | LGN49 | 0.74 | 9.43E−02 | 5 | 4 |
| LGN49 | 0.74 | 9.55E−02 | 5 | 8 | LGN49 | 0.75 | 3.05E−02 | 2 | 12 |
| LGN49 | 0.72 | 4.59E−02 | 2 | 14 | LGN49 | 0.91 | 1.95E−03 | 2 | 4 |
| LGN49 | 0.73 | 4.12E−02 | 2 | 15 | LGN49 | 0.83 | 2.00E−02 | 6 | 5 |

Table 120. Correlations (R) between the genes expression levels in various tissues and the phenotypic performance under normal conditions; "Corr. ID" = correlation set ID according to the correlated parameters described in Table 114 above. "Exp. Set" = Expression set as described in Table 112 above. "R" = Pearson correlation coefficient; "P" = p value.

Example 14

Production of Brachypodium Transcriptome and High Throughput Correlation Analysis Using 60K Brachypodium Oligonucleotide Micro-Array In order to produce a high throughput correlation analysis comparing between plant phenotype and gene expression level, the present inventors utilized a brachypodium oligonucleotide micro-array, produced by Agilent Technologies [chem. (dot) agilent (dot) com/Scripts/PDS (dot) asp?1Page=50879]. The array oligonucleotide represents about 60K brachypodium genes and transcripts. In order to define correlations between the levels of RNA expression and yield or vigor related parameters, various plant characteristics of 24 different brachypodium accessions were analyzed. Among them, 22 accessions encompassing the observed variance were selected for RNA expression analysis and comparative genomic hybridization (CGH) analysis.

The correlation between the RNA levels and the characterized parameters was analyzed using Pearson correlation test [davidmlane (dot) com/hyperstat/A34739 (dot) html].

Additional correlation analysis was done by comparing plant phenotype and gene copy number. The correlation between the normalized copy number hybridization signal and the characterized parameters was analyzed using Pearson correlation test [davidmlane (dot) com/hyperstat/A34739 (dot) html].

Experimental Procedures

Analyzed Brachypodium tissues—two tissues [leaf and spike] were sampled and RNA was extracted as described above. Each micro-array expression information tissue type has received a Set ID as summarized in Table 121 below.

TABLE 121

Brachypodium transcriptome expression sets

| Expression Set | Set ID |
|---|---|
| Leaf at flowering stage under normal growth conditions | 1 |
| Spike at flowering stage under normal growth conditions | 2 |

Table 121. Provided are the brachypodium transcriptome expression sets under normal conditions.

Brachypodium Yield Components and Vigor Related Parameters Assessment—

24 brachypodium accessions were grown in 4-6 repetitive plots (8 plants per plot) in a green house. The growing protocol was as follows: brachypodium seeds were sown in plots and grown under normal condition (6 mM of Nitrogen as ammonium nitrate). Plants were continuously phenotyped during the growth period and at harvest (Table 123-124, below). The image analysis system include d a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

At the end of the growing period the grains were separated from the spikes and the following parameters were measured using digital imaging system and collected:

Number of tillering—all tillers were counted per plant at harvest (mean per plot).

Head number—At the end of the experiment, heads were harvested from each plot and were counted.

Total Grains weight per plot (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Highest number of spikelets—The highest spikelet number per head was calculated per plant (mean per plot).

Mean number of spikelets—The mean spikelet number per head was calculated per plot.

Plant height—Each of the plants was measured for its height using measuring tape. Height was measured from ground level to spike base of the longest spike at harvest.

Vegetative dry weight and spike yield—At the end of the experiment (50% of the spikes were dry) all spikes and vegetative material from plots were collected. The biomass and spikes weight of each plot was separated, measured and divided by the number of plants/plots.

Dry weight—total weight of the vegetative portion above ground (excluding roots) after drying at 70° C. in oven for 48 hours;

Spike yield per plant=total spike weight per plant (gr) after drying at 30° C. in oven for 48 hours.

Spikelets weight (gr.)—The biomass and spikes weight of each plot was separated and measured per plot.

Average head weight—calculated by dividing spikelets weight with head number (gr.).

Harvest Index—The harvest index was calculated using Formula XV (described above).

Spikelets Index—The Spikelets index is calculated using Formula XXXI above.

Percent Number of heads with spikelets—The number of heads with more than one spikelet per plant were counted and the percent from all heads per plant was calculated.

Total dry mater per plot—Calculated as Vegetative portion above ground plus all the spikelet dry weight per plot.

1000 grain weight—At the end of the experiment all grains from all plots were collected and weighted and the weight of 1000 grains was calculated.

The following parameters were collected using digital imaging system:

At the end of the growing period the grains were separated from the spikes and the following parameters were measured and collected:

(i) Average Grain Area ($cm^2$)—A sample of ~200 grains was weighted, photographed and images were processed using the below described image processing system. The grain area was measured from those images and was divided by the number of grains.

(ii) Average Grain Length, perimeter and width (cm)—A sample of ~200 grains was weighted, photographed and images were processed using the below described image processing system. The sum of grain lengths and width (longest axis) was measured from those images and was divided by the number of grains.

The image processing system that was used consisted of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

TABLE 122

Brachypodium correlated parameters (vectors)

| Correlated parameter with | Correlation ID |
|---|---|
| 1000 grain weight [gr.] | 1 |
| Average head weight [gr.] | 2 |
| Grain Perimeter [mm] | 3 |
| Grain area [$mm^2$] | 4 |
| Grain length [mm] | 5 |
| Grain width [mm] | 6 |
| Grains weight per plant [gr.] | 7 |
| Grains weight per plot [gr.] | 8 |
| Harvest index | 9 |
| Heads per plant [number] | 10 |
| Heads per plot [number] | 11 |
| Highest number of spikelets per plot [number] | 12 |
| Mean number of spikelets per plot [number] | 13 |
| Num of heads with spikelets per plant [number] | 14 |
| Percent Number of heads with spikelets [%] | 15 |
| Plant Vegetative DW [gr] | 16 |
| Plant height [cm] | 17 |
| Plants number [number] | 18 |
| Spikelets DW per plant [gr] | 19 |
| Spikelets weight [gr] | 20 |
| Spikes index [gr] | 21 |
| Tillering [number] | 22 |
| Total dry mater per plant [gr] | 23 |
| Total dry mater per plot [gr] | 24 |
| Vegetative DW [gr] | 25 |

Table 122. Provided are the Brachypodium correlated parameters.

Experimental Results 24 different *Brachypodium* accessions were grown and characterized for different parameters as described above. The average for each of the measured parameter was calculated using the JMP software and values are summarized in Tables 123-125 below. Subsequent correlation analysis between the various transcriptome sets and the average parameters (Table 126) was conducted. Follow, results were integrated to the database.

TABLE 123

Measured parameters of correlation IDs in Brachypodium accessions under normal conditions

| Line/Corr. ID | 1 | 2 | 3 | 4 | 5 | 6 | 7 | 8 |
|---|---|---|---|---|---|---|---|---|
| Line-1 | 3.748 | 0.0569 | 1.672 | 0.1025 | 0.7330 | 0.1777 | 0.1399 | 1.051 |
| Line-2 | 3.775 | 0.0436 | 1.615 | 0.0955 | 0.7195 | 0.1679 | 0.0555 | 0.444 |
| Line-3 | 3.345 | 0.0495 | 1.624 | 0.0944 | 0.7170 | 0.1670 | 0.0768 | 0.614 |
| Line-4 | 4.885 | 0.0749 | 1.686 | 0.0945 | 0.7400 | 0.1619 | 0.2552 | 1.960 |

TABLE 123-continued

Measured parameters of correlation IDs in Brachypodium accessions under normal conditions

| Line/Corr. ID | 1 | 2 | 3 | 4 | 5 | 6 | 7 | 8 |
|---|---|---|---|---|---|---|---|---|
| Line-5 | 5.540 | 0.0402 | 1.820 | 0.1052 | 0.8329 | 0.1611 | 0.1403 | 1.110 |
| Line-6 | 4.983 | 0.0558 | 1.829 | 0.1115 | 0.8237 | 0.1722 | 0.1398 | 1.072 |
| Line-7 | 4.827 | 0.0475 | 1.745 | 0.1025 | 0.7813 | 0.1664 | 0.1383 | 1.089 |
| Line-8 | 5.535 | 0.0416 | 1.931 | 0.1095 | 0.8961 | 0.1554 | 0.1050 | 0.840 |
| Line-9 | 3.842 | 0.0780 | 1.683 | 0.1008 | 0.7476 | 0.1715 | 0.0767 | 0.498 |
| Line-10 | 4.761 | 0.0552 | 1.819 | 0.1114 | 0.7888 | 0.1801 | 0.0658 | 0.387 |
| Line-11 | 4.730 | 0.0478 | 1.690 | 0.0996 | 0.7481 | 0.1693 | 0.3927 | 3.070 |
| Line-12 | 5.239 | 0.0529 | 1.910 | 0.1244 | 0.8568 | 0.1850 | 0.1361 | 1.089 |
| Line-13 | 4.964 | 0.0574 | 1.706 | 0.1005 | 0.7437 | 0.1715 | 0.1257 | 1.066 |
| Line-14 | 4.004 | 0.1037 | 1.806 | 0.0963 | 0.8395 | 0.1457 | 0.3742 | 2.993 |
| Line-15 | 4.257 | 0.0789 | 1.755 | 0.0899 | 0.8018 | 0.1426 | 0.4937 | 3.522 |
| Line-16 | 5.991 | 0.0819 | 1.866 | 0.1173 | 0.8421 | 0.1772 | 0.3117 | 2.406 |
| Line-17 | 4.336 | 0.0638 | 1.664 | 0.0913 | 0.7357 | 0.1575 | 0.2027 | 1.468 |
| Line-18 | 3.700 | 0.0872 | 1.646 | 0.0884 | 0.7497 | 0.1494 | 0.3478 | 2.583 |
| Line-19 | 3.904 | 0.0404 | 1.602 | 0.0862 | 0.7240 | 0.1510 | 0.2688 | 2.035 |
| Line-20 | 4.823 | 0.0596 | 1.795 | 0.1047 | 0.7941 | 0.1682 | 0.3226 | 2.581 |
| Line-21 | 4.873 | 0.0867 | 1.903 | 0.1132 | 0.8712 | 0.1649 | 0.4361 | 3.403 |
| Line-22 | 3.758 | 0.0901 | 1.683 | 0.0916 | 0.7638 | 0.1515 | 0.3032 | 1.919 |

Table 123. Correlation IDs: 1, 2, 3, 4, 5, . . . etc. refer to those described in Table 122 above [Brachypodium correlated parameters (vectors)].

TABLE 124

Measured parameters of correlation IDs in brachypodium accessions under normal conditions

| Line/Corr. ID | 9 | 10 | 11 | 12 | 13 | 14 | 15 | 16 |
|---|---|---|---|---|---|---|---|---|
| Line-1 | 0.1308 | 16.29 | 121.75 | 3.000 | 2.103 | 5.272 | 27.61 | 0.4159 |
| Line-2 | 0.1401 | 7.08 | 56.60 | 2.600 | 2.100 | 2.500 | 35.33 | 0.1188 |
| Line-3 | 0.1483 | 6.59 | 52.75 | 3.000 | 1.719 | 2.063 | 21.67 | 0.1328 |
| Line-4 | 0.2049 | 11.63 | 83.40 | 2.200 | 1.692 | 2.083 | 14.00 | 0.3758 |
| Line-5 | 0.1991 | 10.48 | 82.40 | 2.000 | 1.382 | 0.707 | 5.42 | 0.3228 |
| Line-6 | 0.1576 | 9.09 | 70.13 | 2.250 | 1.645 | 1.940 | 15.42 | 0.3244 |
| Line-7 | 0.1355 | 14.13 | 110.33 | 1.833 | 1.426 | 1.080 | 6.40 | 0.3895 |
| Line-8 | 0.2552 | 5.88 | 47.00 | 2.000 | 1.250 | 0.350 | 4.51 | 0.1250 |
| Line-9 | 0.0668 | 11.89 | 81.50 | 3.500 | 2.411 | 7.594 | 55.41 | 0.4375 |
| Line-10 | 0.1063 | 8.02 | 48.60 | 2.000 | 1.563 | 1.868 | 16.51 | 0.3084 |
| Line-11 | 0.2163 | 23.75 | 185.50 | 2.500 | 1.763 | 4.982 | 15.52 | 0.8713 |
| Line-12 | 0.0888 | 16.06 | 125.00 | 2.400 | 1.825 | 3.700 | 20.34 | 0.6933 |
| Line-13 | 0.1753 | 9.74 | 80.75 | 2.000 | 1.424 | 0.889 | 8.11 | 0.3438 |
| Line-14 | 0.0934 | 22.19 | 177.50 | 3.500 | 2.708 | 12.583 | 53.21 | 1.7244 |
| Line-15 | 0.1577 | 24.32 | 172.80 | 3.800 | 2.607 | 12.130 | 47.81 | 1.3159 |
| Line-16 | 0.1806 | 13.25 | 98.60 | 2.800 | 2.121 | 6.350 | 42.81 | 0.4779 |
| Line-17 | 0.1118 | 19.22 | 143.17 | 2.833 | 2.155 | 7.146 | 34.92 | 0.6278 |
| Line-18 | 0.2108 | 16.11 | 123.50 | 2.833 | 2.174 | 9.440 | 52.40 | 0.8175 |
| Line-19 | 0.1714 | 21.40 | 156.83 | 2.333 | 1.850 | 5.016 | 20.84 | 0.6747 |
| Line-20 | 0.1492 | 25.88 | 207.00 | 2.600 | 1.925 | 4.900 | 17.55 | 0.8700 |
| Line-21 | 0.1807 | 17.05 | 135.00 | 4.500 | 2.854 | 7.719 | 47.73 | 1.0473 |
| Line-22 | 0.0879 | 25.54 | 177.00 | 3.167 | 2.790 | 15.355 | 59.01 | 1.7313 |

Table 124. Correlation IDs: 1, 2, 3, 4, 5, . . . etc. refer to those described in Table 122 above [Brachypodium correlated parameters (vectors)].

TABLE 125

Measured parameters of correlation IDs in brachypodium accessions under normal conditions

| Line/Corr. ID | 17 | 18 | 19 | 20 | 21 | 22 | 23 | 24 | 25 |
|---|---|---|---|---|---|---|---|---|---|
| Line-1 | 31.65 | 7.500 | 0.9605 | 7.180 | 0.7061 | 16.84 | 1.376 | 10.26 | 3.078 |
| Line-2 | 23.44 | 8.000 | 0.3123 | 2.498 | 0.7236 | 7.20 | 0.431 | 3.45 | 0.950 |
| Line-3 | 22.75 | 8.000 | 0.3344 | 2.675 | 0.7276 | 7.00 | 0.467 | 3.74 | 1.063 |
| Line-4 | 31.95 | 7.200 | 0.8758 | 6.424 | 0.7060 | 11.97 | 1.252 | 9.12 | 2.692 |
| Line-5 | 34.36 | 7.800 | 0.4372 | 3.452 | 0.5759 | 10.67 | 0.760 | 6.00 | 2.546 |

TABLE 125-continued

Measured parameters of correlation IDs in brachypodium accessions under normal conditions

| Line/Corr. ID | 17 | 18 | 19 | 20 | 21 | 22 | 23 | 24 | 25 |
|---|---|---|---|---|---|---|---|---|---|
| Line-6  | 28.65 | 7.750 | 0.5587 | 4.293  | 0.6573 | 9.38  | 0.883 | 6.78  | 2.483 |
| Line-7  | 28.88 | 7.833 | 0.6741 | 5.290  | 0.6359 | 14.58 | 1.064 | 8.34  | 3.053 |
| Line-8  | 24.74 | 8.000 | 0.2555 | 2.044  | 0.6577 | 6.35  | 0.381 | 3.04  | 1.000 |
| Line-9  | 31.40 | 6.500 | 0.9224 | 6.250  | 0.6869 | 12.38 | 1.360 | 9.21  | 2.960 |
| Line-10 | 29.15 | 6.400 | 0.4496 | 2.658  | 0.6046 | 8.60  | 0.758 | 4.47  | 1.814 |
| Line-11 | 37.30 | 7.750 | 1.1370 | 8.893  | 0.5896 | 25.50 | 2.008 | 15.79 | 6.893 |
| Line-12 | 45.09 | 8.000 | 0.8318 | 6.654  | 0.5429 | 16.56 | 1.525 | 12.20 | 5.546 |
| Line-13 | 22.39 | 8.250 | 0.5910 | 4.915  | 0.6776 | 10.53 | 0.935 | 7.76  | 2.843 |
| Line-14 | 55.04 | 8.000 | 2.2685 | 18.148 | 0.5628 | 27.15 | 3.993 | 31.94 | 13.795 |
| Line-15 | 45.34 | 7.000 | 1.9113 | 13.494 | 0.5931 | 26.30 | 3.227 | 22.78 | 9.284 |
| Line-16 | 40.20 | 7.600 | 1.0916 | 8.346  | 0.6981 | 13.56 | 1.570 | 12.04 | 3.696 |
| Line-17 | 39.18 | 7.333 | 1.2591 | 9.418  | 0.6623 | 20.79 | 1.887 | 14.14 | 4.718 |
| Line-18 | 45.35 | 7.500 | 1.4640 | 11.312 | 0.6829 | 16.99 | 2.282 | 17.78 | 6.468 |
| Line-19 | 29.41 | 7.333 | 0.9560 | 7.162  | 0.6004 | 23.61 | 1.631 | 12.29 | 5.130 |
| Line-20 | 38.39 | 8.000 | 1.5555 | 12.444 | 0.6465 | 27.20 | 2.426 | 19.40 | 6.960 |
| Line-21 | 46.74 | 7.875 | 1.4182 | 11.046 | 0.5749 | 18.25 | 2.466 | 19.27 | 8.228 |
| Line-22 | 58.82 | 6.833 | 2.2523 | 15.548 | 0.5686 | 29.09 | 3.984 | 27.67 | 12.117 |

Table 125. Correlation IDs: 1, 2, 3, 4, 5, . . . etc. refer to those described in Table 122 above [Brachypodium correlated parameters (vectors)].

TABLE 126

Correlation between the expression level of selected genes of some embodiments of the invention in various tissues and the phenotypic performance under normal conditions across brachypodium varieties

| Gene Name | R | P value | Exp. set | Corr. Set ID | Gene Name | R | P value | Exp. set | Corr. Set ID |
|---|---|---|---|---|---|---|---|---|---|
| LBY37 | 0.73 | 1.68E−02 | 2 | 7  | LBY37 | 0.71 | 2.26E−02 | 2 | 8  |
| LBY37 | 0.86 | 7.69E−04 | 1 | 11 | LBY37 | 0.88 | 3.85E−04 | 1 | 22 |
| LBY37 | 0.82 | 1.84E−03 | 1 | 24 | LBY37 | 0.85 | 9.14E−04 | 1 | 19 |
| LBY37 | 0.78 | 4.41E−03 | 1 | 12 | LBY37 | 0.82 | 2.06E−03 | 1 | 25 |
| LBY37 | 0.75 | 7.35E−03 | 1 | 15 | LBY37 | 0.85 | 9.29E−04 | 1 | 16 |
| LBY37 | 0.86 | 6.29E−04 | 1 | 14 | LBY37 | 0.82 | 2.22E−03 | 1 | 20 |
| LBY37 | 0.85 | 8.20E−04 | 1 | 13 | LBY37 | 0.74 | 9.92E−03 | 1 | 17 |
| LBY37 | 0.87 | 4.88E−04 | 1 | 10 | LBY37 | 0.86 | 7.61E−04 | 1 | 23 |

Table 126. Provided are the correlations (R) between the expression levels yield improving genes and their homologs in various tissues [Expression (Exp) sets, Table 121] and the phenotypic performance [yield, biomass, growth rate and/or vigor components as described in Tables 123-125 using the Correlation vectors (Con.) described in Table 122] under normal conditions across brachypodium varieties. P = p value.

Example 15

Production of Soybean (*Glycine Max*) Transcriptome and High Throughput Correlation Analysis with Yield Parameters Using 44K B. Soybean Oligonucleotide Micro-Arrays In order to produce a high throughput correlation analysis, the present inventors utilized a Soybean oligonucleotide micro-array, produced by Agilent Technologies [chem. (dot) agilent (dot) com/Scripts/PDS (dot) asp?1Page=50879]. The array oligonucleotide represents about 42,000 Soybean genes and transcripts. In order to define correlations between the levels of RNA expression with yield components or plant architecture related parameters or plant vigor related parameters, various plant characteristics of 29 different *Glycine max* varieties were analyzed and 26 varieties were further used for RNA expression analysis. The correlation between the RNA levels and the characterized parameters was analyzed using Pearson correlation test.

Correlation of *Glycine max* Genes' Expression Levels with Phenotypic Characteristics Across Ecotype Experimental Procedures 29 Soybean varieties were grown in three repetitive plots in field. Briefly, the growing protocol was as follows: Soybean seeds were sown in soil and grown under normal conditions (no irrigation, good organomic particles) which included high temperature about 82.38 (° F.), low temperature about 58.54 (° F.); total precipitation rainfall from May through September (from sowing until harvest) was about 16.97 inch.

In order to define correlations between the levels of RNA expression with yield components or plant architecture related parameters or vigor related parameters, 26 different Soybean varieties (out of 29 varieties) were analyzed and used for gene expression analyses. Analysis was performed at two pre-determined time periods: at pod set (when the soybean pods are formed) and at harvest time (when the soybean pods are ready for harvest, with mature seeds).

TABLE 127

Soybean transcriptome expression sets

| Expression Set | Set ID |
|---|---|
| Apical meristem at vegetative stage under normal growth condition | 1 |
| Leaf at vegetative stage under normal growth condition | 2 |
| Leaf at flowering stage under normal growth condition | 3 |
| Leaf at pod setting stage under normal growth condition | 4 |
| Root at vegetative stage under normal growth condition | 5 |
| Root at flowering stage under normal growth condition | 6 |
| Root at pod setting stage under normal growth condition | 7 |
| Stem at vegetative stage under normal growth condition | 8 |
| Stem at pod setting stage under normal growth condition | 9 |
| Flower bud at flowering stage under normal growth condition | 10 |
| Pod (R3-R4) at pod setting stage under normal growth condition | 11 |

Table 127.

RNA extraction—All 12 selected Soybean varieties were sample per treatment. Plant tissues [leaf, root, Stem, Pod, apical meristem, Flower buds] growing under normal conditions were sampled and RNA was extracted as described above. The collected data parameters were as follows:

Main branch base diameter [mm] at pod set—the diameter of the base of the main branch (based diameter) average of three plants per plot.

Fresh weight [gr./plant] at pod set]—total weight of the vegetative portion above ground (excluding roots) before drying at pod set, average of three plants per plot.

Dry weight [gr./plant] at pod set—total weight of the vegetative portion above ground (excluding roots) after drying at 70° C. in oven for 48 hours at pod set, average of three plants per plot.

Total number of nodes with pods on lateral branches [value/plant]—counting of nodes which contain pods in lateral branches at pod set, average of three plants per plot.

Number of lateral branches at pod set [value/plant]—counting number of lateral branches at pod set, average of three plants per plot.

Total weight of lateral branches at pod set [gr./plant]—weight of all lateral branches at pod set, average of three plants per plot.

Total weight of pods on main stem at pod set [gr./plant]—weight of all pods on main stem at pod set, average of three plants per plot.

Total number of nodes on main stem [value/plant]—count of number of nodes on main stem starting from first node above ground, average of three plants per plot.

Total number of pods with 1 seed on lateral branches at pod set [value/plant]—count of the number of pods containing 1 seed in all lateral branches at pod set, average of three plants per plot.

Total number of pods with 2 seeds on lateral branches at pod set [value/plant]—count of the number of pods containing 2 seeds in all lateral branches at pod set, average of three plants per plot.

Total number of pods with 3 seeds on lateral branches at pod set [value/plant]—count of the number of pods containing 3 seeds in all lateral branches at pod set, average of three plants per plot.

Total number of pods with 4 seeds on lateral branches at pod set [value/plant]—count of the number of pods containing 4 seeds in all lateral branches at pod set, average of three plants per plot.

Total number of pods with 1 seed on main stem at pod set [value/plant]—count of the number of pods containing 1 seed in main stem at pod set, average of three plants per plot.

Total number of pods with 2 seeds on main stem at pod set [value/plant]—count of the number of pods containing 2 seeds in main stem at pod set, average of three plants per plot.

Total number of pods with 3 seeds on main stem at pod set [value/plant]—count of the number of pods containing 3 seeds in main stem at pod set, average of three plants per plot.

Total number of pods with 4 seeds on main stem at pod set [value/plant]—count of the number of pods containing 4 seeds in main stem at pod set, average of three plants per plot.

Total number of seeds per plant at pod set [value/plant]—count of number of seeds in lateral branches and main stem at pod set, average of three plants per plot.

Total number of seeds on lateral branches at pod set [value/plant]—count of total number of seeds on lateral branches at pod set, average of three plants per plot.

Total number of seeds on main stem at pod set [value/plant]—count of total number of seeds on main stem at pod set, average of three plants per plot.

Plant height at pod set [cm/plant]—total length from above ground till the tip of the main stem at pod set, average of three plants per plot.

Plant height at harvest [cm/plant]—total length from above ground till the tip of the main stem at harvest, average of three plants per plot.

Total weight of pods on lateral branches at pod set [gr./plant]—weight of all pods on lateral branches at pod set, average of three plants per plot.

Ratio of the number of pods per node on main stem at pod set—calculated in Formula XXIII (above), average of three plants per plot.

Ratio of total number of seeds in main stem to number of seeds on lateral branches—calculated in Formula XXIV above, average of three plants per plot.

Total weight of pods per plant at pod set [gr./plant]—weight of all pods on lateral branches and main stem at pod set, average of three plants per plot.

Days till 50% flowering [days]—number of days till 50% flowering for each plot.

Days till 100% flowering [days]—number of days till 100% flowering for each plot.

Maturity [days]—measure as 95% of the pods in a plot have ripened (turned 100% brown). Delayed leaf drop and green stems are not considered in assigning maturity. Tests are observed 3 days per week, every other day, for maturity. The maturity date is the date that 95% of the pods have reached final color. Maturity is expressed in days after August 31 [according to the accepted definition of maturity in USA, Descriptor list for SOYBEAN, ars-grin (dot) gov/cgi-bin/npgs/html/desclist (dot) pl?51].

Seed quality [ranked 1-5]—measure at harvest; a visual estimate based on several hundred seeds. Parameter is rated according to the following scores considering the amount and degree of wrinkling, defective coat (cracks), greenishness, and moldy or other pigment. Rating is "1"—very good, "2"—good, "3"—fair, "4"—poor, "5"—very poor.

Lodging [ranked 1-5]—is rated at maturity per plot according to the following scores: "1"—most plants in a plot are erected; "2"—all plants leaning slightly or a few plants down; "3"—all plants leaning moderately, or 25%-50% down; "4"—all plants leaning considerably, or 50%-80% down; "5"—most plants down. Note: intermediate score such as 1.5 are acceptable.

Seed size [gr.]—weight of 1000 seeds per plot normalized to 13% moisture, measure at harvest.

Total weight of seeds per plant [gr./plant]—calculated at harvest (per 2 inner rows of a trimmed plot) as weight in grams of cleaned seeds adjusted to 13% moisture and divided by the total number of plants in two inner rows of a trimmed plot.

Yield at harvest [bushels/hectare]—calculated at harvest (per 2 inner rows of a trimmed plot) as weight in grams of cleaned seeds, adjusted to 13% moisture, and then expressed as bushels per acre.

Average lateral branch seeds per pod [number]—Calculate number of seeds on lateral branches-at pod set and divide by the number of pods with seeds on lateral branches-at pod set.

Average main stem seeds per pod [number]—Calculate total number of seeds on main stem at pod set and divide by the number of pods with seeds on main stem at pod setting.

Main stem average internode length [cm]—Calculate plant height at pod set and divide by the total number of nodes on main stem at pod setting.

Total number of pods with seeds on main stem [number]—count all pods containing seeds on the main stem at pod setting.

Total number of pods with seeds on lateral branches [number]—count all pods containing seeds on the lateral branches at pod setting.

Total number of pods per plant at pod set [number]—count pods on main stem and lateral branches at pod setting.

TABLE 128

Soybean correlated parameters (vectors)

| Correlated parameter with | Correlation ID |
|---|---|
| 100 percent flowering (days) | 1 |
| 50 percent flowering (days) | 2 |
| Base diameter at pod set (mm) | 3 |
| DW at pod set (gr.) | 4 |
| Lodging (score 1-5) | 5 |
| Maturity (days) | 6 |
| Num of lateral branches (number) | 7 |
| Num of pods with 1 seed on main stem at pod set (number) | 8 |
| Num of pods with 2 seed on main stem at pod set (number) | 9 |
| Num of pods with 3 seed on main stem at pod set (number) | 10 |
| Num of pods with 4 seed on main stem at pod set (number) | 11 |
| Plant height at harvest (cm) | 12 |
| Plant height at pod set (cm) | 13 |
| Ratio number of pods per node on main stem (ratio) | 14 |
| Ratio num of seeds-main stem to lateral branches (ratio) | 15 |
| Seed quality (score 1-5) | 16 |
| 1000 seed weight (gr.) | 17 |
| Num of Seeds on lateral branches-at pod set | 18 |
| Total Number of Seeds on main stem at pod set (number) | 19 |
| Num of pods with 1 seed on lateral branch-pod set (number) | 20 |
| Num of pods with 2 seed on lateral branch-pod set (number) | 21 |
| Num pods with 3 seed on lateral branch-at pod set (number) | 22 |
| Num pods with 4 seed on lateral branch-at pod set (number) | 23 |
| Total number of nodes on main stem (number) | 24 |
| Num of nodes with pods on lateral branches-pod set (number) | 25 |
| Total number of seeds per plant (number) | 26 |
| Total weight of lateral branches at pod set (gr.) | 27 |
| Weight of pods on lateral branches (gr)-at pod set | 28 |
| Total weight of pods on main stem at pod set (gr.) | 29 |
| Total weight of pods per plant (gr./plant) | 30 |
| Total weight of seeds per plant (gr./plant) | 31 |
| Fresh weight at pod set (gr.) | 32 |
| Yield at harvest (bushel/hectare) | 33 |
| Average lateral branch seeds per pod | 34 |
| Average main stem seeds per pod | 35 |
| Main stem average internode length (cm) | 36 |
| Num pods with seeds on lateral branches-at pod set (number) | 37 |

TABLE 128-continued

Soybean correlated parameters (vectors)

| Correlated parameter with | Correlation ID |
|---|---|
| Total number of pods per plant (number) | 38 |
| Total number of pods with seeds on main stem (number) | 39 |
| Corrected Seed size (gr.) | 40 |

Table 128.

29 different Soybean varieties lines were grown and characterized for 40 parameters as specified above. Tissues for expression analysis were sampled from a subset of 12 lines. The correlated parameters are described in Table 128 above. The average for each of the measured parameter was calculated using the JMP software (Tables 129-134) and a subsequent correlation analysis was performed (Table 135). Results were then integrated to the database.

TABLE 129

Measured parameters in Soybean varieties (lines 1-6)

| Ecotype/ Treatment | Line-1 | Line-2 | Line-3 | Line-4 | Line-5 | Line-6 |
|---|---|---|---|---|---|---|
| 1 | 67.33 | 71.67 | 67.67 | 67.33 | 60.00 | 74.00 |
| 2 | 61.00 | 65.33 | 60.67 | 61.00 | 54.67 | 68.33 |
| 3 | 8.33 | 9.54 | 9.68 | 8.11 | 8.82 | 10.12 |
| 4 | 53.67 | 50.33 | 38.00 | 46.17 | 60.83 | 55.67 |
| 5 | 1.67 | 1.83 | 1.17 | 1.67 | 2.67 | 2.83 |
| 6 | 24.00 | 43.67 | 30.33 | 30.33 | 38.33 | 40.00 |
| 7 | 9.00 | 8.67 | 9.11 | 9.89 | 7.67 | 17.56 |
| 8 | 1.11 | 4.38 | 1.44 | 1.44 | 4.56 | 1.67 |
| 9 | 16.89 | 16.25 | 13.22 | 16.89 | 27.00 | 8.11 |
| 10 | 29.56 | 1.75 | 19.78 | 22.33 | 11.67 | 22.78 |
| 11 | 0.00 | 0.00 | 0.11 | 0.11 | 0.00 | 0.44 |
| 12 | 96.67 | 76.67 | 67.50 | 75.83 | 74.17 | 76.67 |
| 13 | 86.78 | 69.56 | 62.44 | 70.89 | 69.44 | 63.89 |
| 14 | 2.87 | 1.38 | 2.13 | 2.26 | 2.60 | 1.87 |
| 15 | 0.89 | 0.90 | 0.87 | 0.89 | 2.32 | 0.37 |
| 16 | 2.33 | 3.50 | 3.00 | 2.17 | 2.83 | 2.00 |
| 17 | 89.00 | 219.33 | 93.00 | 86.00 | 191.33 | 71.33 |
| 18 | 150.89 | 55.89 | 134.00 | 160.44 | 75.44 | 324.63 |
| 19 | 123.56 | 43.89 | 87.67 | 102.67 | 93.56 | 88.00 |
| 20 | 1.56 | 3.00 | 1.78 | 1.78 | 5.67 | 5.63 |
| 21 | 17.00 | 18.75 | 26.44 | 32.33 | 21.56 | 33.50 |
| 22 | 38.44 | 2.00 | 26.44 | 31.33 | 8.89 | 82.00 |
| 23 | 0.00 | 0.00 | 0.00 | 0.00 | 0.00 | 1.50 |
| 24 | 16.56 | 16.78 | 16.11 | 18.11 | 16.78 | 17.11 |
| 25 | 23.00 | 16.00 | 23.11 | 33.00 | 15.22 | 45.25 |
| 26 | 274.44 | 99.78 | 221.67 | 263.11 | 169.00 | 412.50 |
| 27 | 67.78 | 63.78 | 64.89 | 74.89 | 54.00 | 167.22 |
| 28 | 26.00 | 14.89 | 20.11 | 20.11 | 21.11 | 30.25 |
| 29 | 22.11 | 14.33 | 16.00 | 15.00 | 33.78 | 9.00 |
| 30 | 48.11 | 29.22 | 36.11 | 35.11 | 54.89 | 38.88 |
| 31 | 15.09 | 10.50 | 17.23 | 16.51 | 12.06 | 10.25 |
| 32 | 170.89 | 198.22 | 152.56 | 163.89 | 224.67 | 265.00 |
| 33 | 47.57 | 43.77 | 50.37 | 56.30 | 44.00 | 40.33 |
| 34 | 2.67 | 1.95 | 2.43 | 2.53 | 2.13 | 2.68 |
| 35 | 2.60 | 1.89 | 2.52 | 2.53 | 2.17 | 2.59 |
| 36 | 5.24 | 4.15 | 3.91 | 3.92 | 4.15 | 3.74 |
| 37 | 57.00 | 28.56 | 54.67 | 65.44 | 36.11 | 122.63 |
| 38 | 104.56 | 51.67 | 89.22 | 106.22 | 79.33 | 155.63 |
| 39 | 47.56 | 23.11 | 34.56 | 40.78 | 43.22 | 33.00 |
| 40 | 89.00 | | 93.00 | 86.00 | | 71.33 |

Table 129.

TABLE 130

Measured parameters in Soybean varieties (lines 7-12)

| Ecotype/Treatment | Line-7 | Line-8 | Line-9 | Line-10 | Line-11 | Line-12 |
|---|---|---|---|---|---|---|
| 1 | 73.00 | 72.33 | 68.67 | 73.67 | 68.00 | 70.67 |
| 2 | 66.50 | 65.67 | 62.33 | 67.67 | 61.67 | 64.33 |
| 3 | 8.46 | 8.09 | 8.26 | 7.73 | 8.16 | 7.89 |
| 4 | 48.00 | 52.00 | 44.17 | 52.67 | 56.00 | 47.50 |
| 5 | 2.67 | 2.50 | 1.83 | 3.50 | 3.33 | 1.50 |
| 6 | 41.00 | 38.33 | 31.00 | 39.00 | 27.33 | 32.67 |
| 7 | 11.67 | 12.11 | 8.00 | 9.11 | 6.78 | 10.00 |
| 8 | 4.00 | 4.33 | 2.11 | 1.89 | 3.44 | 1.22 |
| 9 | 21.33 | 17.67 | 20.33 | 16.11 | 28.11 | 16.56 |
| 10 | 11.11 | 28.22 | 24.11 | 36.44 | 39.67 | 32.33 |
| 11 | 0.00 | 0.56 | 0.00 | 3.89 | 0.00 | 0.00 |
| 12 | 101.67 | 98.33 | 75.83 | 116.67 | 76.67 | 71.67 |
| 13 | 89.78 | 82.11 | 70.56 | 101.67 | 79.56 | 67.22 |
| 14 | 1.98 | 2.71 | 2.78 | 2.75 | 3.70 | 2.84 |
| 15 | 3.90 | 0.78 | 1.18 | 1.98 | 1.03 | 0.83 |
| 16 | 3.50 | 2.50 | 2.17 | 2.33 | 2.17 | 2.17 |
| 17 | 88.00 | 75.00 | 80.67 | 75.67 | 76.33 | 77.33 |
| 18 | 46.88 | 176.22 | 143.00 | 105.44 | 184.33 | 187.33 |
| 19 | 80.00 | 126.56 | 115.11 | 159.00 | 178.67 | 131.33 |
| 20 | 2.88 | 3.00 | 1.25 | 2.67 | 1.78 | 3.00 |
| 21 | 8.50 | 22.78 | 21.75 | 10.67 | 23.78 | 25.67 |
| 22 | 9.00 | 42.11 | 32.75 | 25.67 | 45.00 | 44.33 |
| 23 | 0.00 | 0.33 | 0.00 | 1.11 | 0.00 | 0.00 |
| 24 | 18.78 | 18.89 | 16.78 | 21.11 | 19.33 | 20.78 |
| 25 | 8.25 | 25.44 | 21.88 | 16.33 | 22.56 | 24.22 |
| 26 | 136.00 | 302.78 | 260.50 | 264.44 | 363.00 | 318.67 |
| 27 | 45.44 | 83.22 | 64.33 | 52.00 | 76.89 | 67.00 |
| 28 | 4.13 | 20.11 | 17.00 | 9.22 | 28.11 | 22.56 |
| 29 | 9.03 | 16.00 | 15.89 | 14.56 | 30.44 | 18.00 |
| 30 | 14.25 | 36.11 | 32.75 | 23.78 | 58.56 | 40.56 |
| 31 | 7.30 | 11.38 | 15.68 | 10.83 | 12.98 | 15.16 |
| 32 | 160.67 | 196.33 | 155.33 | 178.11 | 204.44 | 164.22 |
| 33 | 34.23 | 44.27 | 53.67 | 42.47 | 43.60 | 52.20 |
| 34 | 2.12 | 2.58 | 2.58 | 2.67 | 2.62 | 2.58 |
| 35 | 2.22 | 2.49 | 2.47 | 2.71 | 2.51 | 2.61 |
| 36 | 4.80 | 4.36 | 4.20 | 4.82 | 4.12 | 3.83 |
| 37 | 20.38 | 68.22 | 55.75 | 40.11 | 70.56 | 73.00 |
| 38 | 61.00 | 119.00 | 103.25 | 98.44 | 141.78 | 123.11 |
| 39 | 36.44 | 50.78 | 43.63 | 58.33 | 71.22 | 50.11 |
| 40 | 88.00 | 75.00 | 80.67 | 75.67 | 76.33 | 77.33 |

Table 130.

TABLE 131

Measured parameters in Soybean varieties (lines 1-8)

| Ecotype/Treatment | Line-1 | Line-2 | Line-3 | Line-4 | Line-5 | Line-6 | Line-7 | Line-8 |
|---|---|---|---|---|---|---|---|---|
| 1 | 67.33 | 67.33 | 67.33 | 70.00 | 68.00 | 71.67 | 67.33 | 67.67 |
| 3 | 8.27 | 8.00 | 8.33 | 7.16 | 7.78 | 9.54 | 8.13 | 9.68 |
| 4 | 35.83 | 51.67 | 53.67 | 34.67 | 47.50 | 50.33 | 53.50 | 38.00 |
| 5 | 2.00 | 2.00 | 1.67 | 1.67 | 1.17 | 1.83 | 1.67 | 1.17 |
| 6 | 27.67 | 27.67 | 24.00 | 30.33 | 31.33 | 43.67 | 27.00 | 30.33 |
| 7 | 5.11 | 8.44 | 9.00 | 7.00 | 8.67 | 8.67 | 7.11 | 9.11 |
| 8 | 0.56 | 2.44 | 1.11 | 2.56 | 0.89 | 4.38 | 1.89 | 1.44 |
| 9 | 16.44 | 17.22 | 16.89 | 25.33 | 10.44 | 16.25 | 20.00 | 13.22 |
| 10 | 19.33 | 23.33 | 29.56 | 23.33 | 30.56 | 1.75 | 23.56 | 19.78 |
| 11 | 0.00 | 0.00 | 0.00 | 0.00 | 2.22 | 0.00 | 0.00 | 0.11 |
| 12 | 69.17 | 85.00 | 96.67 | 75.83 | 73.33 | 76.67 | 75.00 | 67.50 |
| 13 | 66.78 | 79.44 | 86.78 | 64.11 | 68.00 | 69.56 | 74.11 | 62.44 |
| 14 | 2.34 | 2.67 | 2.87 | 2.87 | 2.51 | 1.38 | 2.65 | 2.13 |
| 15 | 1.28 | 1.13 | 0.89 | 1.35 | 0.86 | 0.90 | 1.43 | 0.87 |
| 16 | 3.00 | 2.17 | 2.33 | 2.33 | 2.50 | 3.50 | 2.67 | 3.00 |
| 17 | 126.00 | 116.00 | 89.00 | 75.67 | 84.33 | 219.33 | 119.0 | 93.00 |
| 18 | 92.78 | 124.00 | 150.89 | 122.78 | 174.89 | 55.89 | 112.67 | 134.00 |
| 19 | 91.44 | 106.89 | 123.56 | 123.22 | 122.33 | 43.89 | 112.56 | 87.67 |
| 20 | 0.78 | 0.89 | 1.56 | 0.78 | 1.00 | 3.00 | 1.22 | 1.78 |
| 21 | 15.33 | 17.56 | 17.00 | 23.33 | 18.11 | 18.75 | 21.22 | 26.44 |
| 22 | 20.44 | 29.33 | 38.44 | 25.11 | 43.22 | 2.00 | 23.00 | 26.44 |
| 23 | 0.000 | 0.000 | 0.000 | 0.000 | 2.000 | 0.000 | 0.000 | 0.000 |
| 24 | 15.56 | 16.11 | 16.56 | 17.78 | 17.67 | 16.78 | 17.33 | 16.11 |
| 25 | 13.89 | 20.89 | 23.00 | 22.44 | 26.11 | 16.00 | 21.56 | 23.11 |
| 26 | 184.22 | 230.89 | 274.44 | 246.00 | 297.22 | 99.78 | 225.22 | 221.67 |
| 27 | 57.78 | 66.67 | 67.78 | 57.00 | 73.67 | 63.78 | 64.44 | 64.89 |
| 28 | 23.00 | 25.00 | 26.00 | 18.33 | 23.22 | 14.89 | 27.89 | 20.11 |
| 29 | 22.56 | 22.22 | 22.11 | 17.89 | 17.89 | 14.33 | 23.78 | 16.00 |
| 30 | 45.56 | 47.22 | 48.11 | 36.22 | 41.11 | 29.22 | 51.67 | 36.11 |
| 31 | 21.35 | 14.70 | 15.09 | 13.44 | 16.60 | 10.50 | 16.03 | 17.23 |
| 32 | 158.89 | 185.78 | 170.89 | 146.78 | 172.78 | 198.22 | 166.44 | 152.56 |
| 33 | 55.53 | 50.33 | 47.57 | 46.83 | 55.87 | 43.77 | 51.67 | 50.37 |
| 34 | 2.53 | 2.58 | 2.67 | 2.51 | 2.74 | 1.95 | 2.46 | 2.43 |
| 35 | 2.52 | 2.49 | 2.60 | 2.36 | 2.77 | 1.89 | 2.50 | 2.52 |
| 36 | 4.29 | 4.93 | 5.24 | 3.61 | 3.85 | 4.15 | 4.29 | 3.91 |
| 37 | 36.56 | 47.78 | 57.00 | 49.22 | 64.33 | 28.56 | 45.44 | 54.67 |
| 38 | 72.89 | 90.78 | 104.56 | 100.44 | 108.44 | 51.67 | 90.89 | 89.22 |
| 39 | 36.33 | 43.00 | 47.56 | 51.22 | 44.11 | 23.11 | 45.44 | 34.56 |

Table 131.

TABLE 132

Measured parameters in Soybean varieties (lines 9-16)

| Ecotype/Treatment | Line-9 | Line-10 | Line-11 | Line-12 | Line-13 | Line-14 | Line-15 | Line-16 |
|---|---|---|---|---|---|---|---|---|
| 1 | 71.67 | 67.33 | 67.00 | 69.67 | 60.00 | 70.67 | 71.67 | 71.67 |
| 3 | 8.41 | 8.11 | 7.54 | 7.83 | 8.82 | 8.10 | 8.72 | 9.54 |
| 4 | 45.83 | 46.17 | 38.67 | 50.67 | 60.83 | 44.33 | 52.33 | 54.50 |
| 5 | 1.83 | 1.67 | 1.17 | 2.67 | 2.67 | 1.50 | 3.00 | 1.83 |
| 6 | 35.33 | 30.33 | 28.00 | 41.00 | 38.33 | 31.00 | 36.00 | 38.67 |
| 7 | 8.67 | 9.89 | 5.33 | 5.00 | 7.67 | 4.78 | 7.78 | 8.78 |
| 8 | 2.33 | 1.44 | 1.67 | 1.67 | 4.56 | 2.67 | 4.14 | 1.89 |
| 9 | 22.33 | 16.89 | 17.00 | 19.22 | 27.00 | 32.89 | 18.71 | 15.11 |
| 10 | 25.44 | 22.33 | 31.89 | 10.00 | 11.67 | 27.89 | 31.43 | 41.89 |
| 11 | 0.11 | 0.11 | 0.00 | 0.00 | 0.00 | 0.00 | 1.71 | 0.44 |
| 12 | 75.00 | 75.83 | 66.67 | 115.83 | 74.17 | 72.50 | 83.33 | 76.67 |
| 13 | 69.67 | 70.89 | 62.33 | 94.44 | 69.44 | 66.78 | 75.44 | 68.56 |
| 14 | 2.77 | 2.26 | 2.76 | 1.43 | 2.60 | 3.32 | 3.19 | 3.17 |
| 15 | 1.38 | 0.89 | 1.41 | 2.40 | 2.32 | 1.54 | 0.80 | 1.21 |
| 16 | 2.00 | 2.17 | 2.00 | 3.00 | 2.83 | 2.17 | 2.00 | 2.33 |
| 17 | 84.67 | 86.00 | 75.67 | 169.33 | 191.33 | 86.67 | 85.67 | 87.67 |
| 18 | 171.11 | 160.44 | 139.67 | 49.44 | 75.44 | 112.33 | 204.67 | 180.78 |
| 19 | 123.78 | 102.67 | 131.33 | 70.11 | 93.56 | 152.11 | 140.11 | 159.56 |
| 20 | 2.78 | 1.78 | 0.89 | 0.33 | 5.67 | 1.56 | 5.13 | 0.67 |
| 21 | 34.44 | 32.33 | 19.89 | 12.56 | 21.56 | 21.22 | 29.63 | 16.67 |
| 22 | 33.00 | 31.33 | 33.00 | 8.00 | 8.89 | 22.78 | 40.25 | 48.78 |
| 23 | 0.111 | 0.000 | 0.000 | 0.000 | 0.000 | 0.000 | 0.750 | 0.111 |
| 24 | 18.00 | 18.11 | 18.33 | 21.56 | 16.78 | 19.11 | 17.33 | 18.78 |
| 25 | 26.33 | 33.00 | 21.33 | 14.38 | 15.22 | 18.56 | 30.44 | 28.00 |
| 26 | 294.89 | 263.11 | 271.00 | 119.56 | 169.00 | 264.44 | 344.78 | 340.33 |
| 27 | 80.33 | 74.89 | 58.33 | 55.25 | 54.00 | 52.44 | 105.00 | 67.00 |
| 28 | 23.00 | 20.11 | 19.33 | 12.00 | 21.11 | 15.33 | 23.78 | 20.67 |
| 29 | 18.00 | 15.00 | 19.63 | 15.41 | 33.78 | 21.56 | 16.22 | 26.56 |
| 30 | 41.00 | 35.11 | 39.88 | 27.41 | 54.89 | 36.89 | 40.00 | 47.22 |
| 31 | 14.64 | 16.51 | 17.12 | 10.52 | 12.06 | 15.80 | 12.64 | 12.58 |
| 32 | 175.67 | 163.89 | 136.56 | 191.67 | 224.67 | 155.33 | 216.22 | 192.11 |
| 33 | 52.93 | 56.30 | 55.07 | 40.17 | 44.00 | 52.37 | 46.90 | 48.57 |
| 34 | 2.43 | 2.53 | 2.60 | 2.34 | 2.13 | 2.48 | 2.47 | 2.70 |
| 35 | 2.48 | 2.53 | 2.60 | 2.26 | 2.17 | 2.40 | 2.52 | 2.68 |
| 36 | 3.90 | 3.92 | 3.41 | 4.38 | 4.15 | 3.50 | 4.36 | 3.67 |
| 37 | 70.33 | 65.44 | 53.78 | 20.89 | 36.11 | 45.56 | 83.11 | 66.22 |
| 38 | 120.56 | 106.22 | 104.33 | 51.78 | 79.33 | 109.00 | 138.89 | 125.56 |
| 39 | 50.22 | 40.78 | 50.56 | 30.89 | 43.22 | 63.44 | 55.78 | 59.33 |

Table 132.

TABLE 133

Measured parameters in Soybean varieties (lines 17-23)

| Ecotype/Treatment | Line-17 | Line-18 | Line-19 | Line-20 | Line-21 | Line-22 | Line-23 |
|---|---|---|---|---|---|---|---|
| 1 | 74.00 | 73.00 | 72.33 | 73.33 | 67.33 | 68.67 | 69.33 |
| 3 | 10.12 | 8.46 | 8.09 | 8.11 | 7.09 | 8.26 | 7.57 |
| 4 | 55.67 | 48.00 | 52.00 | 45.17 | 57.00 | 44.17 | 43.33 |
| 5 | 2.83 | 2.67 | 2.50 | 1.67 | 2.50 | 1.83 | 2.00 |
| 6 | 40.00 | 41.00 | 38.33 | 37.00 | 24.67 | 31.00 | 37.67 |
| 7 | 17.56 | 11.67 | 12.11 | 10.44 | 8.00 | 8.00 | 9.00 |
| 8 | 1.67 | 4.00 | 4.33 | 1.89 | 1.78 | 2.11 | 0.44 |
| 9 | 8.11 | 21.33 | 17.67 | 20.00 | 17.44 | 20.33 | 11.22 |
| 10 | 22.78 | 11.11 | 28.22 | 27.89 | 25.11 | 24.11 | 25.22 |
| 11 | 0.44 | 0.00 | 0.56 | 0.56 | 0.44 | 0.00 | 0.11 |
| 12 | 76.67 | 101.67 | 98.33 | 89.17 | 93.33 | 75.83 | 78.33 |
| 13 | 63.89 | 89.78 | 82.11 | 81.11 | 85.67 | 70.56 | 70.78 |
| 14 | 1.87 | 1.98 | 2.71 | 2.58 | 2.45 | 2.78 | 2.15 |
| 15 | 0.37 | 3.90 | 0.78 | 1.36 | 0.92 | 1.18 | 0.82 |
| 16 | 2.00 | 3.50 | 2.50 | 2.00 | 2.50 | 2.17 | 2.17 |
| 17 | 71.33 | 88.00 | 75.00 | 78.67 | 91.67 | 80.67 | 80.67 |
| 18 | 324.63 | 46.88 | 176.22 | 121.56 | 151.56 | 143.00 | 144.00 |
| 19 | 88.00 | 80.00 | 126.56 | 127.78 | 113.78 | 115.11 | 99.00 |
| 20 | 5.63 | 2.88 | 3.00 | 2.33 | 1.67 | 1.25 | 0.89 |
| 21 | 33.50 | 8.50 | 22.78 | 21.89 | 22.89 | 21.75 | 13.22 |
| 22 | 82.00 | 9.00 | 42.11 | 24.56 | 34.11 | 32.75 | 38.89 |
| 23 | 1.500 | 0.000 | 0.333 | 0.444 | 0.444 | 0.000 | 0.000 |
| 24 | 17.11 | 18.78 | 18.89 | 19.44 | 19.89 | 16.78 | 17.00 |
| 25 | 45.25 | 8.25 | 25.44 | 22.67 | 23.00 | 21.88 | 23.78 |
| 26 | 412.50 | 136.00 | 302.78 | 249.33 | 265.33 | 260.50 | 243.00 |
| 27 | 167.22 | 45.44 | 83.22 | 63.67 | 69.67 | 64.33 | 76.22 |
| 28 | 30.25 | 4.13 | 20.11 | 14.89 | 24.33 | 17.00 | 19.22 |
| 29 | 9.00 | 9.03 | 16.00 | 14.57 | 19.78 | 15.89 | 14.67 |
| 30 | 38.88 | 14.25 | 36.11 | 29.46 | 44.11 | 32.75 | 33.89 |
| 31 | 10.25 | 7.30 | 11.38 | 13.86 | 14.63 | 15.68 | 14.77 |
| 32 | 265.00 | 160.67 | 196.33 | 166.33 | 171.44 | 155.33 | 175.78 |
| 33 | 40.33 | 34.23 | 44.27 | 46.23 | 49.70 | 53.67 | 52.53 |
| 34 | 2.68 | 2.12 | 2.58 | 2.48 | 2.61 | 2.58 | 2.70 |
| 35 | 2.59 | 2.22 | 2.49 | 2.53 | 2.53 | 2.47 | 2.67 |
| 36 | 3.74 | 4.80 | 4.36 | 4.18 | 4.89 | 4.20 | 4.16 |
| 37 | 122.63 | 20.38 | 68.22 | 49.22 | 59.11 | 55.75 | 53.00 |
| 38 | 155.63 | 61.00 | 119.00 | 99.56 | 103.89 | 103.25 | 90.00 |
| 39 | 33.00 | 36.44 | 50.78 | 50.33 | 44.78 | 46.56 | 37.00 |

Table 133.

TABLE 134

Measured parameters in Soybean varieties (lines 24-29)

| Ecotype/ Treatment | Line-24 | Line-25 | Line-26 | Line-27 | Line-28 | Line-29 |
|---|---|---|---|---|---|---|
| 1 | 73.67 | 68.00 | 68.67 | 68.00 | 67.00 | 70.67 |
| 3 | 7.73 | 8.16 | 8.18 | 6.88 | 7.82 | 7.89 |
| 4 | 52.67 | 56.00 | 56.17 | 43.50 | 46.00 | 47.50 |
| 5 | 3.50 | 3.33 | 1.83 | 1.50 | 2.33 | 1.50 |
| 6 | 39.00 | 27.33 | 27.67 | 27.33 | 36.33 | 32.67 |
| 7 | 9.11 | 6.78 | 7.11 | 4.33 | 9.11 | 10.00 |
| 8 | 1.89 | 3.44 | 3.22 | 1.67 | 3.33 | 1.22 |
| 9 | 16.11 | 28.11 | 24.67 | 14.67 | 14.33 | 16.56 |
| 10 | 36.44 | 39.67 | 35.78 | 31.67 | 37.56 | 32.33 |
| 11 | 3.89 | 0.00 | 0.00 | 0.78 | 0.78 | 0.00 |
| 12 | 116.67 | 76.67 | 85.00 | 78.33 | 79.17 | 71.67 |
| 13 | 101.67 | 79.56 | 77.44 | 73.67 | 73.67 | 67.22 |
| 14 | 2.75 | 3.70 | 3.58 | 3.06 | 3.34 | 2.84 |
| 15 | 1.98 | 1.03 | 1.48 | 1.82 | 1.35 | 0.83 |
| 16 | 2.33 | 2.17 | 2.17 | 2.33 | 2.17 | 2.17 |
| 17 | 75.67 | 76.33 | 88.00 | 93.33 | 79.00 | 77.33 |
| 18 | 105.44 | 184.33 | 166.22 | 92.33 | 143.78 | 187.33 |
| 19 | 159.00 | 178.67 | 159.89 | 129.11 | 147.78 | 131.33 |
| 20 | 2.67 | 1.78 | 1.00 | 0.56 | 2.11 | 3.00 |
| 21 | 10.67 | 23.78 | 26.78 | 10.22 | 15.89 | 25.67 |
| 22 | 25.67 | 45.00 | 37.22 | 23.78 | 35.89 | 44.33 |
| 23 | 1.111 | 0.000 | 0.000 | 0.000 | 0.556 | 0.000 |
| 24 | 21.11 | 19.33 | 17.78 | 15.89 | 16.67 | 20.78 |
| 25 | 16.33 | 22.56 | 19.89 | 11.78 | 16.00 | 24.22 |
| 26 | 264.44 | 363.00 | 326.11 | 221.44 | 291.56 | 318.67 |
| 27 | 52.00 | 76.89 | 74.78 | 35.33 | 52.11 | 67.00 |
| 28 | 9.22 | 28.11 | 24.22 | 14.33 | 15.13 | 22.56 |
| 29 | 14.56 | 30.44 | 24.22 | 26.36 | 21.44 | 18.00 |
| 30 | 23.78 | 58.56 | 48.44 | 40.69 | 35.75 | 40.56 |
| 31 | 10.83 | 12.98 | 16.38 | 16.64 | 15.82 | 15.16 |
| 32 | 178.11 | 204.44 | 205.89 | 144.67 | 176.44 | 164.22 |
| 33 | 42.47 | 43.60 | 51.90 | 52.50 | 46.43 | 52.20 |
| 34 | 2.67 | 2.62 | 2.37 | 2.67 | 2.62 | 2.58 |
| 35 | 2.71 | 2.51 | 2.53 | 2.64 | 2.65 | 2.61 |
| 36 | 4.82 | 4.12 | 4.36 | 4.64 | 4.47 | 3.57 |
| 37 | 40.11 | 70.56 | 71.67 | 34.56 | 54.44 | 73.00 |
| 38 | 98.44 | 141.78 | 135.33 | 83.33 | 110.44 | 123.11 |
| 39 | 58.33 | 71.22 | 63.67 | 48.78 | 56.00 | 50.11 |

Table 134.

TABLE 135

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LBY193 | 0.82 | 1.02E−03 | 11 | 15 | LBY193 | 0.71 | 4.99E−02 | 9 | 16 |
| LBY193 | 0.77 | 2.59E−02 | 9 | 17 | LBY193 | 0.78 | 2.57E−03 | 1 | 23 |
| LBY193 | 0.72 | 8.44E−03 | 10 | 33 | LBY194 | 0.72 | 1.80E−02 | 7 | 18 |
| LBY194 | 0.72 | 1.82E−02 | 7 | 27 | LBY194 | 0.77 | 9.00E−03 | 7 | 7 |
| LBY194 | 0.74 | 1.50E−02 | 7 | 25 | LBY194 | 0.84 | 8.52E−03 | 9 | 22 |
| LBY194 | 0.85 | 7.48E−03 | 9 | 18 | LBY194 | 0.81 | 1.40E−02 | 9 | 21 |
| LBY194 | 0.77 | 2.52E−02 | 9 | 32 | LBY194 | 0.77 | 2.39E−02 | 9 | 23 |
| LBY194 | 0.83 | 1.09E−02 | 9 | 27 | LBY194 | 0.78 | 2.26E−02 | 9 | 25 |
| LBY194 | 0.81 | 1.53E−02 | 9 | 26 | LBY195 | 0.78 | 7.97E−03 | 7 | 32 |
| LBY195 | 0.72 | 1.91E−02 | 7 | 20 | LBY195 | 0.70 | 1.08E−02 | 11 | 1 |
| LBY195 | 0.92 | 1.34E−04 | 5 | 15 | LBY195 | 0.72 | 1.77E−02 | 8 | 17 |
| LBY195 | 0.73 | 4.06E−02 | 9 | 22 | LBY195 | 0.76 | 2.87E−02 | 9 | 18 |
| LBY195 | 0.73 | 3.91E−02 | 9 | 21 | LBY195 | 0.96 | 1.10E−04 | 9 | 32 |
| LBY195 | 0.81 | 1.43E−02 | 9 | 4 | LBY195 | 0.72 | 4.45E−02 | 9 | 5 |
| LBY195 | 0.82 | 1.21E−02 | 9 | 23 | LBY195 | 0.87 | 5.44E−03 | 9 | 27 |
| LBY195 | 0.77 | 2.57E−02 | 9 | 25 | LBY195 | 0.71 | 4.66E−02 | 9 | 28 |
| LBY195 | 0.70 | 5.27E−02 | 9 | 26 | LBY195 | 0.75 | 4.95E−03 | 4 | 9 |
| LBY195 | 0.74 | 5.96E−03 | 10 | 30 | LBY195 | 0.78 | 2.66E−03 | 10 | 29 |
| LGN2 | 0.81 | 4.49E−03 | 8 | 9 | LGN2 | 0.73 | 3.95E−02 | 9 | 6 |
| LGN2 | 0.78 | 2.35E−02 | 9 | 2 | LGN2 | 0.82 | 1.33E−02 | 9 | 1 |
| LGN2 | 0.76 | 7.13E−03 | 2 | 20 | LGN2 | 0.88 | 1.35E−04 | 1 | 32 |
| LGN2 | 0.72 | 8.28E−03 | 1 | 3 | LGN2 | 0.80 | 1.63E−03 | 1 | 20 |
| LGN2 | 0.80 | 1.68E−03 | 10 | 15 | LBY194 | 0.73 | 1.57E−02 | 5 | 36 |
| LBY194 | 0.75 | 1.33E−02 | 7 | 37 | LBY194 | 0.81 | 1.51E−02 | 9 | 38 |
| LBY194 | 0.85 | 7.25E−03 | 9 | 37 | LBY195 | 0.73 | 4.11E−02 | 9 | 38 |
| LBY195 | 0.77 | 2.56E−02 | 9 | 37 | LBY194 | 0.80 | 1.81E−02 | 8 | 40 |
| LBY194 | 0.98 | 3.36E−05 | 5 | 40 | | | | | |

Table 135. Provided are the correlations (R) between the expression levels yield improving genes and their homologs in various tissues [Expression (Exp) sets, Table 127] and the phenotypic performance [yield, biomass, and plant architecture as described in Tables 129-134 using the Correlation vectors (Con.) described in Table 128] under normal conditions across soybean varieties. P = p value.

Example 16

Production of Tomato Transcriptome and High Throughput Correlation Analysis Using 44K Tomato Oligonucleotide Micro-Array In order to produce a high throughput correlation analysis between NUE related phenotypes and gene expression, the present inventors utilized a Tomato oligonucleotide microarray, produced by Agilent Technologies [chem. (dot) agilent (dot) com/Scripts/PDS (dot) asp?1Page=50879]. The array oligonucleotide represents about 44,000 Tomato genes and transcripts. In order to define correlations between the levels of RNA expression with NUE, ABST, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [davidmlane (dot) com/hyperstat/A34739 (dot) html].

I. Correlation of Tomato Varieties Across Ecotypes Grown Under Low Nitrogen, Drought and Regular Growth Conditions Experimental Procedures 10 Tomato varieties were grown in 3 repetitive blocks, each containing 6 plants per plot were grown at net house. Briefly, the growing protocol was as follows:

1. Regular growth conditions: Tomato varieties were grown under normal conditions: 4-6 Liters/m$^2$ of water per day and fertilized with NPK (nitrogen, phosphorous and potassium at a ratio 6:6:6, respectively) as recommended in protocols for commercial tomato production.

2. Low Nitrogen fertilization conditions: Tomato varieties were grown under normal conditions (4-6 Liters/m$^2$ per day and fertilized with NPK as recommended in protocols for commercial tomato production) until flower stage. At this time, Nitrogen fertilization was stopped.

3. Drought stress: Tomato variety was grown under normal conditions (4-6 Liters/m$^2$ per day) until flower stage. At this time, irrigation was reduced to 50% compared to normal conditions.

Plants were phenotyped on a daily basis following the standard descriptor of tomato (Table 137). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute). Data parameters collected are summarized in Tables 138-140, herein below.

Analyzed Tomato tissues—Two tissues at different developmental stages [flower and leaf], representing different plant characteristics, were sampled and RNA was extracted as described above. For convenience, each micro-array expression information tissue type has received a Set ID as summarized in Table 136 below.

TABLE 136

Tomato transcriptome expression sets

| Expression Set | Set ID |
| --- | --- |
| Leaf at reproductive stage under normal conditions | 1 |
| Flower under normal conditions | 2 |
| Leaf at reproductive stage under low N conditions | 3 |
| Flower under low N conditions | 4 |
| Leaf at reproductive stage under drought conditions | 5 |
| Flower under drought conditions | 6 |

Table 136: Provided are the identification (ID) digits of each of the tomato expression sets.

The collected data parameters were as follows:

Fruit Weight (gr)—At the end of the experiment [when 50% of the fruits were ripe (red)] all fruits from plots within blocks A-C were collected. The total fruits were counted and weighted. The average fruits weight was calculated by dividing the total fruit weight by the number of fruits.

Yield/SLA—Fruit yield divided by the specific leaf area, gives a measurement of the balance between reproductive and vegetative processes.

Yield/total leaf area—Fruit yield divided by the total leaf area, gives a measurement of the balance between reproductive and vegetative processes.

Plant vegetative Weight (FW) (gr)—At the end of the experiment [when 50% of the fruit were ripe (red)] all plants from plots within blocks A-C were collected. Fresh weight was measured (grams).

Inflorescence Weight (gr)—At the end of the experiment [when 50% of the fruits were ripe (red)] two Inflorescence from plots within blocks A-C were collected.

The Inflorescence weight (gr.) and number of flowers per inflorescence were counted.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I as described above.

Plants that maintain high relative water content (RWC) compared to control lines were considered more tolerant to drought than those exhibiting reduced relative water content.

TABLE 137

Tomato correlated parameters (vectors)

| Correlated parameter with | Correlation ID |
| --- | --- |
| 100 weight green fruit [gr.] (Drought conditions) | 1 |
| 100 weight green fruit [gr.] (Low N conditions) | 2 |
| 100 weight green fruit [gr.] (Normal conditions) | 3 |
| 100 weight red fruit [gr.] (Drought conditions) | 4 |
| 100 weight red fruit [gr.] (Low N conditions) | 5 |
| 100 weight red fruit [gr.] (Normal conditions) | 6 |
| Cluster Weight (Low N/Normal conditions) | 7 |
| FW NUE [gr.] (Normal conditions) | 8 |

TABLE 137-continued

Tomato correlated parameters (vectors)

| Correlated parameter with | Correlation ID |
|---|---|
| FW (Drought conditions/Normal conditions) | 9 |
| FW/Plant [gr./number] (Low N conditions) | 10 |
| FW/Plant [gr./number] (Normal) conditions | 11 |
| FW/Plant [gr./number] (Drought conditions) | 12 |
| Fruit (Drought conditions/Low N conditions) | 13 |
| Fruit NUE [number] (Normal conditions) | 14 |
| Fruit Yield (Drought conditions/Normal conditions) | 15 |
| Fruit Yield/Plant [gr./number] (Low N conditions) | 16 |
| Fruit Yield/Plant [gr./number] (Drought conditions) | 17 |
| Fruit yield/Plant [gr.] (Normal conditions) | 18 |
| HI [yield/yield + biomass] (Low N conditions) | 19 |
| HI [yield/yield + biomass] (Normal conditions) | 20 |
| Leaflet Length [cm] (Low N conditions) | 21 |
| Leaflet Length [cm] (Normal conditions) | 22 |
| Leaflet Length [cm]) (Drought conditions) | 23 |
| Leaflet Width [cm] (Low N conditions) | 24 |
| Leaflet Width [cm] (Normal conditions) | 25 |
| Leaflet Width [cm] (Drought conditions) | 26 |
| NUE [yield/SPAD] (Low N conditions) | 27 |
| NUE [yield/SPAD] [gr./number] (Normal conditions) | 28 |
| NUE2 [total biomass/SPAD] (Low N conditions) | 29 |
| NUE2 [total biomass/SPAD] [gr./number] (Normal conditions) | 30 |
| NUpE [biomass/SPAD] (Low N conditions) | 31 |
| NUpE [biomass/SPAD] [gr./number] (Normal conditions) | 32 |
| No flowers (Low N conditions) | 33 |
| Number of flowers (Normal conditions) | 34 |
| Number of Flower (Drought conditions/Low N conditions) | 35 |
| Number of Flower (Drought conditions/Normal conditions) | 36 |
| Number of flowers (Drought conditions) | 37 |
| Num. Flowers (Low N conditions/Normal conditions) | 38 |
| RWC (Normal conditions) | 39 |
| RWC (Drought conditions) | 40 |
| RWC (Drought conditions/Normal conditions) | 41 |
| RWC (Low N conditions) | 42 |
| RWC (Low N conditions/Normal conditions) | 43 |
| SPAD 100% RWC (Low N conditions/Normal conditions) | 44 |
| SLA [leaf area/plant biomass] [cm$^2$/gr] (Low N conditions) | 45 |
| SLA [leaf area/plant biomass] [cm$^2$/gr] (Normal conditions) | 46 |
| SPAD (Normal conditions) | 47 |
| SPAD 100% RWC (Low N conditions) | 48 |
| SPAD 100% RWC (Normal conditions) | 49 |
| SPAD (Low N conditions) | 50 |
| SPAD (Low N conditions/Normal conditions) | 51 |
| Total Leaf Area [cm$^2$] (Low N conditions) | 52 |
| Total Leaf Area [cm$^2$] (Normal conditions) | 53 |
| Total Leaf Area [cm$^2$]) (Drought conditions) | 54 |
| Weight Flower clusters [gr.] (Normal conditions) | 55 |
| Weight clusters (flowers) (Low N conditions) | 56 |
| Weight flower clusters [gr.] (Drought conditions) | 57 |
| Yield/SLA [gr./(cm$^2$/gr.)] (Low N conditions) | 58 |
| Yield/SLA [gr./(cm$^2$/gr.)] (Normal conditions) | 59 |
| Yield/total leaf area [gr/cm$^2$] (Low N conditions) | 60 |
| Yield/total leaf area [gr./cm$^2$] (Normal conditions) | 61 |
| Average red fruit weight [gr.] (Low N conditions) | 62 |
| Average red fruit weight [gr.] (Normal conditions) | 63 |
| Average red fruit weight [gr.] (Drought conditions) | 64 |
| Flower cluster weight (Drought conditions/Low N conditions) | 65 |
| Flower cluster weight (Drought conditions/Normal conditions) | 66 |
| Red fruit weight (Drought conditions/Normal conditions) | 67 |

Table 137. Provided are the tomato correlated parameters. "gr." = grams; "FW" = fresh weight; "NUE" = nitrogen use efficiency; "RWC" = relative water content; "NUpE" = nitrogen uptake efficiency; "SPAD" = chlorophyll levels; "HI" = harvest index (vegetative weight divided on yield); "SLA" = specific leaf area (leaf area divided by leaf dry weight), Treatment in the parenthesis.

Table 137 provides the tomato correlated parameters (Vectors). The average for each of the measured parameter was calculated using the JMP software and values are summarized in Tables 138-140 below. Subsequent correlation analysis was conducted (Table 141). Results were integrated to the database.

TABLE 138

Measured parameters in Tomato accessions (lines 1-6)

| Ecotype/ Treatment | Line-1 | Line-2 | Line-3 | Line-4 | Line-5 | Line-6 |
|---|---|---|---|---|---|---|
| 1 | | | | | | |
| 2 | 0.57 | 0.37 | 3.40 | 0.68 | 0.45 | 0.47 |
| 3 | 0.56 | 3.05 | 0.24 | 2.58 | 6.32 | 5.75 |
| 4 | | | | | | |
| 5 | 0.65 | 0.53 | 7.17 | 0.44 | 0.55 | |
| 6 | 0.82 | 2.46 | 0.50 | 2.76 | 5.32 | 5.24 |
| 7 | 0.44 | 0.01 | 1.08 | 0.02 | 0.37 | 0.81 |
| 8 | 0.74 | 3.01 | 0.83 | 1.54 | 3.70 | 1.22 |
| 9 | 0.61 | 2.63 | 1.18 | 1.36 | 4.02 | 1.01 |
| 10 | 2.25 | 2.54 | 1.85 | 3.06 | 3.13 | 2.54 |
| 11 | 3.02 | 0.84 | 2.24 | 1.98 | 0.85 | 2.09 |
| 12 | 1.85 | 2.22 | 2.63 | 2.71 | 3.41 | 2.11 |
| 13 | 1.32 | 0.76 | 1.51 | 0.71 | 5.06 | 0.89 |
| 14 | 0.97 | 3.80 | 2.78 | 0.78 | 0.02 | 1.16 |
| 15 | 1.27 | 2.88 | 4.20 | 0.55 | 0.09 | 1.03 |
| 16 | 0.48 | 0.46 | 1.35 | 0.35 | 0.01 | 0.51 |
| 17 | 0.63 | 0.35 | 2.04 | 0.25 | 0.05 | 0.45 |
| 18 | 0.49 | 0.12 | 0.49 | 0.45 | 0.53 | 0.44 |
| 19 | 0.18 | 0.15 | 0.42 | 0.10 | 0.00 | 0.17 |
| 20 | 0.14 | 0.12 | 0.18 | 0.19 | 0.38 | 0.17 |
| 21 | 3.69 | 5.43 | 6.95 | 3.73 | 4.39 | 6.72 |
| 22 | 6.34 | 7.99 | 5.59 | 7.70 | 7.85 | 6.22 |
| 23 | | | | | | |
| 24 | 1.79 | 2.55 | 3.52 | 1.73 | 1.87 | 3.54 |
| 25 | 3.69 | 4.77 | 3.43 | 4.56 | 4.44 | 3.15 |
| 26 | | | | | | |
| 27 | 0.01 | 0.02 | 0.04 | 0.01 | 0.00 | 0.02 |
| 28 | 0.009 | 0.003 | 0.010 | 0.010 | 0.012 | 0.008 |
| 29 | 0.08 | 0.13 | 0.09 | 0.11 | 0.11 | 0.09 |
| 30 | 0.063 | 0.021 | 0.057 | 0.056 | 0.032 | 0.047 |
| 31 | 0.07 | 0.11 | 0.05 | 0.09 | 0.11 | 0.08 |
| 32 | 0.054 | 0.018 | 0.046 | 0.046 | 0.020 | 0.039 |
| 33 | 9.00 | 13.00 | 10.67 | 16.67 | 6.00 | 16.00 |
| 34 | 6.33 | 7.67 | 9.67 | 8.33 | 5.00 | 8.33 |
| 35 | 1.74 | 1.56 | 1.09 | 1.52 | 4.96 | 1.08 |
| 36 | 2.47 | 2.65 | 1.21 | 3.04 | 5.95 | 2.08 |
| 37 | 15.67 | 20.33 | 11.67 | 25.33 | 29.73 | 17.33 |
| 38 | 1.42 | 1.70 | 1.10 | 2.00 | 1.20 | 1.92 |
| 39 | 64.29 | 67.07 | 54.79 | 77.61 | 58.18 | 66.51 |
| 40 | 65.33 | 72.22 | 66.13 | 68.33 | 78.13 | 18.46 |
| 41 | 1.02 | 1.08 | 1.21 | 0.88 | 1.34 | 0.28 |
| 42 | 69.49 | 63.24 | 77.36 | 77.91 | 80.49 | 67.40 |
| 43 | 1.08 | 0.94 | 1.41 | 1.00 | 1.38 | 1.01 |
| 44 | 0.92 | 0.75 | 1.31 | 0.97 | 1.11 | 0.95 |
| 45 | 131.29 | 148.82 | 257.51 | 64.34 | 144.60 | 246.05 |
| 46 | 140.99 | 689.67 | 130.22 | 299.12 | 1117.74 | 111.77 |
| 47 | 55.80 | 46.40 | 48.20 | 43.40 | 42.90 | 53.30 |
| 48 | 33.01 | 23.42 | 34.53 | 32.51 | 27.66 | 33.68 |
| 49 | 35.89 | 31.09 | 26.38 | 33.68 | 24.98 | 35.47 |
| 50 | 47.50 | 37.00 | 44.60 | 41.70 | 34.40 | 50.00 |
| 51 | 0.85 | 0.80 | 0.93 | 0.96 | 0.80 | 0.94 |
| 52 | 294.83 | 378.00 | 476.39 | 197.08 | 453.24 | 625.51 |
| 53 | 426.10 | 582.38 | 291.40 | 593.58 | 947.59 | 233.35 |
| 54 | | | | | | |
| 55 | 0.69 | 56.35 | 0.44 | 11.31 | 0.79 | 0.58 |
| 56 | 0.31 | 0.35 | 0.47 | 0.25 | 0.29 | 0.47 |
| 57 | 0.33 | 0.29 | 0.55 | 0.31 | 0.45 | 0.56 |
| 58 | 0.004 | 0.003 | 0.005 | 0.006 | 0.000 | 0.002 |
| 59 | 0.004 | 0.000 | 0.004 | 0.002 | 0.000 | 0.004 |
| 60 | 0.002 | 0.001 | 0.003 | 0.002 | 0.000 | 0.001 |
| 61 | 0.001 | 0.000 | 0.002 | 0.001 | 0.001 | 0.002 |
| 62 | 0.006 | 0.005 | 0.096 | 0.004 | 0.006 | 0.007 |
| 63 | 0.01 | 0.29 | 0.01 | 0.05 | 0.23 | 0.29 |
| 64 | 0.209 | 0.005 | 0.102 | 0.002 | 0.035 | 0.006 |
| 65 | 1.06 | 0.82 | 1.16 | 1.25 | 1.52 | 1.19 |
| 66 | 0.47 | 0.01 | 1.25 | 0.03 | 0.56 | 0.96 |
| 67 | 25.38 | 0.02 | 20.26 | 0.04 | 0.15 | 0.02 |

Table 138.

TABLE 139

Measured parameters in Tomato accessions (lines 7-12)

| Ecotype/Treatment | Line-7 | Line-8 | Line-9 | Line-10 | Line-11 | Line-12 |
|---|---|---|---|---|---|---|
| 1 | | | | 0.80 | 0.28 | 0.38 |
| 2 | 0.54 | 0.39 | 0.97 | 0.91 | 0.36 | 0.35 |
| 3 | 0.38 | 0.30 | 1.95 | 2.53 | 1.42 | 2.03 |
| 4 | | | | 0.89 | 0.35 | 0.63 |
| 5 | 0.75 | 0.58 | 1.27 | 1.34 | 0.52 | 0.57 |
| 6 | 0.61 | 0.66 | 2.70 | 0.70 | 2.64 | 4.67 |
| 7 | 0.55 | 0.36 | 0.95 | 0.80 | 0.34 | 0.61 |
| 8 | 0.58 | 0.55 | 1.06 | 0.49 | 1.31 | 1.36 |
| 9 | 0.61 | 0.64 | 0.95 | 0.51 | 1.17 | 1.94 |
| 10 | 1.84 | 1.52 | 1.91 | 1.86 | 2.47 | 2.62 |
| 11 | 3.21 | 2.75 | 1.81 | 3.77 | 1.89 | 1.93 |
| 12 | 1.95 | 1.76 | 1.72 | 1.92 | 2.21 | 3.73 |
| 13 | 0.67 | 2.17 | 0.38 | 1.27 | 0.84 | 1.51 |
| 14 | 2.07 | 1.51 | 2.41 | 2.06 | 0.38 | 1.64 |
| 15 | 1.39 | 3.28 | 0.91 | 2.62 | 0.32 | 2.48 |
| 16 | 0.44 | 0.47 | 1.59 | 0.39 | 0.32 | 0.45 |
| 17 | 0.29 | 1.02 | 0.60 | 0.49 | 0.27 | 0.68 |
| 18 | 0.21 | 0.31 | 0.66 | 0.19 | 0.85 | 0.27 |
| 19 | 0.19 | 0.24 | 0.45 | 0.17 | 0.12 | 0.15 |
| 20 | 0.06 | 0.10 | 0.27 | 0.05 | 0.31 | 0.12 |
| 21 | 6.66 | 4.39 | 3.90 | 5.29 | 6.32 | 5.11 |
| 22 | 6.16 | 5.65 | 4.39 | 4.44 | 6.77 | 7.42 |
| 23 | | | | 5.15 | 3.38 | 7.14 |
| 24 | 3.28 | 2.52 | 2.61 | 2.61 | 3.58 | 2.56 |
| 25 | 3.37 | 3.13 | 2.40 | 2.02 | 3.80 | 3.74 |
| 26 | | | | 2.55 | 2.04 | 4.17 |
| 27 | 0.01 | 0.01 | 0.06 | 0.01 | 0.01 | 0.02 |
| 28 | 0.004 | 0.006 | 0.017 | 0.004 | 0.015 | 0.006 |
| 29 | 0.08 | 0.06 | 0.14 | 0.06 | 0.06 | 0.12 |
| 30 | 0.058 | 0.060 | 0.062 | 0.083 | 0.047 | 0.046 |
| 31 | 0.06 | 0.04 | 0.08 | 0.05 | 0.05 | 0.10 |
| 32 | 0.055 | 0.054 | 0.045 | 0.079 | 0.033 | 0.040 |
| 33 | 15.00 | 6.00 | 17.00 | 13.00 | 8.67 | 9.33 |
| 34 | 10.00 | 7.00 | 9.00 | 8.00 | 5.33 | 8.00 |
| 35 | 0.98 | 4.94 | 0.88 | 0.79 | 2.12 | 1.29 |
| 36 | 1.47 | 4.24 | 1.67 | 1.29 | 3.44 | 1.50 |
| 37 | 14.67 | 29.67 | 15.00 | 10.33 | 18.33 | 12.00 |
| 38 | 1.50 | 0.86 | 1.89 | 1.63 | 1.63 | 1.17 |
| 39 | 64.71 | 75.25 | 66.23 | 63.21 | 56.77 | 35.96 |
| 40 | 73.21 | 62.50 | 67.21 | 75.76 | 62.82 | 70.69 |
| 41 | 1.13 | 0.83 | 1.01 | 1.20 | 1.11 | 1.97 |
| 42 | 67.16 | 66.07 | 69.57 | 69.30 | 100.00 | 57.66 |
| 43 | 1.04 | 0.88 | 1.05 | 1.10 | 1.76 | 1.60 |
| 44 | 0.79 | 0.92 | 0.94 | 1.36 | 1.44 | 1.50 |
| 45 | 405.55 | 299.32 | 86.19 | 182.32 | 160.18 | 90.10 |
| 46 | 106.29 | 123.14 | 104.99 | 111.88 | 307.95 | 419.37 |
| 47 | 58.50 | 51.10 | 40.00 | 47.60 | 57.90 | 48.30 |
| 48 | 30.04 | 35.50 | 24.81 | 40.77 | 47.47 | 26.06 |
| 49 | 37.87 | 38.43 | 26.49 | 30.07 | 32.89 | 17.35 |
| 50 | 44.70 | 53.70 | 35.70 | 58.80 | 47.50 | 45.20 |
| 51 | 0.76 | 1.05 | 0.89 | 1.24 | 0.82 | 0.94 |
| 52 | 748.01 | 453.96 | 164.85 | 338.30 | 396.00 | 236.15 |
| 53 | 340.73 | 339.11 | 190.14 | 421.79 | 581.33 | 807.51 |
| 54 | | | | 337.63 | 130.78 | 557.93 |
| 55 | 0.73 | 0.83 | 0.86 | 0.50 | 1.02 | 0.70 |
| 56 | 0.40 | 0.30 | 0.82 | 0.40 | 0.35 | 0.43 |
| 57 | 0.304 | 0.315 | 0.308 | 0.311 | 8.360 | 0.288 |
| 58 | 0.001 | 0.002 | 0.018 | 0.002 | 0.002 | 0.005 |
| 59 | 0.002 | 0.003 | 0.006 | 0.002 | 0.003 | 0.001 |
| 60 | 0.001 | 0.001 | 0.010 | 0.001 | 0.001 | 0.002 |
| 61 | 0.001 | 0.001 | 0.003 | 0.000 | 0.001 | 0.000 |
| 62 | 0.006 | 0.013 | 0.021 | 0.005 | 0.006 | 0.047 |
| 63 | 0.006 | 0.007 | 0.058 | 0.007 | 0.026 | 0.261 |
| 64 | 0.005 | 0.005 | 0.005 | 0.012 | 0.005 | 0.006 |
| 65 | 0.76 | 1.04 | 0.38 | 0.78 | 24.12 | 0.67 |
| 66 | 0.42 | 0.38 | 0.36 | 0.62 | 8.20 | 0.41 |
| 67 | 0.86 | 0.74 | 0.09 | 1.72 | 0.17 | 0.02 |

Table 139.

TABLE 140

Measured parameters in Tomato accessions (lines 13-18)

| Ecotype/Treatment | Line-13 | Line-14 | Line-15 | Line-16 | Line-17 | Line-18 |
|---|---|---|---|---|---|---|
| 1 | 0.63 | 2.86 | 1.16 | 4.40 | | |
| 2 | 0.57 | 4.38 | 2.02 | 8.13 | 0.87 | 3.66 |
| 3 | 1.39 | 2.27 | 0.45 | 0.42 | | |
| 4 | 2.27 | 7.40 | 2.94 | 11.60 | | |
| 5 | 0.94 | 6.17 | 3.67 | 11.33 | 1.06 | 6.87 |
| 6 | 2.17 | 0.49 | 0.34 | 0.75 | | |
| 7 | 0.94 | 0.68 | 0.40 | 1.44 | 0.46 | 1.07 |
| 8 | 0.51 | 0.71 | 0.31 | 0.47 | 2.65 | 0.38 |
| 9 | 0.35 | 1.06 | 0.21 | 0.48 | 1.72 | 0.34 |
| 10 | 1.08 | 1.17 | 0.92 | 1.09 | 4.04 | 1.21 |
| 11 | 2.14 | 1.65 | 3.01 | 2.29 | 1.53 | 3.17 |
| 12 | 0.75 | 1.76 | 0.63 | 1.11 | 2.62 | 1.09 |
| 13 | 0.98 | 1.34 | 0.38 | 0.84 | 1.15 | 0.73 |
| 14 | 0.41 | 1.21 | 4.59 | 1.70 | 0.49 | 1.93 |
| 15 | 0.41 | 1.62 | 1.76 | 1.42 | 0.57 | 1.41 |
| 16 | 0.14 | 0.40 | 1.44 | 0.50 | 0.41 | 0.66 |
| 17 | 0.14 | 0.53 | 0.55 | 0.41 | 0.47 | 0.48 |
| 18 | 0.35 | 0.33 | 0.31 | 0.29 | 0.83 | 0.34 |
| 19 | 0.12 | 0.25 | 0.61 | 0.31 | 0.09 | 0.35 |
| 20 | 0.14 | 0.17 | 0.09 | 0.11 | 0.35 | 0.10 |
| 21 | 4.72 | 6.83 | 7.10 | 8.21 | 6.40 | 5.92 |
| 22 | 6.71 | 5.87 | 4.16 | 10.29 | | |
| 23 | 5.48 | 8.62 | 6.35 | 6.77 | | |
| 24 | 2.48 | 3.43 | 3.30 | 3.69 | 3.47 | 1.97 |
| 25 | 2.98 | 3.22 | 2.09 | 5.91 | | |
| 26 | 3.09 | 4.69 | 3.87 | 2.91 | | |
| 27 | 0.00 | 0.01 | 0.04 | 0.01 | 0.01 | 0.02 |
| 28 | 0.008 | 0.006 | 0.008 | 0.005 | 0.017 | 0.009 |
| 29 | 0.03 | 0.05 | 0.06 | 0.04 | 0.16 | 0.05 |
| 30 | 0.057 | 0.036 | 0.080 | 0.044 | 0.047 | 0.095 |
| 31 | 0.03 | 0.04 | 0.02 | 0.03 | 0.14 | 0.03 |
| 32 | 0.049 | 0.030 | 0.072 | 0.039 | 0.031 | 0.085 |
| 33 | 12.67 | 6.67 | 9.33 | 8.00 | 19.00 | 5.33 |
| 34 | 7.67 | 9.00 | 10.67 | 9.00 | 5.67 | 19.33 |
| 35 | 1.61 | 1.90 | 1.36 | 1.42 | 0.88 | 1.22 |
| 36 | 2.65 | 1.41 | 1.19 | 1.26 | 2.94 | 0.34 |
| 37 | 20.33 | 12.67 | 12.67 | 11.33 | 16.67 | 6.50 |
| 38 | 1.65 | 0.74 | 0.88 | 0.89 | 3.35 | 0.28 |
| 39 | 77.62 | 100.00 | 63.16 | 75.13 | 72.83 | 76.47 |
| 40 | 55.75 | 75.22 | 63.68 | 62.31 | 72.12 | 74.51 |
| 41 | 0.72 | 0.75 | 1.01 | 0.83 | 0.99 | 0.97 |
| 42 | 90.79 | 68.00 | 59.65 | 72.17 | 74.07 | 99.08 |
| 43 | 1.17 | 0.68 | 0.94 | 0.96 | 1.02 | 1.30 |
| 44 | 1.05 | 0.56 | 1.48 | 0.84 | 0.79 | 1.37 |
| 45 | 160.99 | 379.03 | 531.08 | 650.68 | 140.04 | 317.12 |
| 46 | 365.81 | 212.93 | 84.94 | 469.87 | | |
| 47 | 43.60 | 54.50 | 41.60 | 59.10 | 49.70 | 37.20 |
| 48 | 35.38 | 30.60 | 38.97 | 37.46 | 28.47 | 39.04 |
| 49 | 33.82 | 54.47 | 26.25 | 44.43 | 36.17 | 28.45 |
| 50 | 39.00 | 45.00 | 65.30 | 51.90 | 38.40 | 39.40 |
| 51 | 0.89 | 0.83 | 1.57 | 0.88 | 0.77 | 1.06 |
| 52 | 174.58 | 441.78 | 489.18 | 707.80 | 565.93 | 384.77 |
| 53 | 784.06 | 351.80 | 255.78 | 1078.10 | | |
| 54 | 176.67 | 791.86 | 517.05 | 832.27 | | |
| 55 | 0.38 | 0.66 | 0.70 | 0.33 | 1.17 | 0.34 |
| 56 | 0.35 | 0.45 | 0.28 | 0.47 | 0.53 | 0.37 |
| 57 | 0.34 | 0.44 | 0.27 | 0.43 | 0.37 | 0.41 |
| 58 | 0.001 | 0.001 | 0.003 | 0.001 | 0.003 | 0.002 |
| 59 | 0.001 | 0.002 | 0.004 | 0.001 | | |
| 60 | 0.001 | 0.001 | 0.003 | 0.001 | 0.001 | 0.002 |
| 61 | 0.000 | 0.001 | 0.001 | 0.000 | | |
| 62 | 0.357 | 0.037 | 0.626 | | 0.024 | 0.191 |
| 63 | 0.029 | 0.005 | 0.003 | 0.009 | 0.048 | 0.008 |
| 64 | 0.30 | 0.14 | 0.04 | 0.09 | 0.01 | 0.19 |
| 65 | 0.97 | 0.99 | 0.95 | 0.91 | 0.69 | 1.11 |
| 66 | 0.91 | 0.67 | 0.38 | 1.31 | 0.32 | 1.19 |
| 67 | 10.50 | 27.89 | 11.79 | 9.98 | 0.19 | 24.37 |

Table 140. Provided are the values of each of the parameters (as described above) measured in tomato accessions (Seed ID) under all growth conditions. Growth conditions are specified in the experimental procedure section.

TABLE 141

Correlation between the expression level of selected genes of some embodiments of the invention in various tissues and the phenotypic performance under normal and stress conditions across tomato ecotypes

| Gene Name | R | P value | Exp. set | Corr. Set ID | Gene Name | R | P value | Exp. set | Corr. Set ID |
|---|---|---|---|---|---|---|---|---|---|
| LBY212 | 0.70 | 5.16E−02 | 2 | 46 | LBY212 | 0.82 | 1.29E−02 | 2 | 53 |
| LBY213 | 0.71 | 2.23E−02 | 4 | 45 | LBY213 | 0.86 | 1.27E−03 | 4 | 2 |
| LBY213 | 0.86 | 1.45E−03 | 4 | 5 | LBY213 | 0.71 | 2.11E−02 | 4 | 7 |

Table 141. Provided are the correlations (R) between the expression levels yield improving genes and their homologs in various tissues [Expression (Exp) sets, Table 136] and the phenotypic performance [yield, biomass, growth rate and/or vigor components described in Tables 138-140 using the correlation vectors (Corr.) described in Table 137] under normal, low N and drought conditions across tomato ecotypes. P = p value.

II. Correlation of early vigor traits across collection of Tomato ecotypes under 300 mM NaCl, low nitrogen and normal growth conditions—Ten tomato hybrids were grown in 3 repetitive plots, each containing 17 plants, at a net house under semi-hydroponics conditions. Briefly, the growing protocol was as follows: Tomato seeds were sown in trays filled with a mix of vermiculite and peat in a 1:1 ratio. Following germination, the trays were transferred to the high salinity solution (300 mM NaCl in addition to the Full Hoagland solution), low nitrogen solution (the amount of total nitrogen was reduced in a 90% from the full Hoagland solution, final amount of 0.8 mM N), or at Normal growth solution (Full Hoagland containing 8 mM N solution, at 28±2° C.). All the plants were grown at 28±2° C.

Full Hoagland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8.

Analyzed tomato tissues—All 10 selected Tomato varieties were sample per each treatment. Two types of tissues [leaves and roots] were sampled and RNA was extracted as described above. For convenience, each micro-array expression information tissue type has received a Set ID as summarized in Table 142 below.

TABLE 142

Tomato transcriptome expression sets

| Expression Set | Set IDs |
|---|---|
| Leaf-normal conditions | 1 + 10 |
| Root-normal conditions | 2 + 9 |
| Leaf-low nitrogen conditions | 3 + 8 |
| Root-low nitrogen conditions | 4 + 7 |
| Leaf-salinity conditions | 5 + 12 |
| Root-salinity conditions | 6 + 11 |

Table 142. Provided are the tomato transcriptome experimental sets.

Tomato vigor related parameters—following 5 weeks of growing, plant were harvested and analyzed for leaf number, plant height, chlorophyll levels (SPAD units), different indices of nitrogen use efficiency (NUE) and plant biomass. Next, analyzed data was saved to text files and processed using the JMP statistical analysis software (SAS institute). Data parameters collected are summarized in Table 143, herein below.

Leaf number—number of opened leaves.

RGR Leaf Number—was calculated based on Formula VIII (above).

Shoot/Root ratio—was calculated based on Formula XXX (above).

NUE total biomass—nitrogen use efficiency (NUE) calculated as total biomass divided by nitrogen concentration.

NUE root biomass—nitrogen use efficiency (NUE) of root growth calculated as root biomass divided by nitrogen concentration.

NUE shoot biomass—nitrogen use efficiency (NUE) of shoot growth calculated as shoot biomass divided by nitrogen concentration.

Percent of reduction of root biomass compared to normal—the difference (reduction in percent) between root biomass under normal and under low nitrogen conditions.

Percent of reduction of shoot biomass compared to normal—the difference (reduction in percent) between shoot biomass under normal and under low nitrogen conditions.

Percent of reduction of total biomass compared to normal—the difference (reduction in percent) between total biomass (shoot and root) under normal and under low nitrogen conditions.

Plant height—Plants were characterized for height during growing period at 5 time points. In each measure, plants were measured for their height using a measuring tape. Height was measured from ground level to top of the longest leaf.

SPAD [SPAD unit]—Chlorophyll content was determined using a Minolta SPAD 502 chlorophyll meter and measurement was performed 64 days post sowing. SPAD meter readings were done on young fully developed leaf. Three measurements per leaf were taken per plot.

Root Biomass [DW, gr.]/SPAD—root biomass divided by SPAD results.

Shoot Biomass [DW, gr.]/SPAD—shoot biomass divided by SPAD results.

Total Biomass (Root+Shoot) [DW, gr.]/SPAD—total biomass divided by SPAD results.

TABLE 143

Tomato correlated parameters (vectors)

| Correlated parameter with | Correlation ID |
|---|---|
| Leaf number (Low N conditions/Normal conditions) [ratio] | 1 |
| Leaf number (Salinity conditions/Normal conditions) [ratio] | 2 |
| Leaf number (Salinity conditions/Low N conditions) [ratio] | 3 |
| N level/Leaf [SPAD unit/leaf] (Low N conditions, Normal conditions and salinity conditions) | 4 |
| NUE roots (Root Biomass DW/SPAD) [gr./SPAD unit] (Low N conditions and Normal conditions) | 5 |
| NUE shoots (shoot Biomass DW/SPAD) [gr./SPAD unit] (Low N conditions and Normal conditions) | 6 |

TABLE 143-continued

Tomato correlated parameters (vectors)

| Correlated parameter with | Correlation ID |
|---|---|
| NUE total biomass (Total Biomass DW/SPAD) [gr./SPAD unit] (Low N conditions and Normal conditions) | 7 |
| Percent of reduction of root biomass compared to normal [%] (Low N conditions/Normal conditions) [ratio] | 8 |
| Percent of reduction of shoot biomass compared to normal [%] (Low N conditions/Normal conditions) [ratio] | 9 |
| Plant Height (Low N conditions /Normal conditions) [ratio] | 10 |
| Plant Height (Salinity conditions /Low N conditions) [ratio] | 11 |
| Plant Height (Salinity conditions /Normal conditions) [ratio] | 12 |
| Plant biomass (Salinity conditions) [gr.] | 13 |
| Plant height (Low N conditions) [cm] | 14 |
| Plant height (Salinity conditions) [cm] | 15 |
| Plant height (Normal conditions) [cm] | 16 |
| NUE Root Biomass DW/SPAD [gr./SPAD unit] (Low N conditions and Normal conditions) | 17 |
| SPAD (Low N conditions/Normal conditions) [ratio] | 18 |
| SPAD (Low N conditions) [SPAD unit] | 19 |
| SPAD (Normal conditions) [SPAD unit] | 20 |
| NUE Shoot Biomass DW/SPAD [gr./SPAD unit] (Low N conditions, Normal conditions and salinity conditions) | 21 |
| Shoot/Root [ratio] (Low N conditions and Normal conditions) | 22 |
| NUE Total Biomass (Root + Shoot DW)/SPAD [gr/SPAD unit] (Low N conditions, Normal conditions and salinity conditions) | 23 |
| Plant height (Normal conditions) [cm] | 24 |
| Leaf number (Low N conditions) [number] | 25 |
| Leaf number (Normal conditions) [number] | 26 |
| Leaf number (Salinity conditions) [number] | 27 |

Table 143. Provided are the tomato correlated parameters. "NUE" = nitrogen use efficiency; "DW" = dry weight; "cm" = centimeter; "num"–number; "SPAD" = chlorophyll levels; "gr" = gram;

Experiment Results 10 different Tomato varieties were grown and characterized for parameters as described above (Table 143). The average for each of the measured parameter was calculated using the JMP software and values are summarized in Tables 144-147 below. Subsequent correlation analysis was conducted (Table 148). Follow, results were integrated to the database.

TABLE 144

Measured parameters in Tomato accessions under low nitrogen conditions

| Line/Corr. ID | 1 | 10 | 14 | 18 | 19 | 24 | 25 | 4 | 5 |
|---|---|---|---|---|---|---|---|---|---|
| Line-1 | 0.85 | 0.810 | 36.78 | 1.01 | 34.57 | 45.33 | 5.56 | 10.854 | 6.99 |
| Line-2 | 0.90 | 0.830 | 39.89 | 0.98 | 24.87 | 47.78 | 6.22 | 11.409 | 2.54 |
| Line-3 | 0.98 | 0.840 | 34.44 | 1.02 | 28.58 | 40.78 | 7.22 | | |
| Line-4 | 1.09 | 0.850 | 47.00 | 1.00 | 31.58 | 55.33 | 6.78 | 10.438 | 7.04 |
| Line-5 | 0.88 | 0.830 | 46.44 | 0.98 | 29.72 | 56.22 | 5.56 | 11.169 | 5.04 |
| Line-6 | 1.02 | 0.930 | 45.44 | 0.98 | 31.83 | 48.67 | 6.56 | 8.929 | 8.01 |
| Line-7 | 0.87 | 0.850 | 47.67 | 0.93 | 30.33 | 55.78 | 5.11 | 7.926 | 15.09 |
| Line-8 | 1.06 | 1.050 | 39.33 | 1.05 | 30.29 | 37.44 | 5.89 | 7.993 | 9.02 |
| Line-9 | 0.91 | 0.840 | 41.78 | 1.01 | 31.32 | 49.56 | 5.56 | 10.304 | 8.78 |
| Line-10 | 1.12 | 0.880 | 41.00 | 0.99 | 28.77 | 46.33 | 6.33 | 8.585 | 7.25 |
| Line-11 | | | | | | | | 11.528 | 7.73 |
| Line-12 | | | | | | | | 14.491 | 15.94 |

Table 144. Provided are the values of each of the parameters (as described above) measured in Tomato accessions (Line) under low nitrogen growth conditions. Growth conditions are specified in the experimental procedure section.

TABLE 145

Additional measured parameters in Tomato accessions under low nitrogen conditions

| Line/Corr. ID | 6 | 7 | 8 | 9 | 17 | 21 | 22 | 23 |
|---|---|---|---|---|---|---|---|---|
| Line-1 | 35.35 | 58.47 | 62.592 | 75.380 | 0.00082 | 0.0041 | 5.010 | 0.0050 |
| Line-2 | 24.09 | 63.75 | 54.158 | 55.112 | 0.00032 | 0.0030 | 11.393 | 0.0034 |
| Line-3 | | | | | | | | |
| Line-4 | 65.02 | 69.29 | 70.547 | 49.726 | 0.00079 | 0.0072 | 9.494 | 0.0080 |
| Line-5 | 46.71 | 71.1 | 59.685 | 63.189 | 0.00055 | 0.0049 | 11.600 | 0.0055 |
| Line-6 | 46.67 | 60.54 | 96.129 | 82.667 | 0.00086 | 0.0052 | 8.200 | 0.0060 |
| Line-7 | 120.07 | 73.9 | 106.502 | 66.924 | 0.00139 | 0.0115 | 10.375 | 0.0129 |
| Line-8 | 60.09 | 68.81 | 111.905 | 107.982 | 0.00103 | 0.0069 | 10.523 | 0.0079 |
| Line-9 | 66.27 | 66.74 | 81.644 | 55.401 | 0.00088 | 0.0068 | 8.242 | 0.0077 |
| Line-10 | 56.46 | 70.82 | 32.214 | 54.433 | 0.00086 | 0.0067 | 7.967 | 0.0076 |
| Line-11 | 38.35 | 69.7 | 143.714 | 62.155 | 0.00085 | 0.0042 | 6.414 | 0.0050 |
| Line-12 | 60.32 | 49.72 | 87.471 | 59.746 | 0.00148 | 0.0056 | 3.909 | 0.0070 |

Table 145. Provided are the values of each of the parameters (as described above) measured in Tomato accessions (Line) under low nitrogen growth conditions. Growth conditions are specified in the experimental procedure section.

TABLE 146

Measured parameters in Tomato accessions under normal conditions

| Line/Corr. ID | 16 | 20 | 26 | 4 | 5 | 6 | 7 | 17 | 21 | 22 | 23 |
|---|---|---|---|---|---|---|---|---|---|---|---|
| Line-1 | 45.33 | 34.30 | 6.56 | 9.29 | 1.12 | 4.69 | 7.47 | 0.0012 | 0.0052 | 5.40 | 0.0064 |
| Line-2 | 47.78 | 25.31 | 6.89 | 8.87 | 0.47 | 4.37 | 8.63 | 0.0006 | 0.0052 | 10.02 | 0.0058 |
| Line-3 | 40.78 | 28.12 | 7.33 | | | | | | | | |
| Line-4 | 55.33 | 31.43 | 6.22 | 8.43 | 1 | 13.08 | 8.85 | 0.0011 | 0.0144 | 15.42 | 0.0155 |
| Line-5 | 56.22 | 30.24 | 6.33 | 9.83 | 0.84 | 7.39 | 7.22 | 0.0010 | 0.0084 | 8.83 | 0.0093 |
| Line-6 | 48.67 | 32.43 | 6.44 | 8.57 | 0.83 | 5.65 | 7.87 | 0.0011 | 0.0054 | 7.52 | 0.0065 |
| Line-7 | 55.78 | 32.58 | 5.89 | 6.57 | 0.94 | 17.94 | 9.09 | 0.0014 | 0.0174 | 12.61 | 0.0188 |
| Line-8 | 37.44 | 28.77 | 5.56 | 6.97 | 0.81 | 5.56 | 7.91 | 0.0010 | 0.0072 | 7.99 | 0.0082 |
| Line-9 | 49.56 | 30.92 | 6.11 | 8.71 | 1.08 | 11.96 | 8.55 | 0.0010 | 0.0109 | 14.31 | 0.0119 |
| Line-10 | 46.33 | 28.99 | 5.67 | 7.35 | 2.25 | 10.37 | 8.68 | 0.0025 | 0.0117 | 4.80 | 0.0143 |
| Line-11 | | | | 10.18 | 0.54 | 6.17 | 9.1 | 0.0005 | 0.0061 | 12.65 | 0.0066 |
| Line-12 | | | | 9.37 | 1.82 | 10.1 | 6.24 | 0.0017 | 0.0094 | 6.29 | 0.0110 |

Table 146. Provided are the values of each of the parameters (as described above) measured in Tomato accessions (Line) under normal growth conditions. Growth conditions are specified in the experimental procedure section.

TABLE 147

Measured parameters in Tomato accessions under salinity conditions

| Line/Corr. ID | 2 | 3 | 11 | 12 | 13 | 15 | 27 | 4 | 21 | 17 | 23 |
|---|---|---|---|---|---|---|---|---|---|---|---|
| Line-1 | 0.54 | 0.64 | 0.15 | 0.12 | 0.36 | 5.60 | 3.56 | 11.40 | 0.0005 | 0.000060 | 0.0007 |
| Line-2 | 0.57 | 0.63 | 0.16 | 0.14 | 0.44 | 6.46 | 3.94 | 11.64 | 0.0007 | 0.000107 | 0.0008 |
| Line-3 | 0.68 | 0.69 | 0.25 | 0.21 | 0.26 | 8.47 | 5.00 | | | | |
| Line-4 | 0.64 | 0.59 | 0.18 | 0.15 | 0.71 | 8.56 | 4.00 | 10.79 | 0.0012 | 0.000095 | 0.0014 |
| Line-5 | 0.56 | 0.64 | 0.19 | 0.16 | 0.46 | 8.87 | 3.56 | 10.78 | 0.0017 | 0.000068 | 0.0018 |
| Line-6 | 0.68 | 0.67 | 0.17 | 0.16 | 0.54 | 7.56 | 4.39 | 6.95 | 0.0010 | 0.000087 | 0.0011 |
| Line-7 | 0.54 | 0.62 | 0.18 | 0.15 | 0.66 | 8.64 | 3.17 | 9.21 | 0.0012 | 0.000099 | 0.0013 |
| Line-8 | 0.67 | 0.63 | 0.14 | 0.15 | 0.40 | 5.57 | 3.72 | 8.54 | 0.0007 | 0.000083 | 0.0008 |
| Line-9 | 0.65 | 0.72 | 0.14 | 0.12 | 0.52 | 5.82 | 4.00 | 10.37 | 0.0010 | 0.000094 | 0.0011 |
| Line-10 | 0.75 | 0.68 | 0.23 | 0.20 | 0.45 | 9.36 | 4.28 | 8.84 | 0.0010 | | |
| Line-11 | | | | | | | | 10.43 | 0.0007 | 0.000054 | 0.0006 |
| Line-12 | | | | | | | | 12.43 | 0.0007 | 0.000055 | 0.0007 |

Table 147. Provided are the values of each of the parameters (as described above) measured in Tomato accessions (Line) under salinity growth conditions. Growth conditions are specified in the experimental procedure section.

TABLE 148

Correlation between the expression level of selected genes of some embodiments of the invention in various tissues and the phenotypic performance under low nitrogen, normal or salinity stress conditions across Tomato accessions

| Gene Name | R | P value | Exp. set | Corr. Set ID | Gene Name | R | P value | Exp. set | Corr. Set ID |
|---|---|---|---|---|---|---|---|---|---|
| LBY212 | 0.75 | 3.13E−02 | 3 | 25 | LBY213 | 0.81 | 1.38E−02 | 3 | 10 |
| LBY213 | 0.85 | 3.95E−03 | 3 | 9 | LBY213 | 0.74 | 2.18E−02 | 3 | 8 |

Table 148. Provided are the correlations (R) between the genes expression levels in various tissues and the phenotypic performance Corr. ID-correlation set ID according to the correlated parameters specified in Table 143. Exp. Set-Expression set specified in Table 142. R = Pearson correlation coefficient; P = p value.

Example 17

Plant Fiber Development in Cotton Production of Cotton Transcriptome and High Throughput Correlation Analysis Using Cotton Oligonucleotide Microarray In order to conduct high throughput gene expression correlation analysis, the present inventors used cotton oligonucleotide microarray, designed and produced by "Comparative Evolutionary Genomics of Cotton" [cottonevolution (dot) info/]. This Cotton Oligonucleotide Microarray is composed of 12,006 Integrated DNA Technologies (IDT) oligonucleotides derived from an assembly of more than 180,000 *Gossypium* ESTs sequenced from 30 cDNA libraries. For additional details see PCT/IL2005/000627 and PCT/IL2007/001590 which are fully incorporated herein by reference.

TABLE 149

Cotton transcriptome experimental sets

| Expression Set | Set ID |
|---|---|
| cotton fiber 5d | 1 |
| cotton fiber 15d | 2 |
| cotton fiber 10d | 3 |

Table 149. Provided are the cotton transcriptome expression sets. "5d" = 5 days post anthesis; "10d" = 10 days post anthesis; "15d" = 15 days post anthesis. "DPA" = days-past-anthesis.

In order to define correlations between the levels of RNA expression and fiber length, fibers from 8 different cotton lines were analyzed. These fibers were selected showing very good fiber quality and high lint index (Pima types, originating from other cotton species, namely *G. barbadense*), different levels of quality and lint indexes from various *G. hirsutum* lines: good quality and high lint index (Acala type), and poor quality and short lint index (Tamcot type, and old varieties). A summary of the fiber length of the different lines is provided in Table 150.

Experimental Procedures

RNA extraction—Fiber development stages, representing different fiber characteristics, at 5, 10 and 15 DPA were sampled and RNA was extracted as described above.

Fiber length assessment—Fiber length of the selected cotton lines was measured using fibrograph. The fibrograph system was used to compute length in terms of "Upper Half Mean" length. The upper half mean (UHM) is the average length of longer half of the fiber distribution. The fibrograph measures length in span lengths at a given percentage point World Wide Web (dot) cottoninc (dot) com/Classification-ofCotton/?Pg=4#Length].

Experimental Results

Eight different cotton lines were grown, and their fiber length was measured. The fibers UHM values are summarized in Table 150 herein below. The R square was calculated (Table 151).

TABLE 150

Summary of the fiber length of the 8 different cotton lines

| Line/Correlation ID | Fiber Length (UHM) |
|---|---|
| Line-1 | 1.21 |
| Line-2 | 1.10 |
| Line-3 | 1.36 |
| Line-4 | 1.26 |
| Line-5 | 0.89 |
| Line-6 | 1.01 |
| Line-7 | 1.06 |
| Line-8 | 1.15 |

Table 150: Presented are the fiber length means of 8 different cotton lines.

TABLE 151

Correlation between the expression level of selected genes of some embodiments of the invention in various tissues and the phenotypic performance under normal conditions in cotton

| Gene Name | R | P value | Exp. set | Corr. Set ID | Gene Name | R | P value | Exp. set | Corr. Set ID |
|---|---|---|---|---|---|---|---|---|---|
| LBY48 | 0.73 | 6.24E−02 | 3 | 1 | LBY53 | 0.74 | 3.67E−02 | 2 | 1 |
| LBY93 | 0.81 | 1.59E−02 | 1 | 1 | LBY96 | 0.73 | 4.06E−02 | 2 | 1 |

Table 151. Correlations (R) between the genes expression levels in various tissues and the phenotypic performance. Corr. = correlation; set ID 1 = fiber length. Exp. Set- Expression set (according to Table 149). R = Pearson correlation coefficient; P = p value.

Example 18

Production of Cotton Transcriptome and High Throughput Correlation Analysis with Yield and ABST Related Parameters Using 60K Cotton Oligonucleotide Micro-Arrays In order to produce a high throughput correlation analysis between plant phenotype and gene expression level, the present inventors utilized a cotton oligonucleotide microarray, produced by Agilent Technologies [chem. (dot) agilent (dot) com/Scripts/PDS (dot) asp?1Page=50879]. The array oligonucleotide represents about 60,000 cotton genes and transcripts. In order to define correlations between the levels of RNA expression with ABST and yield and components or vigor related parameters, various plant characteristics of 13 different cotton ecotypes were analyzed and further used for RNA expression analysis. The correlation between the RNA levels and the characterized parameters was analyzed using Pearson correlation test [davidmlane (dot) com/hyperstat/A34739 (dot) html].

Correlation of Cotton Varieties Across Ecotypes Grown Under Regular and Drought Growth Conditions Experimental Procedures 13 Cotton ecotypes were grown in 5-11 repetitive plots, in field. Briefly, the growing protocol was as follows:

Regular growth conditions: Cotton plants were grown in the field using commercial fertilization and irrigation protocols [623 $m^3$ water per dunam (1000 square meters) per entire growth period, fertilization of 24 units of 12% nitrogen, 12 units of 6% phosphorous and 12 units of 6% potassium per entire growth periods]. Plot size was of 5 meter long, two rows, 8 plants per meter.

Drought growth conditions: Cotton seeds were sown in soil and grown under normal condition until first squares were visible (40 days from sowing), and then drought treatment was induced by irrigating with 75% water in comparison to the normal treatment [472 $m^3$ water per dunam (1000 square meters) per entire growth period], while maintaining normal fertilization.

Analyzed Cotton tissues—Eight tissues [mature leaf, lower and upper main stem, flower, main mature boll, fruit, ovule with fiber (Day) and ovule with fiber (Night)] from plants growing under normal conditions were sampled and RNA was extracted as described above.

Eight tissues [mature leaf (Day), mature leaf (Night), lower main stem, upper main stem, main flower, main mature boll, ovule and fiber (Day) and ovule with fiber (night)] from plants growing under drought conditions were sampled and RNA was extracted as described above.

Each micro-array expression information tissue type has received a Set ID as summarized in Tables 152-154 below.

TABLE 152

Cotton transcriptome expression sets under normal conditions (normal expression set 1)

| Expression Set | Set ID |
| --- | --- |
| Fruit at 10 DPA at reproductive stage under normal growth conditions | 1 |
| Lower main stem at reproductive stage under normal growth conditions | 2 |
| Main flower at reproductive stage under normal growth conditions | 3 |
| Main mature boll at reproductive stage under normal growth conditions | 4 |
| Mature leaf (day) at reproductive stage normal growth conditions | 5 |
| Mature leaf (night) at reproductive stage normal growth conditions | 6 |
| Ovule and fiber (day) at reproductive stage normal growth conditions | 7 |
| Ovule and fiber (night) at reproductive stage normal growth conditions | 8 |
| Upper main stem at reproductive stage under normal growth conditions | 9 |

Table 152: Provided are the cotton transcriptome expression sets. "Mature leaf" = Full expanded leaf; Lower main stem = the main stem adjacent to main mature boll; Upper main stem = the main stem adjacent to the main flower; Main flower = reproductive organ on the third position on the main stem (position 3); Fruit at 10 DPA = reproductive organ ten days after anthesis on the main stem (position 2); Main mature boll = reproductive organ on the first position on the main stem (position 1). "DPA" = days post anthesis.

TABLE 153

Additional Cotton transcriptome expression sets under normal conditions (normal expression set 2)

| Expression Set | Set ID |
| --- | --- |
| Mature leaf at reproductive stage during day under normal growth conditions | 1 |
| Ovule and fiber at reproductive stage during day under normal growth conditions | 2 |
| Ovule and fiber at reproductive stage during night under normal growth conditions | 3 |

Table 153: Provided are the cotton transcriptome expression sets. "Mature leaf" = Full expanded leaf; Ovule and fiber were sampled either at day or night hours.

TABLE 154

Cotton transcriptome expression sets under drought conditions (drought expression set 1)

| Expression Set | Set ID |
| --- | --- |
| Lower main stem at reproductive stage under drought growth conditions | 1 |
| Main flower at reproductive stage under drought growth conditions | 2 |
| Main mature boll at reproductive stage under drought growth conditions | 3 |
| Mature leaf during night at reproductive stage under drought growth conditions | 4 |
| Ovule with fiber at reproductive stage during day under drought growth conditions | 5 |
| Ovule with fiber at reproductive stage during night under drought growth conditions | 6 |
| Upper main stem at reproductive stage under drought growth conditions | 7 |

Table 154: Provided are the cotton transcriptome expression sets. Lower main stem = the main stem adjacent to main mature boll; Upper main stem = the main stem adjacent to the main flower; Main flower = reproductive organ on the third position on the main stem (position 3); Main mature boll = reproductive organ on the first position on the main stem (position 1); Ovule and fiber were sampled either at day or night hours.

Cotton yield components and vigor related parameters assessment—13 Cotton ecotypes in 5-11 repetitive plots, each plot containing approximately 80 plants were grown in field. Plants were regularly fertilized and watered during plant growth until harvesting (as recommended for commercial growth). Plants were continuously phenotyped during the growth period and at harvest (Tables 155-156). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The following parameters were measured and collected:
Total Bolls yield (RP) [gr.]—Total boll weight (including fiber) per plot.
Total bolls yield per plant (RP) [gr.]—Total boll weight (including fiber) per plot divided by the number of plants.
Fiber yield (RP) [gr.]—Total fiber weight per plot.
Fiber yield per plant (RP) [gr.]—Total fiber weight in plot divided by the number of plants.
Fiber yield per boll (RP) [gr.]-Total fiber weight in plot divided by the number of bolls.
Estimated Average Fiber yield (MB) po_1 (H) [gr.]—Weight of the fiber on the main branch in position 1 at harvest.
Estimated Average Fiber yield (MB) po_3 (H) [gr.]—Weight of the fiber on the main branch in position 3 at harvest.

Estimated Average Bolls FW (MB) po_1 (H) [gr.]—Weight of the fiber on the main branch in position 1 at harvest.

Estimated Average Bolls FW (MB) po_3 (H) [gr.]—Weight of the fiber on the main branch in position 3 at harvest.

Fiber Length (RP)—Measure Fiber Length in inch from the rest of the plot.

Fiber Length Position 1 (SP)—Fiber length at position 1 from the selected plants. Measure Fiber Length in inch.

Fiber Length Position 3 (SP)—Fiber length at position 3 from the selected plants. Measure Fiber Length in inch.

Fiber Strength (RP)—Fiber Strength from the rest of the plot. Measured in grams per denier.

Fiber Strength Position 3 (SP)—Fiber strength at position 3 from the selected plants. Measured in grams per denier.

Micronaire (RP)—fiber fineness and maturity from the rest of the plot. The scale that was used was 3.7-4.2-for Premium; 4.3-4.9-Base Range; above 5-Discount Range.

Micronaire Position 1 (SP)—fiber fineness and maturity from position 1 from the selected plants. The scale that was used was 3.7-4.2-for Premium; 4.3-4.9-Base Range; above 5-Discount Range.

Micronaire Position 3 (SP)—fiber fineness and maturity from position 3 from the selected plants. The scale that was used was 3.7-4.2-for Premium; 4.3-4.9-Base Range; above 5-Discount Range.

Short Fiber Content (RP (%)—short fiber content from the rest of the plot.

Uniformity (RP) (%)—fiber uniformity from the rest of the plot.

Carbon isotope discrimination—(‰)—isotopic ratio of 13 C to 12 C in plant tissue was compared to the isotopic ratio of 13 C to 12 C in the atmosphere measured in units of Per-mille (‰), i.e., parts per thousand, e.g., 1‰=$\frac{1}{1000}$=0.001.

Leaf temp (V) (° celsius)—leaf temperature was measured at vegetative stage using Fluke IR thermometer 568 device. Measurements were done on 4 plants per plot.

Leaf temp (10DPA) (° celsius)—Leaf temperature was measured 10 days post anthesis using Fluke IR thermometer 568 device. Measurements were done on 4 plants per plot.

Stomatal conductance (10DPA)—(mmol $m^{-2}$ $s^{-1}$)—plants were evaluated for their stomata conductance using SC-1 Leaf Porometer (Decagon devices) 10 days post anthesis. Stomata conductance readings were done on fully developed leaf, for 2 leaves and 2 plants per plot.

Stomatal conductance (17DPA)—(mmol $m^{-2}$ $s^{-1}$)—plants were evaluated for their stomata conductance using SC-1 Leaf Porometer (Decagon devices) 17 days post anthesis. Stomata conductance readings were done on fully developed leaf, for 2 leaves and 2 plants per plot.

% Canopy coverage (10DPA) (F)—percent Canopy coverage 10 days post anthesis and at flowering stage. The % Canopy coverage is calculated using Formula XXXII above.

Leaf area (10 DPA) ($cm^2$)—Total green leaves area 10 days post anthesis.

PAR_LAI (10 DPA)—Photosynthetically active radiation 10 days post anthesis.

SPAD (17 DPA) [SPAD unit]—Plants were characterized for SPAD rate 17 days post anthesis. Chlorophyll content was determined using a Minolta SPAD 502 chlorophyll meter. Four measurements per leaf were taken per plot.

SPAD (pre F)—Plants were characterized for SPAD rate during pre-flowering stage. Chlorophyll content was determined using a Minolta SPAD 502 chlorophyll meter. Four measurements per leaf were taken per plot.

SPAD rate—the relative growth rate (RGR) of SPAD (Formula IV) as described above.

Leaf mass fraction (10DPA) [$cm^2/g$]—leaf mass fraction 10 days post anthesis. The leaf mass fraction is calculated using Formula XXXIII above.

Lower Stem width (H) [mm]—This parameter was measured at harvest. Lower internodes from 8 plants per plot were separated from the plant and the diameter was measured using a caliber. The average internode width per plant was calculated by dividing the total stem width by the number of plants.

Upper Stem width (H) [mm]—This parameter was measured at harvest. Upper internodes from 8 plants per plot were separated from the plant and the diameter was measured using a caliber. The average internode width per plant was calculated by dividing the total stem width by the number of plants.

Plant height (H) [cm]—plants were measured for their height at harvest using a measuring tape. Height of main stem was measured from ground to apical meristem base. Average of eight plants per plot was calculated.

Plant height growth [cm/day]—the relative growth rate (RGR) of Plant Height (Formula III above) as described above.

Shoot DW (V) [gr.]—Shoot dry weight at vegetative stage after drying at 70° C. in oven for 48 hours. Total weight of 3 plants in a plot.

Shoot DW (10DPA) [gr.]—Shoot dry weight at 10 days post anthesis, after drying at 70° C. in oven for 48 hours. Total weight of 3 plants in a plot.

Bolls number per plant (RP) [num]—Average bolls number per plant from the rest of the plot.

Reproductive period duration [num]—number of days from flowering to harvest for each plot.

Closed Bolls number per plant (RP) [num]—Average closed bolls number per plant from the rest of the plot.

Closed Bolls number per plant (SP) [num]—Average closed bolls number per plant from selected plants.

Open Bolls number per plant (SP) [num]—Average open bolls number per plant from selected plants, average of eight plants per plot.

Number of lateral branches with open bolls (H) [num]—count of number of lateral branches with open bolls at harvest, average of eight plants per plot.

Number of nodes with open bolls (MS) (H) [num]—count of number of nodes with open bolls on main stem at harvest, average of eight plants per plot.

Seeds yield per plant (RP) [gr.]—Total weight of seeds in plot divided in plants number.

Estimated Average Seeds yield (MB) po_1 (H) [gr.]—Total weight of seeds in position one per plot divided by plants number.

Estimated Average Seeds yield (MB) po_3 (H) [gr.]—Total weight of seeds in position three per plot divided by plants number.

Estimated Average Seeds number (MB) po_1 (H) [num]—Total number of seeds in position one per plot divided by plants number.

Estimated Average Seeds number (MB) po_3 (H) [num]—Total number of seeds in position three per plot divided by plants number.

1000 seeds weight (RP) [gr.]—was calculated based on Formula XIV.

Experimental Results 13 different cotton varieties were grown and characterized for different parameters (Tables 155-160). The average for each of the measured parameter was calculated using the JMP software (Tables 157-162) and a subsequent correlation analysis between the various transcriptome sets (Tables 152-154) and the average parameters, was conducted (Tables 163-165). Results were then integrated to the database.

TABLE 155

Cotton correlated parameters under normal growth conditions (vectors) (parameters set 1)

| Correlated parameter with | Correlation ID |
| --- | --- |
| % Canopy coverage (10 DPA) [%] | 1 |
| 1000 seeds weight (RP) [gr.] | 2 |
| Bolls num per plant (RP) [number] | 3 |
| Closed Bolls num per plant (RP) [number] | 4 |
| Closed Bolls num per plant (SP) [number] | 5 |
| Fiber Length (RP) [in] | 6 |
| Fiber Length Position 3 (SP) [in] | 7 |
| Fiber Strength (RP) [in] | 8 |
| Fiber Strength Position 3 (SP) [gr./denier] | 9 |
| Fiber yield per boll (RP) [gr.] | 10 |
| Fiber yield per plant (RP) [gr.] | 11 |
| Leaf area (10 DPA) [cm$^2$] | 12 |
| Lower Stem width (H) [mm] | 13 |
| Micronaire (RP) [scoring 3.7-5] | 14 |
| Micronaire Position 3 (SP) [scoring 3.7-5] | 15 |
| Num of lateral branches with open bolls (H) [number] | 16 |
| Num of nodes with open bolls (MS) (H) [number] | 17 |
| Open Bolls num per plant (SP) [number] | 18 |
| PAR_LAI (10 DPA) [µmol m$^{-2}$ S$^{-1}$] | 19 |
| Plant height (H) [cm] | 20 |
| Plant height growth [cm/day] | 21 |
| Reproductive period duration [number] | 22 |
| SPAD (17 DPA) [SPAD unit] | 23 |
| SPAD (pre F) [SPAD unit] | 24 |
| SPAD rate [SPAD unit/day] | 25 |
| Seeds yield per plant (RP) [gr.] | 26 |
| Shoot DW (10 DPA) [gr.] | 27 |
| Shoot DW (V) [gr.] | 28 |
| Shoot FW (10 DPA) [gr.] | 29 |
| Shoot FW (V) [gr.] | 30 |
| Total Bolls yield (SP) [gr.] | 31 |
| Upper Stem width (H) [mm] | 32 |
| bolls num in position 1 [number] | 33 |
| bolls num in position 3 [number] | 34 |
| estimated Avr Bolls FW (MB) po_1 (H) [gr.] | 35 |
| estimated Avr Bolls FW (MB) po_3 (H) [gr.] | 36 |
| estimated Avr Fiber yield (MB) po_1 (H) [gr.] | 37 |
| estimated Avr Fiber yield (MB) po_3 (H) [gr.] | 38 |
| estimated Avr Seeds num (MB) po_1 (H) [number] | 39 |
| estimated Avr Seeds num (MB) po_3 (H) [number] | 40 |
| estimated Avr Seeds yield (MB) po_1 (H) [gr.] | 41 |
| estimated Avr Seeds yield (MB) po_3 (H) [gr.] | 42 |
| Leaf mass fraction (10 DPA) [cm$^2$/gr.] | 43 |

Table 155. Provided are the Cotton correlated parameters (vectors). "RP"—Rest of plot; "SP" = selected plants; "gr." = grams; "H" = Harvest; "in"—inch; "SP"—Selected plants; "SPAD" = chlorophyll levels; "FW" = Plant Fresh weight; "DPA"—Days post anthesis; "mm"—millimeter; "cm"—centimeter; "num"—number; "Avr" = average; "DPA" = days post anthesis; "v" = vegetative stage; "H" = harvest stage;

TABLE 156

Cotton correlated parameters under normal and drought growth conditions (vectors) (parameters set 2)

| Correlated parameter with | Correlation ID |
| --- | --- |
| % Canopy coverage (10 DPA) [%] | 1 |
| 1000 seeds weight (RP) [gr.] | 2 |
| Bolls num per plant (RP) [number] | 3 |
| Closed Bolls num per plant (RP) [number] | 4 |
| Closed Bolls num per plant (SP) [number] | 5 |
| Fiber Length (RP) [in] | 6 |
| Fiber Length Position 1 (SP) [in] | 7 |
| Fiber Length Position 3 (SP) [in] | 8 |
| Fiber Strength (RP) [in] | 9 |
| Fiber Strength Position 3 (SP) [gr./denier] | 10 |
| Fiber yield (RP) [gr.] | 11 |
| Fiber yield per boll (RP) [gr.] | 12 |
| Fiber yield per plant (RP) [gr.] | 13 |
| Leaf area (10 DPA) [cm2] | 14 |
| Lower Stem width (H) [mm] | 15 |
| Micronaire (RP) [scoring 3.7-5] | 16 |
| Micronaire Position 1 (SP) [scoring 3.7-5] | 17 |
| Micronaire Position 3 (SP) [scoring 3.7-5] | 18 |
| Num of lateral branches with open bolls (H) [number] | 19 |
| Num of nodes with open bolls (MS) (H) [number] | 20 |
| Open Bolls num per plant (SP) [number] | 21 |
| PAR_LAI (10 DPA) [µmol m$^{-2}$s$^{-1}$] | 22 |
| Plant height (H) [cm] | 23 |
| Plant height growth [cm/day] | 24 |
| Reproductive period duration [number] | 25 |
| SPAD (17 DPA) [SPAD unit] | 26 |
| SPAD (pre F) [SPAD unit] | 27 |
| SPAD rate [SPAD unit/day] | 28 |
| Seeds yield per plant (RP) [gr.] | 29 |
| Shoot DW (10 DPA) [gr.] | 30 |
| Shoot DW (V) [gr.] | 31 |
| Short Fiber Content (RP) [%] | 32 |
| Stomatal conductance (10 DPA) [mmol m$^{-2}$s$^{-1}$] | 33 |
| Stomatal conductance (17 DPA) [mmol m$^{-2}$s$^{-1}$] | 34 |
| Total Bolls yield (RP) [gr.] | 35 |
| Total Bolls yield per plant (RP) [gr.] | 36 |
| Uniformity (RP) [%] | 37 |
| Upper Stem width (H) [mm] | 38 |
| Carbon isotope discrimination (%) | 39 |
| Estimated Avr Bolls FW (MB) po_1 (H) [gr.] | 40 |
| Estimated Avr Bolls FW (MB) po_3 (H) [gr.] | 41 |
| Estimated Avr Fiber yield (MB) po_1 (H) [gr.] | 42 |
| Estimated Avr Fiber yield (MB) po_3 (H) [gr.] | 43 |
| Estimated Avr Seeds num (MB) po_1 (H) [number] | 44 |
| Estimated Avr Seeds num (MB) po_3 (H) [number] | 45 |
| Estimated Avr Seeds yield (MB) po_1 (H) [number] | 46 |
| Estimated Avr Seeds yield (MB) po_3 (H) [gr.] | 47 |
| Leaf mass fraction (10 DPA) [cm$^2$/gr.] | 48 |
| Leaf temp (10 DPA) [° C.] | 49 |
| Leaf temp (V) [° C.] | 50 |

Table 156. Provided are the Cotton correlated parameters (vectors)."RP"—Rest of plot; "SP" = selected plants; "gr." = grams; "H" = Harvest; "in"—inch; "SP"—Selected plants; "SPAD" = chlorophyll levels; "FW" = Plant Fresh weight; "DPA"—Days post anthesis; "mm"—millimeter; "cm"—centimeter; "num"—number; "Avr" = average; "DPA" = days post anthesis; "v" = vegetative stage; "H" = harvest stage;

TABLE 157

Measured parameters in Cotton accessions (1-7) under normal conditions (parameters set 1)

| Line/Corr. ID | Line-1 | Line-2 | Line-3 | Line-4 | Line-5 | Line-6 | Line-7 |
|---|---|---|---|---|---|---|---|
| 1 | 84.01 | 94.86 | 92.93 | 89.23 | 84.88 | 87.15 | 79.89 |
| 2 | 105.24 | 113.64 | 98.49 | 84.74 | 111.74 | 82.47 | 91.64 |
| 3 | 11.01 | 19.11 | 11.83 | 15.49 | 22.62 | 11.78 | 13.45 |
| 4 | 4.23 | NA | NA | NA | NA | NA | 4.56 |
| 5 | 5.55 | 2.08 | 3.39 | 2.09 | 3.07 | 2.41 | 5.89 |
| 6 | 1.159 | 1.279 | 1.146 | 1.117 | 1.411 | 1.073 | 0.895 |
| 7 | 1.150 | 1.295 | 1.142 | 1.100 | 1.435 | 0.962 | 0.842 |
| 8 | 28.80 | 34.47 | 25.88 | 29.20 | 39.66 | 22.60 | 22.58 |
| 9 | 29.60 | 36.55 | 26.17 | 29.63 | 39.53 | 20.10 | 21.57 |
| 10 | 2.30 | 1.37 | 2.22 | 1.81 | 1.12 | 0.40 | 1.80 |
| 11 | 25.18 | 26.00 | 25.37 | 27.87 | 25.35 | 4.67 | 24.02 |
| 12 | 7007.67 | 6622.34 | 5544.74 | 8196.02 | 8573.30 | 8155.29 | 5291.27 |
| 13 | 12.79 | 13.71 | 11.83 | 12.38 | 12.97 | 10.92 | 12.97 |
| 14 | 4.31 | 3.63 | 3.95 | 4.37 | 4.10 | 6.05 | 5.01 |
| 15 | 4.57 | 3.89 | 3.99 | 4.71 | 4.75 | 5.69 | 5.25 |
| 16 | 1.02 | 1.46 | 0.81 | 0.96 | 1.21 | 1.69 | 1.29 |
| 17 | 8.15 | 10.90 | 9.00 | 11.04 | 10.14 | 7.85 | 8.48 |
| 18 | 11.98 | 22.56 | 11.80 | 18.75 | 27.65 | 16.42 | 15.00 |
| 19 | 5.67 | 6.87 | 6.45 | 5.86 | 5.61 | 6.59 | 4.09 |
| 20 | 112.80 | 110.77 | 100.59 | 115.45 | 103.26 | 98.52 | 121.91 |
| 21 | 1.864 | 1.998 | 1.729 | 1.724 | 1.662 | 1.719 | 2.086 |
| 22 | 121.33 | 108.11 | 108.00 | 103.80 | 102.88 | 108.00 | 126.00 |
| 23 | 34.29 | 33.52 | 31.41 | 29.66 | 37.10 | 27.43 | 33.39 |
| 24 | 32.13 | 35.30 | 35.99 | 35.80 | 35.03 | 32.92 | 35.89 |
| 25 | 0.040 | −0.059 | −0.255 | −0.219 | 0.103 | −0.291 | −0.142 |
| 26 | 32.49 | 34.86 | 32.48 | 35.06 | 36.32 | 26.74 | 33.06 |
| 27 | 169.15 | 183.58 | 171.09 | 172.70 | 190.03 | 149.03 | 193.14 |
| 28 | 39.20 | 64.68 | 44.79 | 38.06 | 46.23 | 36.68 | 48.20 |
| 29 | 842.47 | 792.64 | 804.23 | 766.97 | 745.20 | 725.93 | 922.57 |
| 30 | 168.94 | 256.04 | 194.76 | 155.69 | 154.56 | 172.13 | 193.28 |
| 31 | 505.37 | 564.21 | 544.17 | 585.47 | 536.54 | 317.18 | 488.33 |
| 32 | 3.02 | 3.64 | 3.32 | 3.13 | 3.23 | 2.73 | 2.80 |
| 33 | 5.0 | 5.0 | 5.0 | 5.0 | 5.0 | 5.0 | 5.0 |
| 34 | 5.0 | 5.0 | 5.0 | 5.0 | 5.0 | 5.0 | 5.0 |
| 35 | 6.62 | 4.88 | 7.08 | 5.34 | 4.08 | 3.58 | 5.66 |
| 36 | 6.42 | 2.93 | 5.95 | 4.16 | 2.72 | 2.73 | 5.13 |
| 37 | 2.53 | 1.88 | 2.69 | 2.02 | 1.50 | 0.38 | 2.04 |
| 38 | 2.46 | 1.13 | 2.34 | 1.69 | 1.06 | 0.50 | 1.87 |
| 39 | 31.56 | 24.16 | 36.01 | 31.31 | 20.94 | 32.59 | 30.77 |
| 40 | 31.23 | 15.50 | 33.29 | 26.13 | 14.87 | 31.25 | 32.63 |
| 41 | 3.33 | 2.70 | 3.83 | 2.99 | 2.43 | 3.02 | 3.03 |
| 42 | 3.29 | 1.58 | 3.06 | 2.19 | 1.64 | 2.29 | 2.76 |
| 43 | 41.10 | 36.48 | 33.99 | 47.95 | 44.56 | 54.74 | 28.14 |

Table 157. Provided are the values of each of the parameters (as described above) measured in cotton accessions (Line). Growth conditions are specified in the experimental procedure section.

TABLE 158

Measured parameters in additional Cotton accessions (8-13) under normal conditions (parameters set 1)

| Line/Corr. ID | Line-8 | Line-9 | Line-10 | Line-11 | Line-12 | Line-13 |
|---|---|---|---|---|---|---|
| 1 | 85.19 | 83.55 | 84.53 | 95.90 | 95.92 | 83.89 |
| 2 | 116.68 | 99.58 | 99.55 | 97.72 | 102.72 | 109.95 |
| 3 | 21.94 | 13.92 | 11.56 | 17.33 | 14.98 | 12.15 |
| 4 | NA | NA | 3.16 | 1.11 | NA | NA |
| 5 | 2.34 | 3.75 | 3.31 | 1.84 | 2.74 | 3.09 |
| 6 | 1.376 | 1.181 | 1.119 | 1.122 | 1.185 | 1.179 |
| 7 | 1.406 | 1.138 | 1.072 | 1.107 | 1.204 | 1.196 |
| 8 | 42.63 | 28.87 | 25.87 | 28.98 | 30.82 | 29.77 |
| 9 | 42.70 | 28.38 | 23.67 | 30.30 | 31.97 | 30.53 |
| 10 | 1.24 | 2.23 | 1.99 | 1.18 | 1.74 | 2.39 |
| 11 | 26.64 | 30.80 | 23.14 | 20.49 | 25.97 | 29.14 |
| 12 | 8854.54 | 5650.67 | 6003.34 | 6691.84 | 9004.97 | 7268.00 |
| 13 | 13.07 | 14.26 | 11.84 | 14.48 | 12.57 | 14.00 |
| 14 | 3.88 | 3.98 | 4.10 | 4.55 | 4.76 | 4.93 |
| 15 | 4.48 | 4.19 | 4.51 | 4.21 | 4.25 | 4.74 |
| 16 | 1.13 | 0.80 | 0.58 | 0.13 | 0.15 | 0.71 |
| 17 | 11.29 | 10.83 | 8.73 | 12.33 | 9.19 | 10.65 |
| 18 | 30.29 | 17.90 | 12.40 | 19.56 | 14.67 | 15.67 |

TABLE 158-continued

Measured parameters in additional Cotton accessions (8-13) under normal conditions (parameters set 1)

| Line/Corr. ID | Line-8 | Line-9 | Line-10 | Line-11 | Line-12 | Line-13 |
|---|---|---|---|---|---|---|
| 19 | 5.63 | 5.62 | 5.33 | 7.41 | 7.54 | 5.51 |
| 20 | 102.22 | 127.29 | 105.85 | 151.27 | 117.64 | 119.24 |
| 21 | 1.631 | 2.068 | 1.860 | 1.573 | 1.868 | 1.942 |
| 22 | 102.71 | 104.36 | 126.00 | 145.17 | 109.50 | 106.17 |
| 23 | 33.79 | 31.91 | 32.87 | 22.08 | 28.07 | 31.13 |
| 24 | 33.63 | 35.26 | 38.12 | 32.77 | 34.44 | 35.33 |
| 25 | −0.083 | −0.132 | −0.243 | −0.515 | −0.244 | −0.237 |
| 26 | 39.54 | 39.68 | 30.15 | 47.61 | 37.79 | 35.85 |
| 27 | 196.45 | 199.76 | 179.43 | 134.30 | 198.46 | 165.53 |
| 28 | 50.81 | 51.71 | 39.70 | 35.34 | 42.12 | 42.05 |
| 29 | 802.23 | 861.63 | 930.97 | 591.63 | 911.42 | 791.81 |
| 30 | 230.40 | 176.68 | 176.53 | 163.68 | 164.66 | 170.94 |
| 31 | 620.54 | 715.10 | 421.32 | 531.77 | 405.27 | 715.72 |
| 32 | 2.99 | 3.45 | 2.88 | 3.40 | 3.28 | 3.29 |
| 33 | 5.0 | 5.0 | 5.0 | NA | 5.0 | 5.0 |
| 34 | 5.0 | 5.0 | 5.0 | 5.0 | 5.0 | 5.0 |
| 35 | 3.13 | 6.37 | 6.14 | NA | 4.95 | 6.95 |
| 36 | 3.31 | 4.71 | 5.44 | 4.14 | 4.60 | 6.25 |
| 37 | 1.14 | 2.47 | 2.29 | NA | 1.77 | 2.92 |
| 38 | 1.19 | 1.91 | 2.02 | 1.12 | 1.65 | 2.65 |
| 39 | 15.45 | 31.45 | 29.29 | NA | 25.62 | 34.56 |
| 40 | 18.21 | 25.13 | 28.98 | 29.15 | 25.92 | 32.67 |
| 41 | 1.87 | 3.21 | 3.00 | NA | 2.82 | 3.87 |
| 42 | 2.06 | 2.25 | 2.65 | 2.73 | 2.55 | 3.56 |
| 43 | 45.41 | 28.05 | 33.48 | 47.94 | 45.95 | 44.01 |

Table 158. Provided are the values of each of the parameters (as described above) measured in cotton accessions (Line). Growth conditions are specified in the experimental procedure section

TABLE 159

Measured parameters in Cotton accessions (1-7) under normal conditions (parameters set 2)

| Line/Corr. ID | Line-1 | Line-2 | Line-3 | Line-4 | Line-5 | Line-6 | Line-7 |
|---|---|---|---|---|---|---|---|
| 1 | 84.01 | 94.86 | 92.93 | 89.23 | 84.88 | 87.15 | 79.89 |
| 2 | 105.24 | 113.64 | 98.49 | 84.74 | 111.74 | 82.47 | 91.64 |
| 3 | 11.01 | 19.11 | 11.83 | 15.49 | 22.62 | 11.78 | 13.45 |
| 4 | 4.23 | NA | NA | NA | NA | NA | 4.56 |
| 5 | 5.55 | 2.08 | 3.39 | 2.09 | 3.07 | 2.41 | 5.89 |
| 6 | 1.159 | 1.279 | 1.146 | 1.117 | 1.411 | 1.073 | 0.895 |
| 7 | 1.185 | 1.285 | 1.156 | 1.178 | 1.407 | 0.979 | 0.958 |
| 8 | 1.150 | 1.295 | 1.142 | 1.100 | 1.435 | 0.962 | 0.842 |
| 9 | 28.80 | 34.47 | 25.88 | 29.20 | 39.66 | 22.60 | 22.58 |
| 10 | 29.60 | 36.55 | 26.17 | 29.63 | 39.53 | 20.10 | 21.57 |
| 11 | 956.33 | 854.00 | 822.67 | 882.33 | 756.67 | 165.00 | 700.33 |
| 12 | 2.30 | 1.37 | 2.22 | 1.81 | 1.12 | 0.40 | 1.80 |
| 13 | 25.18 | 26.00 | 25.37 | 27.87 | 25.35 | 4.67 | 24.02 |
| 14 | 7007.67 | 6622.34 | 5544.74 | 8196.02 | 8573.30 | 8155.29 | 5291.27 |
| 15 | 12.79 | 13.71 | 11.83 | 12.38 | 12.97 | 10.92 | 12.97 |
| 16 | 4.31 | 3.63 | 3.95 | 4.37 | 4.10 | 6.05 | 5.01 |
| 17 | 4.675 | 3.665 | 4.593 | 5.200 | 4.063 | 6.300 | 5.620 |
| 18 | 4.568 | 3.885 | 3.987 | 4.713 | 4.753 | 5.690 | 5.247 |
| 19 | 1.021 | 1.458 | 0.813 | 0.958 | 1.208 | 1.688 | 1.292 |
| 20 | 8.15 | 10.90 | 9.00 | 11.04 | 10.14 | 7.85 | 8.48 |
| 21 | 11.98 | 22.56 | 11.80 | 18.75 | 27.65 | 16.42 | 15.00 |
| 22 | 5.67 | 6.87 | 6.45 | 5.86 | 5.61 | 6.59 | 4.09 |
| 23 | 112.80 | 110.77 | 100.59 | 115.45 | 103.26 | 98.52 | 121.91 |
| 24 | 1.86 | 2.00 | 1.73 | 1.72 | 1.66 | 1.72 | 2.09 |
| 25 | 121.33 | 108.11 | 108.00 | 103.80 | 102.88 | 108.00 | 126.00 |
| 26 | 34.29 | 33.52 | 31.41 | 29.66 | 37.10 | 27.43 | 33.39 |
| 27 | 32.132 | 35.297 | 35.994 | 35.800 | 35.033 | 32.921 | 35.892 |
| 28 | 0.040 | −0.059 | −0.255 | −0.219 | 0.103 | −0.291 | −0.142 |
| 29 | 32.49 | 34.86 | 32.48 | 35.06 | 36.32 | 26.74 | 33.06 |
| 30 | 169.15 | 183.58 | 171.09 | 172.70 | 190.03 | 149.03 | 193.14 |
| 31 | 39.20 | 64.68 | 44.79 | 38.06 | 46.23 | 36.68 | 48.20 |
| 32 | 8.08 | 6.22 | 10.17 | 10.80 | 4.84 | 11.80 | 12.60 |
| 33 | NA | NA | NA | NA | NA | NA | NA |
| 34 | NA | NA | NA | NA | NA | NA | NA |
| 35 | 2379.00 | 2148.89 | 2050.17 | 2156.33 | 1934.22 | 1221.25 | 1773.33 |
| 36 | 62.64 | 65.36 | 63.24 | 67.97 | 64.78 | 32.52 | 60.83 |
| 37 | 82.40 | 83.59 | 80.90 | 81.00 | 84.23 | 78.45 | 77.32 |

TABLE 159-continued

Measured parameters in Cotton accessions (1-7) under normal conditions (parameters set 2)

| Line/Corr. ID | Line-1 | Line-2 | Line-3 | Line-4 | Line-5 | Line-6 | Line-7 |
|---|---|---|---|---|---|---|---|
| 38 | 3.022 | 3.638 | 3.316 | 3.125 | 3.225 | 2.728 | 2.799 |
| 39 | −28.30 | −28.43 | −28.22 | −28.17 | −28.81 | −28.77 | −28.37 |
| 40 | 6.62 | 4.88 | 7.08 | 5.34 | 4.08 | 3.58 | 5.66 |
| 41 | 6.42 | 2.93 | 5.95 | 4.16 | 2.72 | 2.73 | 5.13 |
| 42 | 2.53 | 1.88 | 2.69 | 2.02 | 1.50 | 0.38 | 2.04 |
| 43 | 2.46 | 1.13 | 2.34 | 1.69 | 1.06 | 0.50 | 1.87 |
| 44 | 31.56 | 24.16 | 36.01 | 31.31 | 20.94 | 32.59 | 30.77 |
| 45 | 31.23 | 15.50 | 33.29 | 26.13 | 14.87 | 31.25 | 32.63 |
| 46 | 3.33 | 2.70 | 3.83 | 2.99 | 2.43 | 3.02 | 3.03 |
| 47 | 3.292 | 1.582 | 3.064 | 2.186 | 1.636 | 2.293 | 2.762 |
| 48 | 41.10 | 36.48 | 33.99 | 47.95 | 44.56 | 54.74 | 28.14 |
| 49 | 37.059 | 37.033 | 35.733 | 35.559 | 35.556 | 36.081 | 36.081 |
| 50 | 30.510 | 30.281 | 30.454 | 30.750 | 30.246 | 30.698 | 30.965 |

Table 159. Provided are the values of each of the parameters (as described above) measured in cotton accessions (Line). Growth conditions are specified in the experimental procedure section

TABLE 160

Measured parameters in Cotton accessions (8-13) under normal conditions (parameters set 2)

| Line/Corr. ID | Line-8 | Line-9 | Line-10 | Line-11 | Line-12 | Line-13 |
|---|---|---|---|---|---|---|
| 1 | 85.19 | 83.55 | 84.53 | 95.90 | 95.92 | 83.89 |
| 2 | 116.68 | 99.58 | 99.55 | 97.72 | 102.72 | 109.95 |
| 3 | 21.94 | 13.92 | 11.56 | 17.33 | 14.98 | 12.15 |
| 4 | NA | NA | 3.16 | 1.11 | NA | NA |
| 5 | 2.34 | 3.75 | 3.31 | 1.84 | 2.74 | 3.09 |
| 6 | 1.376 | 1.181 | 1.119 | 1.122 | 1.185 | 1.179 |
| 7 | 1.396 | 1.199 | 1.074 | 1.143 | 1.199 | 1.204 |
| 8 | 1.406 | 1.138 | 1.072 | 1.107 | 1.204 | 1.196 |
| 9 | 42.63 | 28.87 | 25.87 | 28.98 | 30.82 | 29.77 |
| 10 | 42.70 | 28.38 | 23.67 | 30.30 | 31.97 | 30.53 |
| 11 | 772.00 | 918.36 | 700.33 | 592.00 | 834.67 | 864.33 |
| 12 | 1.24 | 2.23 | 1.99 | 1.18 | 1.74 | 2.39 |
| 13 | 26.64 | 30.80 | 23.14 | 20.49 | 25.97 | 29.14 |
| 14 | 8854.54 | 5650.67 | 6003.34 | 6691.84 | 9004.97 | 7268.00 |
| 15 | 13.07 | 14.26 | 11.84 | 14.48 | 12.57 | 14.00 |
| 16 | 3.88 | 3.98 | 4.10 | 4.55 | 4.76 | 4.93 |
| 17 | 4.090 | 4.288 | 4.363 | 4.070 | 4.667 | 4.637 |
| 18 | 4.480 | 4.192 | 4.507 | 4.205 | 4.250 | 4.737 |
| 19 | 1.125 | 0.795 | 0.583 | 0.125 | 0.146 | 0.708 |
| 20 | 11.29 | 10.83 | 8.73 | 12.33 | 9.19 | 10.65 |
| 21 | 30.29 | 17.90 | 12.40 | 19.56 | 14.67 | 15.67 |
| 22 | 5.63 | 5.62 | 5.33 | 7.41 | 7.54 | 5.51 |
| 23 | 102.22 | 127.29 | 105.85 | 151.27 | 117.64 | 119.24 |
| 24 | 1.63 | 2.07 | 1.86 | 1.57 | 1.87 | 1.94 |
| 25 | 102.71 | 104.36 | 126.00 | 145.17 | 109.50 | 106.17 |
| 26 | 33.79 | 31.91 | 32.87 | 22.08 | 28.07 | 31.13 |
| 27 | 33.633 | 35.262 | 38.124 | 32.772 | 34.443 | 35.332 |
| 28 | −0.083 | −0.132 | −0.243 | −0.515 | −0.244 | −0.237 |
| 29 | 39.54 | 39.68 | 30.15 | 47.61 | 37.79 | 35.85 |
| 30 | 196.45 | 199.76 | 179.43 | 134.30 | 198.46 | 165.53 |
| 31 | 50.81 | 51.71 | 39.70 | 35.34 | 42.12 | 42.05 |
| 32 | 4.79 | 9.12 | 11.57 | 8.10 | 7.80 | 8.55 |
| 33 | NA | NA | NA | NA | NA | NA |
| 34 | NA | NA | NA | NA | NA | NA |
| 35 | 1920.00 | 2326.82 | 1794.83 | 2030.67 | 2211.00 | 2239.00 |
| 36 | 68.76 | 80.24 | 59.15 | 70.35 | 68.80 | 75.54 |
| 37 | 84.63 | 82.03 | 80.64 | 82.02 | 82.55 | 82.73 |
| 38 | 2.987 | 3.449 | 2.876 | 3.403 | 3.280 | 3.290 |
| 39 | −29.38 | −28.21 | −28.81 | −28.06 | −28.20 | −28.57 |
| 40 | 3.13 | 6.37 | 6.14 | NA | 4.95 | 6.95 |
| 41 | 3.31 | 4.71 | 5.44 | 4.14 | 4.60 | 6.25 |
| 42 | 1.14 | 2.47 | 2.29 | NA | 1.77 | 2.92 |
| 43 | 1.19 | 1.91 | 2.02 | 1.12 | 1.65 | 2.65 |
| 44 | 15.45 | 31.45 | 29.29 | NA | 25.62 | 34.56 |
| 45 | 18.21 | 25.13 | 28.98 | 29.15 | 25.92 | 32.67 |
| 46 | 1.87 | 3.21 | 3.00 | NA | 2.82 | 3.87 |
| 47 | 2.058 | 2.254 | 2.652 | 2.731 | 2.551 | 3.555 |
| 48 | 45.41 | 28.05 | 33.48 | 47.94 | 45.95 | 44.01 |

TABLE 160-continued

Measured parameters in Cotton accessions (8-13) under normal conditions (parameters set 2)

| Line/Corr. ID | Line-8 | Line-9 | Line-10 | Line-11 | Line-12 | Line-13 |
|---|---|---|---|---|---|---|
| 49 | 35.204 | 36.163 | 36.752 | 35.600 | 35.581 | 36.648 |
| 50 | 30.704 | 30.300 | 29.579 | 30.379 | 29.827 | 30.492 |

Table 160. Provided are the values of each of the parameters (as described above) measured in cotton accessions (Line). Growth conditions are specified in the experimental procedure section

TABLE 161

Measured parameters in Cotton accessions (1-7) under drought conditions (parameters set 2)

| Line/Corr. ID | Line-1 | Line-2 | Line-3 | Line-4 | Line-5 | Line-6 | Line-7 |
|---|---|---|---|---|---|---|---|
| 1 | 68.860 | 68.215 | 76.261 | 65.223 | 79.612 | 77.924 | 71.937 |
| 2 | 99.1 | 105.4 | 94.2 | 80.7 | 109.0 | 80.4 | 92.9 |
| 3 | 9.321 | 14.463 | 9.813 | 12.454 | 19.889 | 7.970 | 10.608 |
| 4 | NA | NA | NA | NA | NA | NA | 4.237 |
| 5 | 3.775 | 3.697 | 3.630 | 2.917 | 2.500 | 3.200 | 4.756 |
| 6 | 1.100 | 1.220 | 1.088 | 1.073 | 1.390 | 0.931 | 0.815 |
| 7 | 1.130 | 1.236 | 1.150 | 1.052 | 1.400 | 0.907 | 0.941 |
| 8 | 1.099 | 1.057 | 1.046 | 1.079 | 1.354 | 0.952 | 0.873 |
| 9 | 27.967 | 35.313 | 24.933 | 29.433 | 40.878 | 17.880 | 21.983 |
| 10 | 27.075 | 30.700 | 23.000 | 27.767 | 39.900 | 17.000 | 26.333 |
| 11 | 622.0 | 554.3 | 659.3 | 683.3 | 494.7 | 76.0 | 467.3 |
| 12 | 2.061 | 1.078 | 2.002 | 1.817 | 0.840 | 0.268 | 1.435 |
| 13 | 19.198 | 17.542 | 19.403 | 20.471 | 16.713 | 2.155 | 15.977 |
| 14 | 3928.3 | 5090.0 | 6094.3 | 6011.0 | 5919.0 | 4668.2 | 4397.7 |
| 15 | 11.436 | 11.727 | 10.826 | 10.823 | 11.029 | 9.898 | 11.269 |
| 16 | 4.277 | 4.168 | 4.093 | 4.715 | 3.701 | 6.392 | 5.565 |
| 17 | 4.978 | 4.583 | 4.733 | 5.367 | 4.833 | 7.420 | 5.843 |
| 18 | 4.630 | 3.850 | 4.363 | 5.130 | 4.567 | 7.340 | 5.523 |
| 19 | 1.041 | 0.875 | 1.167 | 1.083 | 1.384 | 1.050 | 1.229 |
| 20 | 6.980 | 7.234 | 7.167 | 7.417 | 8.233 | 5.975 | 7.604 |
| 21 | 9.755 | 14.097 | 10.625 | 12.234 | 23.219 | 10.275 | 11.938 |
| 22 | 3.656 | 2.914 | 3.760 | 3.330 | 4.383 | 4.264 | 2.866 |
| 23 | 92.9 | 87.2 | 79.8 | 85.6 | 71.3 | 77.2 | 99.4 |
| 24 | 0.988 | 0.956 | 0.993 | 0.985 | 0.975 | 0.966 | 0.996 |
| 25 | 100.2 | 99.8 | 99.3 | 96.2 | 92.9 | 99.4 | 127.0 |
| 26 | 47.378 | 46.822 | 48.481 | 49.347 | 53.486 | 46.373 | 48.633 |
| 27 | 36.256 | 38.826 | 39.785 | 40.718 | 39.256 | 37.412 | 39.187 |
| 28 | 0.336 | 0.170 | 0.216 | 0.279 | 0.447 | 0.236 | 0.281 |
| 29 | 24.90 | 23.97 | 25.54 | 27.10 | 27.52 | 16.54 | 24.05 |
| 30 | 140.2 | 140.8 | 184.7 | 147.4 | 149.5 | 116.5 | 161.3 |
| 31 | 37.22 | 51.21 | 46.91 | 45.57 | 39.96 | 28.16 | 41.39 |
| 32 | 9.140 | 7.713 | 10.633 | 10.683 | 4.733 | 16.400 | 17.317 |
| 33 | 481 | 428 | 582 | 512 | 451 | 610 | NA |
| 34 | 392 | 370 | 406 | 483 | 224 | 381 | 554 |
| 35 | 1573 | 1379 | 1635 | 1597 | 1359 | 745 | 1246 |
| 36 | 48.69 | 43.51 | 48.24 | 52.19 | 45.91 | 19.38 | 42.61 |
| 37 | 81.62 | 82.76 | 80.17 | 80.85 | 84.43 | 76.42 | 75.72 |
| 38 | 2.889 | 3.088 | 3.085 | 3.170 | 3.248 | 2.843 | 2.605 |
| 39 | −28.081 | −28.655 | −28.723 | −27.658 | −28.280 | −27.948 | −28.233 |
| 40 | 6.755 | 3.054 | 6.509 | NA | NA | NA | NA |
| 41 | 6.148 | 4.253 | 5.902 | NA | NA | 3.505 | 4.178 |
| 42 | 2.627 | 1.203 | 2.526 | NA | NA | NA | NA |
| 43 | 2.343 | 1.567 | 2.317 | NA | NA | 0.473 | 1.444 |
| 44 | 32.59 | 15.60 | 33.48 | NA | NA | NA | NA |
| 45 | 33.44 | 21.82 | 34.57 | NA | NA | 32.06 | 27.54 |
| 46 | 3.445 | 1.661 | 3.553 | NA | NA | NA | NA |
| 47 | 3.295 | 2.304 | 3.163 | NA | NA | 2.562 | 2.156 |
| 48 | 28.856 | 37.427 | 33.065 | 40.956 | 39.797 | 33.397 | 26.959 |
| 49 | 35.221 | 38.604 | 37.007 | 34.659 | 38.511 | 37.944 | 37.411 |
| 50 | 33.035 | 33.621 | 33.046 | 34.638 | 33.091 | 33.354 | 33.038 |

Table 161. Provided are the values of each of the parameters (as described above) measured in Cotton accessions (Line). Growth conditions are specified in the experimental procedure section

TABLE 162

Measured parameters in additional Cotton accessions (8-13) under drought conditions (parameters set 2)

| Line/Corr. ID | Line-8 | Line-9 | Line-10 | Line-11 | Line-12 | Line-13 |
|---|---|---|---|---|---|---|
| 1 | 71.615 | 68.801 | 59.418 | 81.208 | 79.860 | 60.446 |
| 2 | 108.7 | 95.5 | 98.7 | 99.0 | 97.2 | 109.6 |
| 3 | 19.562 | 11.449 | 9.117 | 14.026 | 10.164 | 11.008 |
| 4 | NA | NA | 3.977 | NA | NA | NA |
| 5 | 1.625 | 3.625 | 4.674 | 2.300 | 3.206 | 3.571 |
| 6 | 1.329 | 1.113 | 1.062 | 1.041 | 1.102 | 1.130 |
| 7 | 1.332 | 1.133 | 1.071 | 1.060 | 1.075 | 1.133 |
| 8 | 1.324 | 1.109 | 0.994 | 1.073 | 1.077 | 1.087 |
| 9 | 43.120 | 28.110 | 26.067 | 28.367 | 29.183 | 30.000 |
| 10 | 43.450 | 27.780 | 22.300 | 28.900 | 31.850 | 30.267 |
| 11 | 592.6 | 598.8 | 558.0 | 428.0 | 563.7 | 614.7 |
| 12 | 0.997 | 1.824 | 2.023 | 1.005 | 1.593 | 2.017 |
| 13 | 19.616 | 18.888 | 18.292 | 14.144 | 16.100 | 20.158 |
| 14 | 6847.0 | 4819.7 | 3690.0 | 7521.9 | 6199.3 | 5593.0 |
| 15 | 11.889 | 12.473 | 10.583 | 11.758 | 11.264 | 11.999 |
| 16 | 4.065 | 4.318 | 4.263 | 4.705 | 4.982 | 4.687 |
| 17 | 4.460 | 5.096 | 5.073 | 4.875 | 4.880 | 4.513 |
| 18 | 3.975 | 4.634 | 4.277 | 4.690 | 5.350 | 4.210 |
| 19 | 0.893 | 0.963 | 0.875 | 0.208 | 0.367 | 0.875 |
| 20 | 9.393 | 7.679 | 7.063 | 10.313 | 7.551 | 8.188 |
| 21 | 22.804 | 12.679 | 9.896 | 14.542 | 11.653 | 12.771 |
| 22 | 3.613 | 3.083 | 2.585 | 4.147 | 4.033 | 2.457 |
| 23 | 74.8 | 97.7 | 85.5 | 104.4 | 93.0 | 93.4 |
| 24 | 0.992 | 0.993 | 0.985 | 0.991 | 0.986 | 0.984 |
| 25 | 92.9 | 97.7 | 127.0 | 98.8 | 98.5 | 98.8 |
| 26 | 48.831 | 51.219 | 52.131 | 43.782 | 45.764 | 48.989 |
| 27 | 38.519 | 39.099 | 41.867 | 37.365 | 37.744 | 37.929 |
| 28 | 0.311 | 0.370 | 0.298 | 0.082 | 0.177 | 0.308 |
| 29 | 30.40 | 25.90 | 23.30 | 31.74 | 23.86 | 30.57 |
| 30 | 162.8 | 159.8 | 123.2 | 192.8 | 156.6 | 163.7 |
| 31 | 49.82 | 44.31 | 36.49 | 43.24 | 38.05 | 37.82 |
| 32 | 4.733 | 10.070 | 12.283 | 8.883 | 8.633 | 9.283 |
| 33 | 328 | 407 | 510 | 542 | 383 | 556 |
| 34 | 219 | 427 | 421 | 384 | 434 | 499 |
| 35 | 1583 | 1552 | 1419 | 1533 | 1489 | 1606 |
| 36 | 52.39 | 49.13 | 46.00 | 50.72 | 42.42 | 57.10 |
| 37 | 84.00 | 80.92 | 79.52 | 81.42 | 80.83 | 82.22 |
| 38 | 3.170 | 3.373 | 2.909 | 3.460 | 3.502 | 3.223 |
| 39 | −28.403 | −27.778 | −27.808 | −26.931 | −27.501 | −27.862 |
| 40 | 3.585 | 5.503 | NA | 4.197 | 4.880 | 5.898 |
| 41 | 2.429 | 5.167 | 5.143 | 3.362 | 4.454 | 5.028 |
| 42 | 1.309 | 2.106 | NA | 1.129 | 1.753 | 2.151 |
| 43 | 0.864 | 1.954 | 1.821 | 0.967 | 1.641 | 1.859 |
| 44 | 18.74 | 29.54 | NA | 31.17 | 27.26 | 28.98 |
| 45 | 13.92 | 29.19 | 28.13 | 24.83 | 27.79 | 26.01 |
| 46 | 2.150 | 2.822 | NA | 3.179 | 2.744 | 3.195 |
| 47 | 1.385 | 2.643 | 2.506 | 2.315 | 2.533 | 2.651 |
| 48 | 41.854 | 30.639 | 30.062 | 46.046 | 39.539 | 34.155 |
| 49 | 36.985 | 36.507 | 37.248 | 36.341 | 36.200 | 35.659 |
| 50 | 33.151 | 32.598 | 32.869 | 33.700 | 33.542 | 33.580 |

Table 162. Provided are the values of each of the parameters (as described above) measured in Cotton accessions (Line). Growth conditions are specified in the experimental procedure section

TABLE 163

Correlation between the expression level of selected genes of some embodiments of the invention in various tissues and the phenotypic performance under normal conditions (set 1) across Cotton accessions

| Gene Name | R | P value | Exp. set | Corr. Set ID | Gene Name | R | P value | Exp. set | Corr. Set ID |
|---|---|---|---|---|---|---|---|---|---|
| LBY45 | 0.86 | 1.21E−02 | 2 | 16 | LBY45 | 0.87 | 2.48E−02 | 6 | 2 |
| LBY45 | 0.79 | 6.18E−02 | 6 | 7 | LBY45 | 0.76 | 8.08E−02 | 6 | 18 |
| LBY45 | 0.82 | 4.69E−02 | 6 | 8 | LBY45 | 0.76 | 8.24E−02 | 6 | 32 |
| LBY45 | 0.89 | 1.81E−02 | 6 | 3 | LBY45 | 0.81 | 5.16E−02 | 6 | 26 |
| LBY45 | 0.72 | 1.06E−01 | 6 | 30 | LBY45 | 0.91 | 1.11E−02 | 6 | 31 |
| LBY45 | 0.71 | 1.16E−01 | 6 | 6 | LBY45 | 0.93 | 7.33E−03 | 6 | 17 |
| LBY45 | 0.88 | 1.93E−02 | 6 | 9 | LBY45 | 0.81 | 4.98E−02 | 6 | 13 |
| LBY45 | 0.78 | 6.85E−02 | 6 | 11 | LBY45 | 0.74 | 5.54E−02 | 9 | 43 |
| LBY45 | 0.80 | 5.58E−02 | 7 | 12 | LBY45 | 0.85 | 3.28E−02 | 7 | 3 |
| LBY46 | 0.83 | 8.40E−04 | 3 | 7 | LBY46 | 0.81 | 1.26E−03 | 3 | 18 |
| LBY46 | 0.91 | 3.57E−05 | 3 | 8 | LBY46 | 0.71 | 9.91E−03 | 3 | 12 |
| LBY46 | 0.77 | 3.21E−03 | 3 | 3 | LBY46 | 0.84 | 6.39E−04 | 3 | 6 |

TABLE 163-continued

Correlation between the expression level of selected genes of some embodiments of the invention in various tissues and the phenotypic performance under normal conditions (set 1) across Cotton accessions

| Gene Name | R | P value | Exp. set | Corr. Set ID | Gene Name | R | P value | Exp. set | Corr. Set ID |
|---|---|---|---|---|---|---|---|---|---|
| LBY46 | 0.85 | 5.28E-04 | 3 | 9 | LBY46 | 0.87 | 2.27E-02 | 8 | 2 |
| LBY46 | 0.91 | 1.09E-02 | 8 | 16 | LBY46 | 0.87 | 2.59E-02 | 8 | 7 |
| LBY46 | 0.80 | 5.66E-02 | 8 | 8 | LBY46 | 0.76 | 7.90E-02 | 8 | 32 |
| LBY46 | 0.79 | 5.92E-02 | 8 | 31 | LBY46 | 0.80 | 5.58E-02 | 8 | 6 |
| LBY46 | 0.83 | 3.99E-02 | 8 | 9 | LBY46 | 0.72 | 6.96E-02 | 2 | 32 |
| LBY46 | 0.74 | 5.93E-02 | 2 | 17 | LBY46 | 0.72 | 6.71E-02 | 2 | 20 |
| LBY46 | 0.90 | 1.56E-02 | 6 | 2 | LBY46 | 0.89 | 1.67E-02 | 6 | 7 |
| LBY46 | 0.86 | 2.86E-02 | 6 | 18 | LBY46 | 0.73 | 1.00E-01 | 6 | 43 |
| LBY46 | 0.90 | 1.53E-02 | 6 | 8 | LBY46 | 0.91 | 1.10E-02 | 6 | 3 |
| LBY46 | 0.76 | 8.01E-02 | 6 | 14 | LBY46 | 0.84 | 3.67E-02 | 6 | 31 |
| LBY46 | 0.84 | 3.52E-02 | 6 | 6 | LBY46 | 0.89 | 1.80E-02 | 6 | 17 |
| LBY46 | 0.94 | 4.74E-03 | 6 | 9 | LBY46 | 0.82 | 2.37E-02 | 5 | 24 |
| LBY46 | 0.76 | 1.10E-02 | 1 | 10 | LBY46 | 0.71 | 3.34E-02 | 1 | 35 |
| LBY46 | 0.70 | 3.45E-02 | 1 | 37 | LBY46 | 0.76 | 1.12E-02 | 1 | 11 |
| LBY46 | 0.84 | 3.80E-02 | 7 | 43 | LBY47 | 0.77 | 4.47E-02 | 2 | 16 |
| LBY47 | 0.84 | 3.72E-02 | 6 | 23 | LBY47 | 0.88 | 2.06E-02 | 6 | 25 |
| LBY47 | 0.77 | 4.23E-02 | 5 | 19 | LBY47 | 0.75 | 5.44E-02 | 5 | 20 |
| LBY48 | 0.91 | 1.28E-02 | 8 | 5 | LBY48 | 0.83 | 4.20E-02 | 8 | 23 |
| LBY48 | 0.84 | 3.76E-02 | 8 | 24 | LBY48 | 0.84 | 3.44E-02 | 8 | 27 |
| LBY48 | 0.73 | 9.70E-02 | 8 | 25 | LBY48 | 0.82 | 4.42E-02 | 8 | 29 |
| LBY48 | 0.81 | 1.47E-03 | 9 | 28 | LBY48 | 0.75 | 5.01E-03 | 9 | 30 |
| LBY48 | 0.79 | 3.59E-02 | 5 | 26 | LBY48 | 0.98 | 7.04E-05 | 5 | 19 |
| LBY48 | 0.73 | 6.21E-02 | 5 | 17 | LBY48 | 0.73 | 6.28E-02 | 5 | 20 |
| LBY48 | 0.95 | 8.67E-04 | 5 | 1 | LBY48 | 0.70 | 7.77E-02 | 5 | 13 |
| LBY48 | 0.72 | 1.07E-01 | 7 | 5 | LBY48 | 0.72 | 1.04E-01 | 7 | 28 |
| LBY49 | 0.86 | 2.93E-02 | 8 | 18 | LBY49 | 0.72 | 1.08E-01 | 8 | 8 |
| LBY49 | 0.89 | 1.77E-02 | 8 | 3 | LBY49 | 0.70 | 7.58E-03 | 4 | 18 |
| LBY49 | 0.73 | 9.83E-02 | 6 | 43 | LBY49 | 0.79 | 5.91E-02 | 6 | 14 |
| LBY49 | 0.71 | 1.15E-01 | 6 | 15 | LBY49 | 0.71 | 7.28E-02 | 5 | 26 |
| LBY49 | 0.72 | 1.96E-02 | 1 | 18 | LBY49 | 0.71 | 2.15E-02 | 1 | 8 |
| LBY49 | 0.73 | 1.60E-02 | 1 | 14 | LBY49 | 0.71 | 2.08E-02 | 1 | 6 |
| LBY49 | 0.85 | 3.15E-02 | 7 | 2 | LBY49 | 0.75 | 8.54E-02 | 7 | 38 |
| LBY49 | 0.76 | 7.97E-02 | 7 | 10 | LBY49 | 0.78 | 6.44E-02 | 7 | 17 |
| LBY49 | 0.74 | 9.17E-02 | 7 | 20 | LBY49 | 0.82 | 4.53E-02 | 7 | 13 |
| LBY49 | 0.79 | 6.26E-02 | 7 | 36 | LBY50 | 0.88 | 2.16E-02 | 6 | 5 |
| LBY50 | 0.81 | 5.12E-02 | 6 | 21 | LBY50 | 0.77 | 7.60E-02 | 6 | 29 |
| LBY50 | 0.74 | 9.04E-02 | 6 | 36 | LBY50 | 0.71 | 9.24E-03 | 9 | 19 |
| LBY50 | 0.88 | 7.04E-04 | 1 | 14 | LBY50 | 0.72 | 1.10E-01 | 7 | 14 |
| LBY51 | 0.95 | 3.24E-03 | 8 | 38 | LBY51 | 0.77 | 7.28E-02 | 8 | 42 |
| LBY51 | 0.91 | 1.25E-02 | 8 | 10 | LBY51 | 0.72 | 1.08E-01 | 8 | 31 |
| LBY51 | 0.90 | 1.32E-02 | 8 | 36 | LBY51 | 0.72 | 6.72E-02 | 2 | 26 |
| LBY51 | 0.83 | 2.13E-02 | 2 | 31 | LBY51 | 0.86 | 1.28E-02 | 2 | 17 |
| LBY51 | 0.77 | 4.18E-02 | 2 | 11 | LBY51 | 0.74 | 9.00E-02 | 6 | 43 |
| LBY51 | 0.88 | 2.16E-02 | 6 | 12 | LBY51 | 0.72 | 1.06E-01 | 7 | 18 |
| LBY51 | 0.72 | 1.03E-01 | 7 | 20 | LBY52 | 0.83 | 4.23E-02 | 8 | 12 |
| LBY52 | 0.89 | 6.75E-03 | 2 | 24 | LBY52 | 0.75 | 3.34E-03 | 4 | 30 |
| LBY52 | 0.71 | 1.10E-01 | 6 | 43 | LBY52 | 0.74 | 5.94E-02 | 5 | 43 |
| LBY53 | 0.88 | 2.08E-02 | 8 | 18 | LBY53 | 0.75 | 8.50E-02 | 8 | 8 |
| LBY53 | 0.85 | 3.10E-02 | 8 | 3 | LBY53 | 0.71 | 1.17E-01 | 8 | 25 |
| LBY53 | 0.73 | 9.91E-02 | 8 | 6 | LBY53 | 0.71 | 1.15E-01 | 8 | 9 |
| LBY53 | 0.78 | 4.01E-02 | 2 | 16 | LBY53 | 0.75 | 5.02E-02 | 2 | 18 |
| LBY53 | 0.71 | 7.27E-02 | 2 | 30 | LBY53 | 0.76 | 2.70E-03 | 4 | 7 |
| LBY53 | 0.77 | 1.87E-03 | 4 | 18 | LBY53 | 0.85 | 2.43E-04 | 4 | 8 |
| LBY53 | 0.73 | 4.50E-03 | 4 | 3 | LBY53 | 0.75 | 3.39E-03 | 4 | 6 |
| LBY53 | 0.82 | 5.71E-04 | 4 | 9 | LBY53 | 0.82 | 4.79E-02 | 6 | 2 |
| LBY53 | 0.85 | 3.33E-02 | 6 | 22 | LBY53 | 0.71 | 1.16E-01 | 6 | 8 |
| LBY53 | 0.83 | 4.16E-02 | 6 | 30 | LBY53 | 0.79 | 5.89E-02 | 6 | 31 |
| LBY53 | 0.76 | 7.99E-02 | 6 | 9 | LBY53 | 0.83 | 3.98E-02 | 6 | 20 |
| LBY53 | 0.74 | 5.83E-02 | 5 | 10 | LBY53 | 0.71 | 1.11E-01 | 5 | 35 |
| LBY53 | 0.71 | 7.48E-02 | 5 | 36 | LBY53 | 0.75 | 8.53E-02 | 7 | 12 |
| LBY53 | 0.76 | 7.65E-02 | 7 | 19 | LBY53 | 0.74 | 9.45E-02 | 7 | 9 |
| LBY53 | 0.82 | 4.64E-02 | 7 | 1 | LBY54 | 0.82 | 4.46E-02 | 8 | 18 |
| LBY54 | 0.73 | 9.87E-02 | 8 | 8 | LBY54 | 0.73 | 9.64E-02 | 8 | 3 |
| LBY54 | 0.73 | 1.00E-01 | 8 | 6 | LBY54 | 0.78 | 6.79E-02 | 6 | 43 |
| LBY54 | 0.73 | 9.87E-02 | 6 | 19 | LBY54 | 0.78 | 3.83E-02 | 5 | 22 |
| LBY54 | 0.82 | 2.33E-02 | 5 | 26 | LBY54 | 0.84 | 1.79E-02 | 5 | 19 |
| LBY54 | 0.89 | 7.19E-03 | 5 | 20 | LBY54 | 0.75 | 5.26E-02 | 5 | 1 |
| LBY54 | 0.76 | 7.76E-02 | 7 | 18 | LBY54 | 0.71 | 9.89E-03 | 3 | 22 |
| LBY93 | 0.75 | 4.87E-03 | 3 | 42 | LBY93 | 0.79 | 6.41E-02 | 8 | 16 |
| LBY93 | 0.87 | 2.54E-02 | 6 | 16 | LBY93 | 0.78 | 6.96E-02 | 6 | 15 |
| LBY93 | 0.75 | 8.48E-02 | 6 | 29 | LBY93 | 0.72 | 6.92E-02 | 5 | 14 |
| LBY93 | 0.75 | 5.42E-02 | 5 | 20 | LBY94 | 0.84 | 6.36E-04 | 3 | 42 |
| LBY94 | 0.77 | 3.59E-03 | 3 | 36 | LBY94 | 0.78 | 6.63E-02 | 8 | 7 |

TABLE 163-continued

Correlation between the expression level of selected genes of some embodiments of the invention in various tissues and the phenotypic performance under normal conditions (set 1) across Cotton accessions

| Gene Name | R | P value | Exp. set | Corr. Set ID | Gene Name | R | P value | Exp. set | Corr. Set ID |
|---|---|---|---|---|---|---|---|---|---|
| LBY94 | 0.83 | 4.05E−02 | 8 | 18 | LBY94 | 0.72 | 1.07E−01 | 8 | 12 |
| LBY94 | 0.80 | 5.37E−02 | 8 | 3 | LBY94 | 0.85 | 3.09E−02 | 8 | 6 |
| LBY94 | 0.83 | 2.20E−02 | 2 | 16 | LBY94 | 0.88 | 9.56E−03 | 2 | 18 |
| LBY94 | 0.81 | 2.59E−02 | 2 | 8 | LBY94 | 0.85 | 1.56E−02 | 2 | 3 |
| LBY94 | 0.85 | 1.49E−02 | 2 | 25 | LBY94 | 0.74 | 5.66E−02 | 2 | 30 |
| LBY94 | 0.77 | 4.41E−02 | 2 | 15 | LBY94 | 0.82 | 2.52E−02 | 2 | 6 |
| LBY94 | 0.70 | 7.75E−02 | 2 | 9 | LBY94 | 0.71 | 6.99E−03 | 4 | 14 |
| LBY94 | 0.80 | 1.01E−03 | 4 | 15 | LBY94 | 0.82 | 4.53E−02 | 6 | 22 |
| LBY94 | 0.71 | 1.14E−01 | 6 | 26 | LBY94 | 0.90 | 1.59E−02 | 6 | 20 |
| LBY94 | 0.80 | 5.83E−02 | 6 | 13 | LBY94 | 0.81 | 2.67E−02 | 5 | 21 |
| LBY94 | 0.87 | 2.52E−02 | 5 | 35 | LBY94 | 0.88 | 9.34E−03 | 5 | 15 |
| LBY94 | 0.88 | 2.09E−02 | 5 | 39 | LBY94 | 0.86 | 2.83E−02 | 5 | 37 |
| LBY94 | 0.86 | 2.65E−02 | 5 | 41 | LBY94 | 0.78 | 7.96E−03 | 1 | 2 |
| LBY94 | 0.73 | 1.72E−02 | 1 | 8 | LBY94 | 0.78 | 7.30E−03 | 1 | 9 |
| LBY94 | 0.86 | 1.30E−03 | 1 | 11 | LBY94 | 0.88 | 2.20E−02 | 7 | 23 |
| LBY94 | 0.98 | 5.23E−04 | 7 | 24 | LBY94 | 0.75 | 8.70E−02 | 7 | 29 |
| LBY95 | 0.74 | 5.84E−03 | 3 | 38 | LBY95 | 0.82 | 1.09E−03 | 3 | 42 |
| LBY95 | 0.78 | 2.62E−03 | 3 | 36 | LBY95 | 0.71 | 1.37E−02 | 3 | 41 |
| LBY95 | 0.78 | 3.95E−02 | 2 | 2 | LBY95 | 0.83 | 2.20E−02 | 2 | 7 |
| LBY95 | 0.90 | 5.37E−03 | 2 | 28 | LBY95 | 0.71 | 7.25E−02 | 2 | 26 |
| LBY95 | 0.73 | 6.09E−02 | 2 | 6 | LBY95 | 0.70 | 7.94E−02 | 2 | 9 |
| LBY95 | 0.88 | 1.97E−02 | 6 | 43 | LBY95 | 0.85 | 3.06E−02 | 6 | 12 |
| LBY96 | 0.71 | 9.21E−03 | 3 | 31 | LBY96 | 0.83 | 3.89E−02 | 8 | 2 |
| LBY96 | 0.87 | 2.33E−02 | 8 | 7 | LBY96 | 0.73 | 1.02E−01 | 8 | 18 |
| LBY96 | 0.80 | 5.78E−02 | 8 | 23 | LBY96 | 0.88 | 2.01E−02 | 8 | 8 |
| LBY96 | 0.78 | 6.95E−02 | 8 | 25 | LBY96 | 0.84 | 3.69E−02 | 8 | 6 |
| LBY96 | 0.83 | 4.29E−02 | 8 | 9 | LBY96 | 0.73 | 1.00E−01 | 8 | 11 |
| LBY96 | 0.71 | 1.15E−01 | 6 | 24 | LBY96 | 0.93 | 6.61E−03 | 6 | 32 |
| LBY96 | 0.74 | 5.53E−02 | 5 | 2 | LBY96 | 0.71 | 7.14E−02 | 5 | 18 |
| LBY96 | 0.92 | 3.48E−03 | 5 | 31 | LBY96 | 0.73 | 6.23E−02 | 5 | 17 |
| LBY96 | 0.78 | 3.91E−02 | 5 | 9 | LBY96 | 0.71 | 7.36E−02 | 5 | 11 |
| LBY96 | 0.74 | 9.45E−02 | 7 | 28 | LBY97 | 0.82 | 4.81E−02 | 8 | 38 |
| LBY97 | 0.93 | 7.96E−03 | 8 | 42 | LBY97 | 0.74 | 9.15E−02 | 8 | 10 |
| LBY97 | 0.80 | 5.55E−02 | 8 | 40 | LBY97 | 0.96 | 1.99E−03 | 8 | 36 |
| LBY97 | 0.93 | 2.34E−03 | 2 | 31 | LBY97 | 0.74 | 5.59E−02 | 2 | 17 |
| LBY97 | 0.75 | 5.19E−02 | 2 | 13 | LBY97 | 0.78 | 6.49E−02 | 6 | 43 |
| LBY97 | 0.75 | 5.29E−03 | 9 | 18 | LBY97 | 0.73 | 6.82E−03 | 9 | 8 |
| LBY97 | 0.77 | 4.44E−02 | 5 | 32 | LBY97 | 0.73 | 1.71E−02 | 1 | 29 |
| LBY97 | 0.87 | 2.57E−02 | 7 | 3 | LBY97 | 0.83 | 3.96E−02 | 7 | 1 |
| LGN40 | 0.71 | 1.02E−02 | 3 | 14 | LGN40 | 0.94 | 5.43E−03 | 8 | 2 |
| LGN40 | 0.71 | 1.15E−01 | 8 | 7 | LGN40 | 0.73 | 9.94E−02 | 8 | 32 |
| LGN40 | 0.87 | 2.36E−02 | 8 | 31 | LGN40 | 0.74 | 9.35E−02 | 8 | 9 |
| LGN40 | 0.82 | 4.34E−02 | 8 | 11 | LGN40 | 0.72 | 5.88E−03 | 4 | 28 |
| LGN40 | 0.88 | 7.61E−05 | 4 | 30 | LGN40 | 0.91 | 1.12E−02 | 6 | 43 |
| LGN40 | 0.73 | 9.84E−02 | 6 | 12 | LGN40 | 0.76 | 8.04E−02 | 6 | 19 |
| LGN40 | 0.75 | 4.85E−03 | 9 | 22 | LGN40 | 0.92 | 9.66E−03 | 7 | 22 |
| LGN40 | 0.77 | 7.10E−02 | 7 | 3 | LGN40 | 0.81 | 5.10E−02 | 7 | 26 |
| LGN40 | 0.73 | 1.01E−01 | 7 | 17 | LGN40 | 0.83 | 4.02E−02 | 7 | 20 |

Table 163. Provided are the correlations (R) between the genes expression levels in various tissues and the phenotypic performance. "Corr. ID"—correlation set ID according to the correlated parameters specified in Table 155. "Exp. Set"—Expression set specified in Table 152. "R" = Pearson correlation coefficient; "P" = p value.

TABLE 164

Correlation between the expression level of selected genes of some embodiments of the invention in additional tissues and the phenotypic performance under normal conditions (set 2) across Cotton accessions

| Gene Name | R | P value | Exp. set | Corr. Set ID | Gene Name | R | P value | Exp. set | Corr. Set ID |
|---|---|---|---|---|---|---|---|---|---|
| LBY45 | 0.89 | 1.27E−03 | 1 | 25 | LBY45 | 0.77 | 1.47E−02 | 1 | 32 |
| LBY45 | 0.77 | 1.52E−02 | 1 | 49 | LBY45 | 0.72 | 2.75E−02 | 1 | 28 |
| LBY45 | 0.70 | 3.48E−02 | 1 | 41 | LBY46 | 0.81 | 1.32E−03 | 2 | 24 |
| LBY46 | 0.85 | 3.38E−03 | 1 | 8 | LBY46 | 0.85 | 3.72E−03 | 1 | 32 |
| LBY46 | 0.81 | 7.86E−03 | 1 | 43 | LBY46 | 0.82 | 7.06E−03 | 1 | 9 |
| LBY46 | 0.74 | 2.33E−02 | 1 | 47 | LBY46 | 0.77 | 1.47E−02 | 1 | 12 |
| LBY46 | 0.79 | 1.08E−02 | 1 | 21 | LBY46 | 0.82 | 7.33E−03 | 1 | 40 |
| LBY46 | 0.80 | 9.43E−03 | 1 | 3 | LBY46 | 0.88 | 1.54E−03 | 1 | 7 |
| LBY46 | 0.87 | 2.42E−03 | 1 | 6 | LBY46 | 0.84 | 5.02E−03 | 1 | 45 |
| LBY46 | 0.82 | 6.81E−03 | 1 | 44 | LBY46 | 0.81 | 7.66E−03 | 1 | 42 |

TABLE 164-continued

Correlation between the expression level of selected genes of some embodiments of the invention in additional tissues and the phenotypic performance under normal conditions (set 2) across Cotton accessions

| Gene Name | R | P value | Exp. set | Corr. Set ID | Gene Name | R | P value | Exp. set | Corr. Set ID |
|---|---|---|---|---|---|---|---|---|---|
| LBY46 | 0.78 | 1.28E−02 | 1 | 10 | LBY46 | 0.78 | 1.23E−02 | 1 | 41 |
| LBY46 | 0.75 | 2.02E−02 | 1 | 37 | LBY46 | 0.81 | 7.80E−03 | 1 | 46 |
| LBY46 | 0.77 | 1.88E−03 | 3 | 8 | LBY46 | 0.75 | 3.39E−03 | 3 | 7 |
| LBY46 | 0.77 | 2.15E−03 | 3 | 6 | LBY47 | 0.77 | 3.56E−03 | 2 | 21 |
| LBY47 | 0.83 | 5.40E−03 | 1 | 8 | LBY47 | 0.88 | 1.94E−03 | 1 | 9 |
| LBY47 | 0.85 | 3.43E−03 | 1 | 21 | LBY47 | 0.89 | 1.17E−03 | 1 | 3 |
| LBY47 | 0.71 | 3.10E−02 | 1 | 30 | LBY47 | 0.86 | 2.65E−03 | 1 | 7 |
| LBY47 | 0.86 | 3.29E−03 | 1 | 6 | LBY47 | 0.88 | 1.81E−03 | 1 | 10 |
| LBY47 | 0.83 | 5.95E−03 | 1 | 37 | LBY48 | 0.73 | 7.06E−03 | 2 | 8 |
| LBY48 | 0.70 | 1.11E−02 | 2 | 9 | LBY48 | 0.73 | 7.25E−03 | 2 | 7 |
| LBY48 | 0.79 | 2.14E−03 | 2 | 6 | LBY48 | 0.85 | 3.67E−03 | 1 | 31 |
| LBY49 | 0.75 | 4.83E−03 | 2 | 8 | LBY49 | 0.79 | 2.19E−03 | 2 | 9 |
| LBY49 | 0.72 | 7.65E−03 | 2 | 7 | LBY49 | 0.73 | 6.96E−03 | 2 | 6 |
| LBY49 | 0.76 | 4.41E−03 | 2 | 10 | LBY49 | 0.74 | 5.81E−03 | 2 | 37 |
| LBY50 | 0.70 | 1.11E−02 | 2 | 39 | LBY50 | 0.88 | 1.88E−03 | 1 | 32 |
| LBY50 | 0.72 | 2.97E−02 | 1 | 17 | LBY50 | 0.90 | 1.10E−03 | 1 | 43 |
| LBY50 | 0.80 | 9.25E−03 | 1 | 47 | LBY50 | 0.96 | 5.88E−05 | 1 | 12 |
| LBY50 | 0.90 | 8.24E−04 | 1 | 40 | LBY50 | 0.91 | 6.79E−04 | 1 | 45 |
| LBY50 | 0.90 | 8.87E−04 | 1 | 44 | LBY50 | 0.89 | 1.16E−03 | 1 | 42 |
| LBY50 | 0.88 | 1.65E−03 | 1 | 41 | LBY50 | 0.86 | 2.61E−03 | 1 | 46 |
| LBY50 | 0.77 | 2.03E−03 | 3 | 48 | LBY51 | 0.81 | 8.68E−03 | 1 | 8 |
| LBY51 | 0.75 | 1.91E−02 | 1 | 9 | LBY51 | 0.71 | 3.23E−02 | 1 | 21 |
| LBY51 | 0.76 | 1.70E−02 | 1 | 3 | LBY51 | 0.75 | 1.98E−02 | 1 | 28 |
| LBY51 | 0.84 | 4.90E−03 | 1 | 7 | LBY51 | 0.83 | 5.72E−03 | 1 | 6 |
| LBY51 | 0.73 | 2.54E−02 | 1 | 10 | LBY52 | 0.73 | 2.54E−02 | 1 | 14 |
| LBY52 | 0.75 | 3.06E−03 | 3 | 14 | LBY53 | 0.71 | 3.05E−02 | 1 | 32 |
| LBY53 | 0.72 | 2.88E−02 | 1 | 43 | LBY53 | 0.75 | 2.12E−02 | 1 | 12 |
| LBY53 | 0.74 | 2.22E−02 | 1 | 16 | LBY53 | 0.71 | 3.22E−02 | 1 | 42 |
| LBY53 | 0.73 | 2.47E−02 | 1 | 23 | LBY53 | 0.70 | 3.49E−02 | 1 | 41 |
| LBY54 | 0.77 | 3.47E−03 | 2 | 21 | LBY54 | 0.78 | 2.72E−03 | 2 | 3 |
| LBY54 | 0.73 | 2.65E−02 | 1 | 30 | LBY54 | 0.71 | 6.34E−03 | 3 | 8 |
| LBY54 | 0.73 | 4.28E−03 | 3 | 9 | LBY54 | 0.73 | 4.46E−03 | 3 | 3 |
| LBY54 | 0.74 | 4.07E−03 | 3 | 6 | LBY93 | 0.79 | 1.14E−02 | 1 | 32 |
| LBY94 | 0.71 | 3.28E−02 | 1 | 19 | LBY94 | 0.75 | 2.09E−02 | 1 | 32 |
| LBY94 | 0.82 | 7.17E−03 | 1 | 43 | LBY94 | 0.74 | 2.24E−02 | 1 | 47 |
| LBY94 | 0.81 | 8.73E−03 | 1 | 12 | LBY94 | 0.75 | 2.04E−02 | 1 | 40 |
| LBY94 | 0.75 | 1.91E−02 | 1 | 45 | LBY94 | 0.77 | 1.50E−02 | 1 | 42 |
| LBY94 | 0.80 | 9.43E−03 | 1 | 41 | LBY94 | 0.73 | 4.81E−03 | 3 | 27 |
| LBY95 | 0.71 | 3.26E−02 | 1 | 25 | LBY95 | 0.90 | 9.66E−04 | 1 | 32 |
| LBY95 | 0.73 | 2.68E−02 | 1 | 43 | LBY95 | 0.76 | 1.81E−02 | 1 | 12 |
| LBY95 | 0.75 | 1.95E−02 | 1 | 45 | LBY95 | 0.76 | 1.78E−02 | 1 | 41 |
| LBY96 | 0.72 | 7.69E−03 | 2 | 8 | LBY96 | 0.74 | 5.66E−03 | 2 | 9 |
| LBY96 | 0.70 | 1.11E−02 | 2 | 7 | LBY96 | 0.74 | 5.87E−03 | 2 | 6 |
| LGN40 | 0.79 | 1.22E−02 | 1 | 16 | | | | | |

Table 164. Provided are the correlations (R) between the genes expression levels in various tissues and the phenotypic performance. "Corr. ID"—correlation set ID according to the correlated parameters specified in Table 156. "Exp. Set"—Expression set specified in Table 153. "R" = Pearson correlation coefficient; "P" = p value

TABLE 165

Correlation between the expression level of selected genes of some embodiments of the invention in various tissues and the phenotypic performance under drought conditions (drought expression set 2) across Cotton accessions

| Gene Name | R | P value | Exp. set | Corr. Set ID | Gene Name | R | P value | Exp. set | Corr. Set ID |
|---|---|---|---|---|---|---|---|---|---|
| LBY45 | 0.75 | 7.41E−03 | 4 | 2 | LBY45 | 0.79 | 4.02E−03 | 4 | 8 |
| LBY45 | 0.84 | 1.27E−03 | 4 | 9 | LBY45 | 0.88 | 3.92E−04 | 4 | 21 |
| LBY45 | 0.84 | 1.22E−03 | 4 | 3 | LBY45 | 0.70 | 1.56E−02 | 4 | 7 |
| LBY45 | 0.71 | 1.37E−02 | 4 | 20 | LBY45 | 0.91 | 1.11E−04 | 4 | 10 |
| LBY45 | 0.74 | 2.29E−02 | 7 | 2 | LBY45 | 0.83 | 5.19E−03 | 7 | 8 |
| LBY45 | 0.81 | 8.01E−03 | 7 | 9 | LBY45 | 0.83 | 5.18E−03 | 7 | 21 |
| LBY45 | 0.78 | 1.39E−02 | 7 | 3 | LBY45 | 0.75 | 1.98E−02 | 7 | 14 |
| LBY45 | 0.72 | 3.02E−02 | 7 | 6 | LBY45 | 0.86 | 2.78E−03 | 7 | 20 |
| LBY45 | 0.91 | 5.75E−04 | 7 | 10 | LBY45 | 0.79 | 6.36E−03 | 3 | 26 |
| LBY45 | 0.92 | 1.97E−04 | 3 | 21 | LBY45 | 0.88 | 7.46E−04 | 3 | 3 |
| LBY45 | 0.73 | 1.65E−02 | 3 | 10 | LBY45 | 0.84 | 1.70E−02 | 2 | 40 |
| LBY45 | 0.79 | 3.35E−02 | 2 | 44 | LBY45 | 0.84 | 1.72E−02 | 2 | 42 |
| LBY45 | 0.83 | 1.96E−02 | 2 | 46 | LBY45 | 0.79 | 3.63E−02 | 1 | 28 |

TABLE 165-continued

Correlation between the expression level of selected genes of some embodiments of the invention in various tissues and the phenotypic performance under drought conditions (drought expression set 2) across Cotton accessions

| Gene Name | R | P value | Exp. set | Corr. Set ID | Gene Name | R | P value | Exp. set | Corr. Set ID |
|---|---|---|---|---|---|---|---|---|---|
| LBY45 | 0.74 | 5.57E−02 | 1 | 7 | LBY45 | 0.71 | 9.53E−03 | 5 | 16 |
| LBY45 | 0.78 | 2.95E−03 | 5 | 18 | LBY46 | 0.73 | 1.01E−02 | 4 | 8 |
| LBY46 | 0.80 | 3.00E−03 | 4 | 31 | LBY46 | 0.81 | 2.50E−03 | 4 | 9 |
| LBY46 | 0.71 | 1.39E−02 | 4 | 3 | LBY46 | 0.81 | 2.77E−03 | 4 | 7 |
| LBY46 | 0.81 | 2.60E−03 | 4 | 6 | LBY46 | 0.82 | 4.47E−02 | 4 | 44 |
| LBY46 | 0.71 | 1.37E−02 | 4 | 10 | LBY46 | 0.85 | 9.87E−04 | 4 | 37 |
| LBY46 | 0.80 | 5.56E−02 | 4 | 46 | LBY46 | 0.87 | 1.11E−03 | 6 | 31 |
| LBY46 | 0.82 | 3.81E−03 | 6 | 9 | LBY46 | 0.70 | 2.37E−02 | 6 | 3 |
| LBY46 | 0.74 | 1.54E−02 | 6 | 7 | LBY46 | 0.74 | 1.36E−02 | 6 | 6 |
| LBY46 | 0.77 | 9.40E−03 | 6 | 10 | LBY46 | 0.72 | 1.77E−02 | 6 | 15 |
| LBY46 | 0.83 | 2.89E−03 | 6 | 37 | LBY46 | 0.78 | 1.25E−02 | 7 | 48 |
| LBY46 | 0.72 | 1.93E−02 | 3 | 9 | LBY46 | 0.71 | 2.05E−02 | 3 | 29 |
| LBY46 | 0.76 | 1.14E−02 | 3 | 7 | LBY46 | 0.75 | 1.18E−02 | 3 | 6 |
| LBY46 | 0.72 | 1.91E−02 | 3 | 20 | LBY46 | 0.76 | 1.08E−02 | 3 | 37 |
| LBY46 | 0.71 | 7.32E−02 | 1 | 48 | LBY46 | 0.86 | 1.21E−02 | 1 | 38 |
| LBY46 | 0.72 | 6.69E−02 | 1 | 50 | LBY46 | 0.71 | 7.59E−02 | 1 | 22 |
| LBY46 | 0.71 | 9.38E−03 | 5 | 17 | LBY47 | 0.73 | 1.63E−02 | 6 | 8 |
| LBY47 | 0.70 | 2.38E−02 | 6 | 9 | LBY47 | 0.75 | 1.23E−02 | 6 | 21 |
| LBY47 | 0.72 | 1.79E−02 | 6 | 3 | LBY47 | 0.74 | 1.38E−02 | 6 | 7 |
| LBY47 | 0.79 | 6.64E−03 | 6 | 6 | LBY47 | 0.79 | 2.12E−03 | 2 | 7 |
| LBY47 | 0.76 | 4.61E−02 | 1 | 48 | LBY47 | 0.77 | 4.35E−02 | 1 | 50 |
| LBY48 | 0.77 | 5.85E−03 | 4 | 48 | LBY48 | 0.78 | 4.87E−03 | 4 | 14 |
| LBY48 | 0.71 | 1.39E−02 | 4 | 29 | LBY48 | 0.91 | 9.55E−05 | 4 | 20 |
| LBY48 | 0.73 | 6.22E−02 | 7 | 41 | LBY48 | 0.85 | 1.44E−02 | 1 | 24 |
| LBY48 | 0.79 | 2.21E−03 | 5 | 9 | LBY48 | 0.76 | 4.38E−03 | 5 | 21 |
| LBY48 | 0.78 | 2.68E−03 | 5 | 3 | LBY48 | 0.76 | 4.51E−03 | 5 | 10 |
| LBY49 | 0.86 | 1.30E−03 | 6 | 8 | LBY49 | 0.72 | 1.82E−02 | 6 | 9 |
| LBY49 | 0.85 | 1.85E−03 | 6 | 21 | LBY49 | 0.81 | 4.26E−03 | 6 | 3 |
| LBY49 | 0.76 | 1.15E−02 | 6 | 7 | LBY49 | 0.78 | 8.44E−03 | 6 | 6 |
| LBY49 | 0.71 | 2.24E−02 | 6 | 20 | LBY49 | 0.78 | 8.46E−03 | 6 | 10 |
| LBY49 | 0.75 | 1.30E−02 | 6 | 37 | LBY49 | 0.90 | 2.19E−03 | 7 | 33 |
| LBY49 | 0.71 | 2.06E−02 | 3 | 9 | LBY49 | 0.95 | 3.50E−05 | 3 | 21 |
| LBY49 | 0.91 | 2.61E−04 | 3 | 3 | LBY49 | 0.71 | 2.21E−02 | 3 | 10 |
| LBY49 | 0.73 | 7.28E−03 | 2 | 31 | LBY49 | 0.81 | 2.57E−02 | 1 | 48 |
| LBY49 | 0.70 | 7.79E−02 | 1 | 14 | LBY49 | 0.71 | 7.28E−02 | 1 | 10 |
| LBY49 | 0.80 | 1.87E−03 | 5 | 8 | LBY49 | 0.78 | 2.64E−03 | 5 | 9 |
| LBY49 | 0.84 | 7.23E−04 | 5 | 21 | LBY49 | 0.82 | 1.12E−03 | 5 | 3 |
| LBY49 | 0.79 | 2.29E−03 | 5 | 7 | LBY49 | 0.72 | 7.79E−03 | 5 | 6 |
| LBY49 | 0.78 | 2.77E−03 | 5 | 20 | LBY49 | 0.76 | 4.26E−03 | 5 | 10 |
| LBY50 | 0.74 | 9.19E−02 | 4 | 44 | LBY50 | 0.71 | 1.13E−01 | 4 | 46 |
| LBY50 | 0.76 | 9.95E−03 | 6 | 39 | LBY50 | 0.72 | 7.06E−02 | 7 | 47 |
| LBY50 | 0.81 | 8.68E−03 | 7 | 50 | LBY50 | 0.81 | 2.76E−02 | 7 | 45 |
| LBY50 | 0.76 | 7.94E−02 | 1 | 43 | LBY50 | 0.72 | 1.08E−01 | 1 | 47 |
| LBY50 | 0.77 | 7.58E−02 | 1 | 33 | LBY50 | 0.73 | 6.10E−02 | 1 | 11 |
| LBY50 | 0.70 | 1.21E−01 | 1 | 45 | LBY50 | 0.74 | 9.11E−02 | 1 | 41 |
| LBY50 | 0.92 | 2.06E−05 | 5 | 17 | LBY50 | 0.91 | 4.01E−05 | 5 | 16 |
| LBY50 | 0.98 | 4.18E−08 | 5 | 18 | LBY51 | 0.71 | 1.41E−02 | 4 | 8 |
| LBY51 | 0.78 | 4.21E−03 | 4 | 31 | LBY51 | 0.75 | 8.13E−03 | 4 | 48 |
| LBY51 | 0.83 | 1.66E−03 | 4 | 9 | LBY51 | 0.71 | 1.36E−02 | 4 | 3 |
| LBY51 | 0.74 | 9.89E−03 | 4 | 29 | LBY51 | 0.71 | 1.47E−02 | 4 | 7 |
| LBY51 | 0.75 | 7.88E−03 | 4 | 6 | LBY51 | 0.76 | 6.98E−03 | 4 | 10 |
| LBY51 | 0.83 | 1.45E−03 | 4 | 37 | LBY51 | 0.79 | 6.43E−03 | 6 | 9 |
| LBY51 | 0.71 | 2.06E−02 | 6 | 3 | LBY51 | 0.79 | 6.32E−03 | 6 | 10 |
| LBY51 | 0.80 | 5.71E−03 | 6 | 37 | LBY51 | 0.71 | 3.21E−02 | 7 | 22 |
| LBY51 | 0.70 | 2.38E−02 | 3 | 30 | LBY51 | 0.82 | 9.81E−04 | 2 | 48 |
| LBY51 | 0.73 | 7.37E−03 | 2 | 9 | LBY51 | 0.72 | 7.97E−03 | 2 | 3 |
| LBY51 | 0.75 | 5.23E−02 | 1 | 9 | LBY51 | 0.74 | 5.90E−02 | 1 | 21 |
| LBY51 | 0.78 | 3.95E−02 | 1 | 3 | LBY51 | 0.74 | 5.78E−02 | 1 | 20 |
| LBY51 | 0.81 | 2.85E−02 | 1 | 10 | LBY51 | 0.79 | 2.42E−03 | 5 | 7 |
| LBY51 | 0.70 | 1.12E−02 | 5 | 6 | LBY51 | 0.75 | 5.22E−03 | 5 | 37 |
| LBY52 | 0.89 | 5.97E−04 | 3 | 50 | LBY52 | 0.80 | 3.20E−02 | 1 | 25 |
| LBY52 | 0.74 | 5.93E−02 | 1 | 5 | LBY52 | 0.77 | 4.38E−02 | 1 | 49 |
| LBY52 | 0.79 | 2.03E−03 | 5 | 8 | LBY52 | 0.74 | 6.05E−03 | 5 | 9 |
| LBY52 | 0.81 | 1.49E−03 | 5 | 21 | LBY52 | 0.74 | 6.06E−03 | 5 | 3 |
| LBY52 | 0.76 | 4.17E−03 | 5 | 20 | LBY52 | 0.80 | 1.90E−03 | 5 | 10 |
| LBY53 | 0.71 | 3.38E−02 | 7 | 2 | LBY53 | 0.73 | 2.55E−02 | 7 | 9 |
| LBY53 | 0.84 | 4.45E−03 | 7 | 21 | LBY53 | 0.81 | 8.37E−03 | 7 | 3 |
| LBY53 | 0.74 | 2.36E−02 | 7 | 10 | LBY53 | 0.72 | 1.79E−02 | 3 | 8 |
| LBY53 | 0.72 | 1.89E−02 | 3 | 9 | LBY53 | 0.86 | 1.28E−03 | 3 | 21 |
| LBY53 | 0.81 | 4.56E−03 | 3 | 3 | LBY53 | 0.78 | 7.21E−03 | 3 | 10 |
| LBY53 | 0.78 | 3.85E−02 | 1 | 8 | LBY53 | 0.89 | 7.21E−03 | 1 | 9 |
| LBY53 | 0.97 | 3.95E−04 | 1 | 21 | LBY53 | 0.94 | 1.41E−03 | 1 | 3 |
| LBY53 | 0.84 | 1.70E−02 | 1 | 29 | LBY53 | 0.80 | 3.19E−02 | 1 | 7 |

TABLE 165-continued

Correlation between the expression level of selected genes of some embodiments of the invention in various tissues and the phenotypic performance under drought conditions (drought expression set 2) across Cotton accessions

| Gene Name | R | P value | Exp. set | Corr. Set ID | Gene Name | R | P value | Exp. set | Corr. Set ID |
|---|---|---|---|---|---|---|---|---|---|
| LBY53 | 0.95 | 1.28E−03 | 1 | 20 | LBY53 | 0.87 | 1.16E−02 | 1 | 10 |
| LBY53 | 0.72 | 6.69E−02 | 1 | 15 | LBY53 | 0.74 | 5.76E−03 | 5 | 8 |
| LBY53 | 0.85 | 4.57E−04 | 5 | 9 | LBY53 | 0.87 | 2.19E−04 | 5 | 21 |
| LBY53 | 0.89 | 1.13E−04 | 5 | 3 | LBY53 | 0.81 | 1.57E−03 | 5 | 7 |
| LBY53 | 0.76 | 3.97E−03 | 5 | 6 | LBY53 | 0.71 | 9.24E−03 | 5 | 20 |
| LBY53 | 0.79 | 2.43E−03 | 5 | 10 | LBY54 | 0.79 | 3.51E−03 | 4 | 2 |
| LBY54 | 0.77 | 5.63E−03 | 4 | 9 | LBY54 | 0.71 | 1.44E−02 | 4 | 21 |
| LBY54 | 0.80 | 3.15E−03 | 4 | 3 | LBY54 | 0.72 | 1.20E−02 | 4 | 7 |
| LBY54 | 0.73 | 1.15E−02 | 4 | 10 | LBY54 | 0.73 | 1.11E−02 | 4 | 15 |
| LBY54 | 0.71 | 1.46E−02 | 4 | 37 | LBY54 | 0.70 | 2.32E−02 | 6 | 48 |
| LBY54 | 0.78 | 7.95E−03 | 6 | 20 | LBY54 | 0.76 | 1.84E−02 | 7 | 2 |
| LBY54 | 0.75 | 2.10E−02 | 7 | 8 | LBY54 | 0.72 | 2.89E−02 | 7 | 9 |
| LBY54 | 0.86 | 3.07E−03 | 7 | 21 | LBY54 | 0.81 | 8.47E−03 | 7 | 3 |
| LBY54 | 0.76 | 1.74E−02 | 7 | 7 | LBY54 | 0.78 | 1.41E−02 | 7 | 10 |
| LBY54 | 0.88 | 7.21E−04 | 3 | 17 | LBY54 | 0.84 | 2.17E−03 | 3 | 18 |
| LBY54 | 0.70 | 7.81E−02 | 1 | 2 | LBY54 | 0.84 | 1.81E−02 | 1 | 8 |
| LBY54 | 0.92 | 3.29E−03 | 1 | 9 | LBY54 | 0.95 | 8.32E−04 | 1 | 21 |
| LBY54 | 0.93 | 2.31E−03 | 1 | 3 | LBY54 | 0.85 | 1.51E−02 | 1 | 29 |
| LBY54 | 0.86 | 1.32E−02 | 1 | 7 | LBY54 | 0.76 | 4.92E−02 | 1 | 6 |
| LBY54 | 0.93 | 2.56E−03 | 1 | 20 | LBY54 | 0.88 | 9.72E−03 | 1 | 10 |
| LBY54 | 0.73 | 6.24E−02 | 1 | 15 | LBY54 | 0.78 | 2.89E−03 | 5 | 8 |
| LBY54 | 0.73 | 7.10E−03 | 5 | 9 | LBY54 | 0.84 | 6.57E−04 | 5 | 21 |
| LBY54 | 0.79 | 2.15E−03 | 5 | 3 | LBY54 | 0.76 | 3.75E−03 | 5 | 7 |
| LBY54 | 0.78 | 2.71E−03 | 5 | 6 | LBY93 | 0.75 | 7.99E−03 | 4 | 17 |
| LBY93 | 0.83 | 2.96E−03 | 4 | 33 | LBY93 | 0.75 | 1.31E−02 | 3 | 21 |
| LBY93 | 0.73 | 1.58E−02 | 3 | 3 | LBY93 | 0.77 | 4.29E−02 | 1 | 2 |
| LBY93 | 0.73 | 6.50E−02 | 1 | 8 | LBY93 | 0.74 | 5.55E−02 | 1 | 9 |
| LBY93 | 0.70 | 7.93E−02 | 1 | 21 | LBY93 | 0.87 | 1.09E−02 | 1 | 7 |
| LBY93 | 0.77 | 4.47E−02 | 1 | 6 | LBY93 | 0.79 | 2.34E−03 | 5 | 16 |
| LBY94 | 0.86 | 6.78E−04 | 4 | 17 | LBY94 | 0.78 | 4.35E−03 | 4 | 16 |
| LBY94 | 0.81 | 2.43E−03 | 4 | 18 | LBY94 | 0.71 | 2.03E−02 | 6 | 19 |
| LBY94 | 0.77 | 4.33E−02 | 7 | 47 | LBY94 | 0.71 | 7.67E−02 | 7 | 41 |
| LBY94 | 0.78 | 2.74E−03 | 2 | 17 | LBY94 | 0.72 | 8.48E−03 | 2 | 18 |
| LBY94 | 0.75 | 5.06E−02 | 1 | 8 | LBY94 | 0.88 | 8.90E−03 | 1 | 35 |
| LBY94 | 0.78 | 3.82E−02 | 1 | 38 | LBY94 | 0.71 | 7.12E−02 | 1 | 7 |
| LBY94 | 0.78 | 3.76E−02 | 1 | 6 | LBY94 | 0.90 | 5.62E−03 | 1 | 22 |
| LBY94 | 0.72 | 6.61E−02 | 1 | 39 | LBY94 | 0.83 | 2.06E−02 | 1 | 37 |
| LBY94 | 0.85 | 4.30E−04 | 5 | 16 | LBY94 | 0.71 | 9.77E−03 | 5 | 18 |
| LBY94 | 0.75 | 4.72E−03 | 5 | 20 | LBY94 | 0.75 | 5.39E−03 | 5 | 10 |
| LBY95 | 0.72 | 1.31E−02 | 4 | 8 | LBY95 | 0.72 | 1.31E−02 | 4 | 9 |
| LBY95 | 0.76 | 1.07E−02 | 6 | 17 | LBY95 | 0.74 | 1.39E−02 | 6 | 16 |
| LBY95 | 0.71 | 2.02E−02 | 6 | 18 | LBY95 | 0.73 | 2.46E−02 | 7 | 18 |
| LBY95 | 0.76 | 1.68E−02 | 7 | 39 | LBY95 | 0.72 | 1.98E−02 | 3 | 8 |
| LBY95 | 0.87 | 1.11E−03 | 3 | 21 | LBY95 | 0.81 | 4.21E−03 | 3 | 3 |
| LBY95 | 0.70 | 2.28E−02 | 3 | 7 | LBY95 | 0.70 | 2.42E−02 | 2 | 47 |
| LBY95 | 0.81 | 2.79E−02 | 2 | 40 | LBY95 | 0.77 | 5.96E−03 | 2 | 33 |
| LBY95 | 0.72 | 6.82E−02 | 2 | 44 | LBY95 | 0.84 | 1.90E−02 | 2 | 42 |
| LBY95 | 0.80 | 2.93E−02 | 2 | 46 | LBY95 | 0.77 | 4.24E−02 | 1 | 38 |
| LBY95 | 0.71 | 7.62E−02 | 1 | 50 | LBY95 | 0.78 | 3.67E−02 | 1 | 39 |
| LBY95 | 0.71 | 7.62E−02 | 1 | 13 | LBY95 | 0.71 | 9.62E−03 | 5 | 32 |
| LBY95 | 0.95 | 3.58E−06 | 5 | 17 | LBY95 | 0.90 | 5.38E−05 | 5 | 16 |
| LBY95 | 0.93 | 1.15E−05 | 5 | 18 | LBY96 | 0.79 | 4.03E−03 | 4 | 39 |
| LBY96 | 0.72 | 1.30E−02 | 4 | 20 | LBY96 | 0.92 | 2.88E−03 | 7 | 43 |
| LBY96 | 0.73 | 2.51E−02 | 7 | 30 | LBY96 | 0.82 | 2.38E−02 | 7 | 41 |
| LBY96 | 0.70 | 7.75E−02 | 1 | 32 | LBY96 | 0.71 | 7.65E−02 | 1 | 17 |
| LBY96 | 0.76 | 4.74E−02 | 1 | 34 | LBY96 | 0.94 | 1.79E−03 | 1 | 16 |
| LBY96 | 0.89 | 7.29E−03 | 1 | 18 | LBY96 | 0.83 | 2.20E−02 | 1 | 23 |
| LBY96 | 0.75 | 4.91E−03 | 5 | 2 | LBY96 | 0.73 | 6.76E−03 | 5 | 8 |
| LBY96 | 0.79 | 2.01E−03 | 5 | 9 | LBY96 | 0.80 | 1.87E−03 | 5 | 21 |
| LBY96 | 0.77 | 3.72E−03 | 5 | 3 | LBY96 | 0.74 | 5.44E−03 | 5 | 29 |
| LBY96 | 0.87 | 2.46E−04 | 5 | 20 | LBY96 | 0.80 | 1.83E−03 | 5 | 10 |
| LBY97 | 0.71 | 1.38E−02 | 4 | 48 | LBY97 | 0.80 | 2.83E−03 | 4 | 38 |
| LBY97 | 0.74 | 1.37E−02 | 6 | 32 | LBY97 | 0.96 | 3.32E−05 | 7 | 8 |
| LBY97 | 0.70 | 3.44E−02 | 7 | 48 | LBY97 | 0.83 | 5.88E−03 | 7 | 9 |
| LBY97 | 0.90 | 9.18E−04 | 7 | 21 | LBY97 | 0.88 | 1.96E−03 | 7 | 3 |
| LBY97 | 0.84 | 4.50E−03 | 7 | 7 | LBY97 | 0.88 | 1.52E−03 | 7 | 6 |
| LBY97 | 0.76 | 1.65E−02 | 7 | 10 | LBY97 | 0.81 | 7.48E−03 | 7 | 37 |
| LBY97 | 0.75 | 1.33E−02 | 5 | 45 | LGN40 | 0.72 | 1.22E−02 | 4 | 2 |
| LGN40 | 0.78 | 4.76E−03 | 4 | 9 | LGN40 | 0.88 | 3.70E−04 | 4 | 21 |
| LGN40 | 0.90 | 1.32E−04 | 4 | 3 | LGN40 | 0.84 | 1.29E−03 | 4 | 10 |
| LGN40 | 0.71 | 2.11E−02 | 6 | 24 | LGN40 | 0.82 | 1.31E−02 | 6 | 43 |
| LGN40 | 0.82 | 3.31E−03 | 6 | 12 | LGN40 | 0.91 | 1.21E−02 | 6 | 40 |
| LGN40 | 0.73 | 1.03E−01 | 6 | 44 | LGN40 | 0.91 | 1.13E−02 | 6 | 42 |

TABLE 165-continued

Correlation between the expression level of selected genes of some embodiments of the invention in various tissues and the phenotypic performance under drought conditions (drought expression set 2) across Cotton accessions

| Gene Name | R | P value | Exp. set | Corr. Set ID | Gene Name | R | P value | Exp. set | Corr. Set ID |
|---|---|---|---|---|---|---|---|---|---|
| LGN40 | 0.73 | 3.95E−02 | 6 | 41 | LGN40 | 0.76 | 7.90E−02 | 6 | 46 |
| LGN40 | 0.73 | 1.56E−02 | 3 | 9 | LGN40 | 0.90 | 3.62E−04 | 3 | 21 |
| LGN40 | 0.91 | 2.35E−04 | 3 | 3 | LGN40 | 0.77 | 9.87E−03 | 3 | 10 |

Table 165. Provided are the correlations (R) between the genes expression levels in various tissues and the phenotypic performance. "Corr. ID"—correlation set ID according to the correlated parameters specified in Table 156. "Exp. Set"—Expression set specified in Table 154. "R" = Pearson correlation coefficient; "P" = p value.

Example 19

Production of Bean Transcriptome and High Throughput Correlation Analysis with Yield Parameters Using 60K Bean (*Phaseolus Vulgaris* L.) Oligonucleotide Micro-Arrays In order to produce a high throughput correlation analysis, the present inventors utilized a Bean oligonucleotide microarray, produced by Agilent Technologies [chem. (dot) agilent (dot) com/Scripts/PDS (dot) asp?1Page=50879]. The array oligonucleotide represents about 60,000 Bean genes and transcripts. In order to define correlations between the levels of RNA expression with yield components or plant architecture related parameters or plant vigor related parameters, various plant characteristics of 40 different commercialized bean varieties were analyzed and further used for RNA expression analysis. The correlation between the RNA levels and the characterized parameters was analyzed using Pearson correlation test [davidmlane (dot) com/hyperstat/A34739 (dot) html].

Experimental Procedures

Analyzed Bean Tissues

Six tissues [leaf, Stem, lateral stem, lateral branch flower bud, lateral branch pod with seeds and meristem] growing under normal conditions [field experiment, normal growth conditions which included irrigation with water 2-3 times a week with 524 m³ water per dunam (1000 square meters) per entire growth period, and fertilization of 16 units nitrogen per dunam given in the first month of the growth period] were sampled and RNA was extracted as described above.

For convenience, each micro-array expression information tissue type has received a Set ID as summarized in Table 166 below.

TABLE 166

Bean transcriptome expression sets

| Expression Set | Set ID |
|---|---|
| Lateral branch flower bud at flowering stage under normal growth conditions | 1 |
| Lateral branch pod with seeds at pod setting stage under normal growth conditions | 2 |
| Lateral stem at pod setting stage under normal growth conditions | 3 |
| Lateral stem at flowering stage under normal growth conditions | 4 |
| Leaf at pod setting stage under normal growth conditions | 5 |

TABLE 166-continued

Bean transcriptome expression sets

| Expression Set | Set ID |
|---|---|
| Leaf at flowering stage under normal growth conditions | 6 |
| Leaf at vegetative stage under normal growth conditions | 7 |
| Meristem at vegetative stage under normal growth conditions | 8 |
| stem at vegetative stage under normal growth conditions | 9 |

Table 166: Provided are the bean transcriptome expression sets.
Lateral branch flower bud = flower bud from vegetative branch; Lateral branch pod with seeds = pod with seeds from vegetative branch; Lateral stem = stem from vegetative branch.

Bean Yield Components and Vigor Related Parameters Assessment

40 Bean varieties were grown in five repetitive plots, in field. Briefly, the growing protocol was as follows: Bean seeds were sown in soil and grown under normal conditions until harvest. Plants were continuously phenotyped during the growth period and at harvest (Table 167). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The collected data parameters were as follows:

% Canopy coverage—percent Canopy coverage at grain filling stage, R1 flowering stage and at vegetative stage. The % Canopy coverage is calculated using Formula XXXII above.

1000 seed weight [gr.]—At the end of the experiment all seeds from all plots were collected and weighted and the weight of 1000 were calculated.

Days till 50% flowering [days]—number of days till 50% flowering for each plot.

Avr shoot DW—At the end of the experiment, the shoot material was collected, measured and divided by the number of plants.

Big pods FW per plant (PS) [gr.]—1 meter big pods fresh weight at pod setting divided by the number of plants.

Big pods number per plant (PS)—number of pods at development stage of R3-4 period above 4 cm per plant at pod setting.

Small pods FW per plant (PS) [gr.]—1 meter small pods fresh weight at pod setting divided by the number of plants.

Small pods num per plant (PS)—number of pods at development stage of R3-4 period below 4 cm per plant at pod setting.

Pod Area [cm$^2$]—At development stage of R3-4 period pods of three plants were weighted, photographed and images were processed using the below described image processing system. The pod area above 4 cm and below 4 cm was measured from those images and was divided by the number of pods.

Pod Length and Pod width [cm]—At development stage of R3-4 period pods of three plants were weighted, photographed and images were processed using the below described image processing system. The sum of pod lengths/ or width (longest axis) was measured from those images and was divided by the number of pods.

Num of lateral branches per plant [value/plant]—number of lateral branches per plant at vegetative stage (average of two plants per plot) and at harvest (average of three plants per plot).

Relative growth rate [cm/day]—the relative growth rate (RGR) of Plant Height was calculated using Formula III above.

Leaf area per plant (PS) [cm$^2$]=Total leaf area of 3 plants in a plot at pod setting. Measurement was performed using a Leaf area-meter.

Specific leaf area (PS) [cm$^2$/gr.]—leaf area per leaf dry weight at pod set.

Leaf form—Leaf length (cm)/leaf width (cm); average of two plants per plot.

Leaf number per plant (PS)—Plants were characterized for leaf number during pod setting stage. Plants were measured for their leaf number by counting all the leaves of 3 selected plants per plot.

Plant height [cm]—Plants were characterized for height during growing period at 3 time points. In each measure, plants were measured for their height using a measuring tape. Height of main stem was measured from first node above ground to last node before apex.

Seed yield per area (H) [gr.]—1 meter seeds weight at harvest.

Seed yield per plant (H) [gr.]—Average seeds weight per plant at harvest in 1 meter plot.

Seeds num per area (H)—1 meter plot seeds number at harvest.

Total seeds per plant (H)—Seeds number on lateral branch per plant+Seeds number on main branch per plant at harvest, average of three plants per plot.

Total seeds weight per plant (PS) [gr.]—Seeds weight on lateral branch+Seeds weight on main branch at pod set per plant, average of three plants per plot.

Small pods FW per plant (PS)—Average small pods (below 4 cm) fresh weight per plant at pod setting per meter.

Small pods num per plant (PS)—Number of Pods below 4 cm per plant at pod setting, average of two plants per plot.

SPAD—Plants were characterized for SPAD rate during growing period at grain filling stage and vegetative stage. Chlorophyll content was determined using a Minolta SPAD 502 chlorophyll meter and measurement was performed 64 days post sowing. SPAD meter readings were done on young fully developed leaf. Three measurements per leaf were taken per plot.

Stem width (R2F)[mm]—width of the stem of the first node at R2 flowering stage, average of two plants per plot.

Total pods number per plant (H), (PS)—Pods number on lateral branch per plant+Pods number on main branch per plant at pod setting and at harvest, average of three plants per plot.

Total pods DW per plant (H) [gr.]—Pods dry weight on main branch per plant+Pods dry weight on lateral branch per plant at harvest, average of three plants per plot.

Total pods FW per plant (PS) [gr.]—Average pods fresh weight on lateral branch+Pods weight on main branch at pod setting.

Pods weight per plant (RP) (H) [gr.]—Average pods weight per plant at harvest in 1 meter.

Total seeds per plant (H), (PS)—Seeds number on lateral branch per plant+Seeds number on main branch per plant at pod setting and at harvest. average of three plants per plot.

Total seeds num per pod (H), (PS)—Total seeds num per plant divided in total pods num per plant, average of three plants per plot.

Vegetative FW and DW per plant (PS) [gr/plant]—total weight of the vegetative portion above ground (excluding roots and pods) before and after drying at 70° C. in oven for 48 hours at pod set, average of three plants per plot.

Vigor till flowering [gr./day]—Relative growth rate (RGR) of shoot DW=Regression coefficient of shoot DW along time course (two measurements at vegetative stage and one measurement at flowering stage).

Vigor post flowering [gr./day]—Relative growth rate (RGR) of shoot DW=Regression coefficient of shoot DW measurements along time course (one measurement at flowering stage and two measurements at grain filling stage).

Experimental Results 40 different bean varieties lines 1-40 were grown and characterized for 48 parameters as specified above. Among the 40 varieties, 16 varieties are "fine" and "extra fine". The average for each of the measured parameters was calculated using the JMP software and values are summarized in Tables 168-169 below. Subsequent correlation analysis between the various transcriptome sets and the average parameters was conducted (Table 170).

TABLE 167

Bean correlated parameters (vectors)

| Correlated parameter with | Correlation ID |
|---|---|
| % Canopy coverage (GF) [percentage] | 1 |
| % Canopy coverage (R1F) [percentage] | 2 |
| % Canopy coverage (V) [percentage] | 3 |
| % Seed weight (EGF) [gr.] | 4 |
| % Seed weight (LGF) [gr.] | 5 |
| 1000 seed weight [gr.] | 6 |
| Avr shoot DW (EGF) [gr.] | 7 |
| Avr shoot DW (R2F) [gr.] | 8 |
| Avr shoot DW (V) [gr.] | 9 |
| Big pods FW per plant (PS) (RP) [gr.] | 10 |
| Big pods num per plant (PS) [gr.] | 11 |
| CV(Pod_Area_Below_4 cm) [percentage] | 12 |
| CV(Pod_Average_Width) [percentage] | 13 |
| CV(Pod_Length) [percentage] | 14 |
| CV(Pod_Length_Below_4 cm) [percentage] | 15 |
| Days to 50% flowering [number] | 16 |
| Height Rate [cm/day] | 17 |
| Leaf Length [cm] | 18 |
| Leaf Width [cm] | 19 |
| Leaf area per plant (PS) [cm$^2$] | 20 |
| Leaf form [cm/cm] | 21 |
| Leaf num per plant (PS) [number] | 22 |
| Mean (Pod_Area) [cm$^2$] | 23 |
| Mean(Pod_Area_Below_4cm) [cm$^2$] | 24 |
| Mean(Pod_Average_Width) [cm] | 25 |
| Mean(Pod_Length) [cm] | 26 |
| Mean(Pod_Length_Below_4cm) [cm] | 27 |
| Num of lateral branches per plant (H) [number] | 28 |

TABLE 167-continued

Bean correlated parameters (vectors)

| Correlated parameter with | Correlation ID |
|---|---|
| Num of lateral branches per plant (V) [number] | 29 |
| PAR_LAI (EGF) [μmol m$^{-2}$S$^{-1}$] | 30 |
| PAR_LAI (LGF) [μmol m$^{-2}$S$^{-1}$] | 31 |
| PAR_LAI (R1F) [μmol m$^{-2}$S$^{-1}$] | 32 |
| Plant height (GF) [cm] | 33 |
| Plant height (V2-V3) [cm] | 34 |
| Plant height (V4-V5) [cm] | 35 |
| Pods weight per plant (RP) (H) [gr.] | 36 |
| SPAD (GF) [SPAD unit] | 37 |
| SPAD (V) [SPAD unit] | 38 |
| Seed FW/podsW.O seeds FW (EGF) [gr.] | 39 |
| Seed FW/podsW.O seeds FW (LGF) [gr.] | 40 |
| Seed yield per area (H) (RP) [gr.] | 41 |
| Seed yield per plant (RP) (H) [gr.] | 42 |
| Seeds num per area (H) (RP) [number] | 43 |
| Small pods FW per plant (PS) (RP) [gr.] | 44 |
| Small pods num per plant (PS) [number] | 45 |
| Specific leaf area (PS) [cm$^2$/gr.] | 46 |
| Stem width (R2F) [mm] | 47 |
| Total pods DW per plant (H) [gr.] | 48 |
| Total pods num per plant (H) [number] | 49 |
| Total pods num per plant (PS) [number] | 50 |
| Total pods weight per plant (PS) [gr.] | 51 |
| Total seeds num per pod (H) [number] | 52 |
| Total seeds num per pod (PS) [number] | 53 |
| Total seeds per plant (H) [number] | 54 |
| Total seeds per plant (PS) [number] | 55 |
| Total seeds weight per plant (PS) [gr.] | 56 |
| Vegetative DW per plant (PS) [gr.] | 57 |
| Vegetative FW per plant (PS) [gr.] | 58 |
| Vigor post flowering [gr./day] | 59 |
| Vigor till flowering [gr./day] | 60 |

Table 167. Provided are the Bean correlated parameters (vectors). "gr." = grams; "SPAD" = chlorophyll levels; "PAR" = Photosynthetically active radiation; "FW" = Plant Fresh weight; "normal" = standard growth conditions; "H" = harvest; "PS" = pod setting; "v" = vegetative stage.

TABLE 168

Measured parameters in bean varieties (lines 1-8)

| Line/Corr. ID | Line-1 | Line-2 | Line-3 | Line-4 | Line-5 | Line-6 | Line-7 | Line-8 |
|---|---|---|---|---|---|---|---|---|
| 1 | 88.66 | 91.02 | 80.76 | 90.29 | 84.27 | NA | 73.90 | 66.50 |
| 2 | 89.59 | 78.87 | 72.28 | 90.49 | 73.78 | 76.45 | 91.63 | 72.86 |
| 3 | 70.53 | 58.56 | 38.98 | 83.64 | 46.91 | 51.88 | 59.82 | 65.28 |
| 4 | NA | 10.668 | 9.234 | 8.624 | 11.535 | 12.365 | NA | 12.053 |
| 5 | 45.34 | 30.72 | 31.77 | 37.30 | 12.62 | 40.98 | 37.70 | 33.54 |
| 6 | 94.43 | 117.59 | 69.63 | 123.75 | 66.31 | 93.68 | 72.75 | 107.37 |
| 7 | 16.192 | 18.656 | 19.292 | 27.824 | 14.442 | 18.024 | 15.575 | 31.030 |
| 8 | 7.334 | 8.283 | 6.370 | 11.850 | 5.418 | 7.399 | 8.019 | 9.338 |
| 9 | 0.302 | 0.329 | 0.240 | 0.443 | 0.206 | 0.349 | 0.243 | 0.384 |
| 10 | NA | 67.40 | 38.22 | 76.45 | 49.40 | 43.69 | NA | 49.94 |
| 11 | 24.25 | 35.25 | 65.00 | 26.50 | 38.75 | 35.50 | 49.75 | 22.25 |
| 12 | 0.280 | 0.263 | 0.211 | 0.225 | 0.217 | 0.231 | 0.196 | 0.203 |
| 13 | 20.30 | 41.79 | 32.10 | 19.35 | 21.75 | 37.40 | 41.54 | 22.06 |
| 14 | 19.39 | 40.69 | 36.57 | 19.08 | 17.38 | 41.36 | 42.84 | 22.62 |
| 15 | NA | 48.720 | 38.908 | 67.375 | 41.280 | 55.886 | 28.705 | NA |
| 16 | 55.0 | 55.0 | 55.0 | 48.0 | 55.0 | 55.0 | 48.0 | 55.0 |
| 17 | 0.974 | 0.849 | 0.907 | 0.853 | 0.720 | 1.062 | 0.814 | 1.073 |
| 18 | 13.339 | 11.638 | 11.140 | 13.149 | 11.989 | 12.346 | 12.643 | 11.987 |
| 19 | 8.161 | 8.834 | 7.027 | 8.422 | 7.854 | 8.133 | 7.781 | 7.614 |
| 20 | 211.67 | 307.13 | 133.13 | 308.07 | 157.53 | 155.00 | 192.00 | 273.47 |
| 21 | 1.641 | 1.315 | 1.585 | 1.563 | 1.528 | 1.517 | 1.626 | 1.577 |
| 22 | 4.733 | 6.067 | 4.733 | 6.167 | 5.000 | 5.417 | 5.867 | 6.133 |
| 23 | 6.534 | 4.294 | 3.692 | 8.039 | 5.733 | 5.696 | 4.151 | 6.869 |
| 24 | 1.00 | 6.00 | 9.50 | 3.00 | 2.00 | 5.00 | 8.75 | 1.00 |
| 25 | 0.714 | 0.593 | 0.480 | 0.825 | 0.619 | 0.679 | 0.471 | 0.698 |
| 26 | 10.998 | 7.653 | 8.335 | 11.291 | 10.975 | 9.066 | 9.077 | 11.417 |
| 27 | 0.484 | 0.432 | 0.386 | 0.321 | 0.532 | 0.419 | 0.400 | 0.404 |
| 28 | 7.933 | 6.200 | 7.933 | 7.000 | 9.667 | 7.533 | 9.200 | 8.867 |
| 29 | 4.90 | 4.90 | 5.80 | 6.60 | 5.10 | 5.70 | 5.50 | 6.00 |
| 30 | 8.435 | 7.845 | 5.780 | 7.609 | 6.286 | 6.598 | 6.737 | 6.771 |
| 31 | 6.146 | 5.842 | 4.377 | 4.013 | 4.950 | NA | 3.725 | 2.884 |
| 32 | 3.270 | 3.061 | 1.328 | 5.006 | 1.581 | 1.744 | 2.251 | 3.338 |
| 33 | 36.842 | 34.833 | 31.517 | 37.708 | 28.875 | 39.827 | 30.442 | 41.267 |
| 34 | 4.388 | 4.800 | 3.675 | 5.750 | 3.925 | 4.500 | 4.675 | 6.163 |
| 35 | 11.433 | 11.167 | 7.600 | 16.567 | 8.400 | 9.667 | 11.233 | 15.333 |
| 36 | 11.666 | 15.197 | 15.962 | 23.075 | 17.061 | 15.121 | 19.482 | 18.878 |
| 37 | 40.192 | 36.219 | 37.681 | NA | 39.396 | NA | NA | 43.006 |
| 38 | 36.000 | 39.436 | 31.413 | 40.147 | 35.756 | 35.011 | 35.751 | 35.133 |
| 39 | NA | 11.942 | 10.298 | 9.438 | 13.039 | 14.110 | NA | 13.705 |
| 40 | 92.310 | 44.351 | 25.951 | 60.205 | 14.875 | 51.058 | 61.491 | 51.320 |
| 41 | 342.4 | 457.2 | 196.7 | 430.6 | 198.1 | 371.6 | 431.5 | 533.6 |
| 42 | 6.306 | 8.291 | 4.532 | 9.202 | 4.018 | 6.553 | 7.917 | 9.622 |
| 43 | 3635.2 | 3879.6 | 2875.2 | 3485.8 | 3012.2 | 3953.8 | 5946.6 | 4920.2 |
| 44 | 0.622 | 2.064 | 1.146 | 0.602 | 0.796 | 1.268 | 0.001 | 0.726 |
| 45 | 0.500 | 6.000 | 9.500 | 1.500 | 1.000 | 5.000 | 8.750 | 0.500 |
| 46 | 226.3 | 222.3 | 213.0 | 207.3 | 257.8 | 238.2 | 248.2 | 237.7 |

TABLE 168-continued

Measured parameters in bean varieties (lines 1-8)

| Line/Corr. ID | Line-1 | Line-2 | Line-3 | Line-4 | Line-5 | Line-6 | Line-7 | Line-8 |
|---|---|---|---|---|---|---|---|---|
| 47 | 5.785 | 5.843 | 5.395 | 5.831 | 4.909 | 6.001 | 5.292 | 5.536 |
| 48 | 12.764 | 20.706 | 13.886 | 30.423 | 15.310 | 10.754 | 21.881 | 23.486 |
| 49 | 27.133 | 24.733 | 46.067 | 38.267 | 38.267 | 18.857 | 44.067 | 33.933 |
| 50 | 33.067 | 33.929 | 31.583 | 20.938 | 46.000 | 24.333 | 30.267 | 27.333 |
| 51 | 32.96 | 105.04 | 61.14 | 33.15 | 41.19 | 81.76 | 2.98 | 42.96 |
| 52 | 3.315 | 4.685 | 2.814 | 3.927 | 3.093 | 3.767 | 3.872 | 3.776 |
| 53 | 2.635 | 2.351 | 1.022 | 0.632 | 1.612 | 0.811 | 1.577 | 3.148 |
| 54 | 90.47 | 111.33 | 128.60 | 151.80 | 138.20 | 70.53 | 168.40 | 128.80 |
| 55 | 87.600 | 79.000 | 29.385 | 9.167 | 77.929 | 20.000 | 50.133 | 84.600 |
| 56 | NA | 3.448 | 0.500 | 0.173 | 2.877 | 0.390 | NA | 2.298 |
| 57 | 16.296 | 13.525 | 18.800 | 12.637 | 17.034 | 9.985 | 12.287 | 13.708 |
| 58 | 91.613 | 65.647 | 61.833 | 71.071 | 77.527 | 56.827 | 47.664 | 70.773 |
| 59 | 0.915 | 2.029 | 1.675 | 0.839 | 1.355 | NA | 1.524 | 1.388 |
| 60 | 0.444 | 0.456 | 0.352 | 1.183 | 0.380 | 0.390 | 0.453 | 0.579 |

Table 168. Provided are the values of each of the parameters (as described above) measured in Bean accessions (Line). Growth conditions are specified in the experimental procedure section

TABLE 169

Measured parameters in bean varieties (lines 9-16)

| Line/Corr. ID | Line-9 | Line-10 | Line-11 | Line-12 | Line-13 | Line-14 | Line-15 | Line-16 |
|---|---|---|---|---|---|---|---|---|
| 1 | 84.42 | NA | 83.89 | NA | 83.40 | NA | 79.59 | 75.12 |
| 2 | 83.06 | 86.63 | 82.53 | 83.35 | 84.21 | 73.07 | 71.41 | 68.05 |
| 3 | 64.09 | 89.99 | 62.34 | 63.42 | 61.26 | 38.21 | 40.26 | 26.24 |
| 4 | 11.762 | 8.418 | NA | NA | 9.446 | 12.067 | 7.503 | NA |
| 5 | 40.72 | 35.03 | 41.72 | 43.38 | 17.34 | 18.21 | 26.42 | 28.91 |
| 6 | 121.34 | 120.75 | 96.79 | 116.14 | 94.55 | 82.93 | 111.76 | 70.74 |
| 7 | 18.653 | 21.945 | 21.756 | 17.003 | 18.753 | 14.780 | 18.542 | 15.100 |
| 8 | 6.966 | 11.209 | 6.313 | 11.988 | 10.575 | 7.351 | 7.438 | 5.213 |
| 9 | 0.361 | 0.537 | 0.212 | 0.476 | 0.361 | 0.203 | 0.298 | 0.209 |
| 10 | 49.06 | 76.18 | NA | NA | 61.66 | 23.67 | 89.21 | NA |
| 11 | 23.25 | 28.25 | 32.00 | 32.75 | 34.17 | 46.50 | 23.50 | 68.75 |
| 12 | 0.319 | 0.233 | 0.216 | 0.257 | 0.256 | 0.219 | NA | 0.199 |
| 13 | 30.56 | 28.44 | 47.69 | 27.56 | 26.13 | 43.74 | 29.96 | 21.54 |
| 14 | 32.83 | 31.13 | 46.08 | 28.64 | 20.56 | 46.23 | 23.70 | 22.64 |
| 15 | 51.241 | 51.209 | 37.343 | 58.238 | 82.139 | 44.704 | NA | 71.494 |
| 16 | 55.0 | 48.0 | 55.0 | 48.0 | 55.0 | 48.0 | 55.0 | 55.0 |
| 17 | 1.182 | 1.303 | 0.941 | 0.980 | 0.876 | 0.790 | 0.960 | 0.705 |
| 18 | 12.787 | 12.174 | 10.387 | 11.156 | 13.102 | 11.793 | 11.632 | 12.882 |
| 19 | 7.517 | 7.730 | 6.259 | 7.045 | 8.234 | 7.099 | 7.329 | 8.680 |
| 20 | 180.73 | 324.07 | 175.80 | 242.20 | 200.60 | 174.00 | 146.89 | 61.67 |
| 21 | 1.700 | 1.577 | 1.675 | 1.593 | 1.593 | 1.662 | 1.590 | 1.484 |
| 22 | 4.133 | 7.167 | 7.000 | 6.188 | 5.133 | 4.533 | 5.111 | 3.643 |
| 23 | 7.369 | 7.532 | 5.677 | 7.889 | 6.264 | 4.296 | 8.222 | 5.230 |
| 24 | 2.33 | 2.00 | 6.25 | 3.00 | 1.67 | 9.50 | NA | 6.50 |
| 25 | 0.718 | 0.739 | 0.663 | 0.725 | 0.686 | 0.498 | 0.811 | 0.590 |
| 26 | 11.399 | 11.706 | 8.774 | 12.243 | 10.549 | 8.658 | 11.732 | 10.494 |
| 27 | 0.561 | 0.499 | 0.397 | 0.527 | 0.690 | 0.441 | NA | 0.527 |
| 28 | 9.000 | 6.941 | 8.267 | 6.533 | 8.200 | 6.933 | 8.667 | 10.667 |
| 29 | 6.00 | 6.92 | 7.60 | 6.40 | 8.40 | 6.20 | 6.00 | 4.60 |
| 30 | 7.015 | 7.399 | 6.210 | 6.421 | 8.401 | 5.108 | 4.656 | 4.557 |
| 31 | 5.164 | NA | 4.777 | NA | 4.673 | NA | 4.199 | 4.005 |
| 32 | 3.628 | 6.297 | 3.497 | 3.068 | 2.658 | 1.137 | 1.283 | 0.761 |
| 33 | 44.558 | 53.167 | 34.742 | 37.492 | 35.725 | 29.542 | 34.889 | 26.250 |
| 34 | 5.538 | 6.163 | 4.325 | 6.525 | 4.610 | 3.463 | 4.983 | 3.500 |
| 35 | 11.667 | 23.167 | 7.833 | 19.133 | 10.500 | 8.700 | 8.722 | 5.900 |
| 36 | 15.895 | 17.874 | 11.825 | 17.009 | 11.164 | 12.831 | 20.157 | 19.529 |
| 37 | 42.339 | NA | 34.000 | NA | 37.814 | NA | 31.085 | 34.700 |
| 38 | 34.162 | 34.496 | 30.782 | 38.376 | 37.031 | 34.206 | 26.070 | 29.340 |
| 39 | 13.330 | 9.191 | NA | NA | 10.432 | 13.724 | 8.111 | NA |
| 40 | 68.762 | 54.786 | 71.575 | 87.547 | 20.980 | 22.444 | 36.002 | 40.671 |
| 41 | 482.2 | 290.8 | 426.6 | 501.1 | 102.6 | 170.9 | 334.6 | 330.6 |
| 42 | 9.047 | 5.423 | 7.366 | 8.235 | 1.939 | 3.699 | 9.763 | 10.156 |
| 43 | 3978.6 | 2416.5 | 4403.0 | 4356.2 | 1164.4 | 2036.8 | 2987.2 | 4661.8 |
| 44 | 1.233 | 1.467 | 1.396 | 0.905 | 0.607 | 0.001 | 1.665 | 1.027 |
| 45 | 1.750 | 2.000 | 6.250 | 2.250 | 0.833 | 9.500 | 0.000 | 3.250 |
| 46 | 220.6 | 250.4 | 236.9 | 203.5 | 211.4 | 255.6 | 228.0 | 251.6 |
| 47 | 5.544 | 6.054 | 5.086 | 5.646 | 6.279 | 5.546 | 5.637 | 4.628 |
| 48 | 18.859 | 13.014 | 18.171 | 18.924 | 9.772 | 23.521 | 24.595 | 28.081 |
| 49 | 30.000 | 22.056 | 25.200 | 24.067 | 23.533 | 63.571 | 24.533 | 43.933 |

TABLE 169-continued

Measured parameters in bean varieties (lines 9-16)

| Line/Corr. ID | Line-9 | Line-10 | Line-11 | Line-12 | Line-13 | Line-14 | Line-15 | Line-16 |
|---|---|---|---|---|---|---|---|---|
| 50 | 22.250 | 23.167 | 25.333 | 24.933 | 32.400 | 26.867 | 22.333 | 43.400 |
| 51 | 82.63 | 91.03 | 85.27 | 62.23 | 36.42 | 1.79 | 52.44 | 40.39 |
| 52 | 3.660 | 3.082 | 4.793 | 4.273 | 3.023 | 1.819 | 5.304 | 5.118 |
| 53 | 2.515 | 0.355 | 3.652 | 4.930 | 2.484 | 1.115 | 1.828 | 1.424 |
| 54 | 98.53 | 65.11 | 118.07 | 103.20 | 70.33 | 111.93 | 126.73 | 224.00 |
| 55 | 58.545 | 12.538 | 91.067 | 97.067 | 81.400 | 31.714 | 45.429 | 62.286 |
| 56 | 1.528 | 1.010 | NA | NA | 3.741 | 0.303 | 1.540 | NA |
| 57 | NA | 8.803 | 11.696 | 12.911 | 18.529 | 10.759 | 17.398 | 14.323 |
| 58 | 70.867 | 66.765 | 61.767 | 69.113 | 86.773 | 52.760 | ###### | 71.507 |
| 59 | 0.838 | 1.646 | 0.934 | NA | 0.368 | 1.385 | 1.428 | 1.336 |
| 60 | 0.345 | 0.689 | 0.388 | 0.635 | 0.542 | 0.419 | 0.355 | 0.248 |

Table 169. Provided are the values of each of the parameters (as described above) measured in bean accessions (Line). Growth conditions are specified in the experimental procedure section

TABLE 170

Correlation between the expression level of selected genes of some embodiments of the invention in various tissues and the phenotypic performance under normal conditions across "fine" and "extra fine" bean varieties

| Gene Name | R | P value | Exp. set | Corr. Set ID | Gene Name | R | P value | Exp. set | Corr. Set ID |
|---|---|---|---|---|---|---|---|---|---|
| LBY33 | 0.91 | 5.11E−05 | 4 | 6 | LBY33 | 0.76 | 4.19E−03 | 4 | 9 |
| LBY33 | 0.71 | 9.29E−03 | 4 | 32 | LBY33 | 0.71 | 1.01E−02 | 4 | 33 |
| LBY33 | 0.84 | 1.34E−03 | 2 | 11 | LBY33 | 0.82 | 3.50E−03 | 2 | 24 |
| LBY33 | 0.83 | 1.52E−03 | 2 | 45 | LBY33 | 0.78 | 4.78E−03 | 2 | 49 |
| LBY33 | 0.74 | 5.54E−02 | 9 | 37 | LBY33 | 0.85 | 3.82E−03 | 7 | 57 |
| LBY33 | 0.71 | 9.41E−03 | 6 | 36 | LBY34 | 0.73 | 1.24E−03 | 1 | 53 |
| LBY34 | 0.72 | 1.27E−02 | 4 | 27 | LBY34 | 0.76 | 1.08E−02 | 2 | 12 |
| LBY34 | 0.86 | 3.30E−03 | 9 | 31 | LBY34 | 0.80 | 1.68E−03 | 9 | 51 |
| LBY34 | 0.85 | 4.06E−03 | 9 | 1 | LBY34 | 0.73 | 1.10E−02 | 5 | 53 |
| LBY34 | 0.75 | 1.93E−02 | 7 | 10 | LBY34 | 0.77 | 9.37E−03 | 7 | 52 |
| LBY34 | 0.82 | 1.91E−03 | 3 | 55 | LBY34 | 0.86 | 7.19E−04 | 3 | 53 |
| LBY34 | 0.88 | 4.29E−03 | 3 | 56 | LBY35 | 0.83 | 2.65E−03 | 2 | 4 |
| LBY35 | 0.84 | 2.64E−03 | 2 | 39 | LBY35 | 0.70 | 1.55E−02 | 5 | 46 |
| LBY35 | 0.71 | 2.10E−02 | 7 | 38 | LBY36 | 0.76 | 6.12E−03 | 2 | 29 |
| LBY36 | 0.81 | 7.59E−03 | 2 | 15 | LBY36 | 0.73 | 6.49E−03 | 9 | 2 |
| LBY36 | 0.81 | 2.70E−03 | 5 | 55 | LBY36 | 0.86 | 6.34E−04 | 5 | 53 |
| LBY36 | 0.80 | 3.20E−03 | 5 | 50 | LBY36 | 0.87 | 1.44E−05 | 8 | 11 |
| LBY36 | 0.75 | 8.18E−03 | 3 | 44 | LBY36 | 0.84 | 1.20E−03 | 3 | 51 |

Table 170. Provided are the correlations (R) between the genes expression levels in various tissues and the phenotypic performance. "Corr. ID"—correlation set ID according to the correlated parameters specified in Table 167. "Exp. Set"—Expression set specified in Table 166. "R" = Pearson correlation coefficient; "P" = p value.

Example 20

Production of Foxtail Millet Transcriptome and High Throughput Correlation Analysis Using 60K Foxtail Millet Oligonucleotide Micro-Array In order to produce a high throughput correlation analysis comparing between plant phenotype and gene expression level, the present inventors utilized a foxtail millet oligonucleotide micro-array, produced by Agilent Technologies [World Wide Web (dot) chem. (dot) agilent (dot) com/Scripts/PDS (dot) asp?1Page=50879]. The array oligonucleotide represents about 60K foxtail millet genes and transcripts. In order to define correlations between the levels of RNA expression and yield or vigor related parameters, various plant characteristics of 15 different foxtail millet accessions were analyzed. Among them, 11 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Fourteen foxtail millet varieties were grown in 5 repetitive plots, in field. Briefly, the growing protocol was as follows:

1. Regular growth conditions: foxtail millet plants were grown in the field using commercial fertilization and irrigation protocols, which include 283 $m^3$ water per dunam (100 square meters) per entire growth period and fertilization of 16 units of URAN® 32% (Nitrogen Fertilizer Solution; PCS Sales, Northbrook, Ill., USA) (normal growth conditions).

2. Drought conditions: foxtail millet seeds were sown in soil and grown under normal condition until the heading stage (22 days from sowing), and then drought treatment was imposed by irrigating plants with 50% water relative to the normal treatment (171 $m^3$ water per dunam per entire growth period) while maintaining normal fertilization.

Analyzed Foxtail millet tissues—All 15 foxtail millet lines were sample per each treatment. Three tissues [leaf, flower, and stem] at 2 different developmental stages [flowering, grain filling], representing different plant characteristics were sampled and RNA was extracted as described above. Each micro-array expression information tissue type has received a Set ID as summarized in Tables 171-174 below.

TABLE 171

Foxtail millet transcriptome expression sets under drought conditions at flowering stage

| Expression Set | Set ID |
|---|---|
| flower: flowering stage, drought | 1 |
| leaf: flowering stage, drought | 2 |
| stem: flowering stage, drought | 3 |

Table 171. Provided are the foxtail millet transcriptome expression sets under drought conditions at flowering stage.

TABLE 172

Foxtail millet transcriptome expression sets under drought conditions at grain filling stage

| Expression Set | Set ID |
|---|---|
| grain: grain filling stage, drought | 4 |
| leaf: grain filling stage, drought | 5 |
| stem: grain filling stage, drought | 6 |

Table 172. Provided are the foxtail millet transcriptome expression sets under drought conditions at grain filling stage.

TABLE 173

Foxtail millet transcriptome expression sets under normal conditions at flowering stage

| Expression Set | Set ID |
|---|---|
| flower: flowering stage, normal | 1 |
| leaf: flowering stage, normal | 2 |

Table 173. Provided are the foxtail millet transcriptome expression sets under normal conditions at flowering stage.

TABLE 174

Foxtail millet transcriptome expression sets under normal conditions at grain filling stage

| Expression Set | Set ID |
|---|---|
| grain: grain filling stage, normal | 4 |
| leaf: grain filling stage, normal | 5 |
| stem: grain filling stage, normal | 6 |

Table 174. Provided are the foxtail mi let transcriptome expression sets under normal conditions at grain filling stage.

Foxtail millet yield components and vigor related parameters assessment—Plants were continuously phenotyped during the growth period and at harvest (Tables 175-176, below). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The following parameters were collected using digital imaging system:

At the end of the growing period the grains were separated from the Plant 'Head' and the following parameters were measured and collected:

Average Grain Area ($cm^2$)—A sample of ~200 grains was weighted, photographed and images were processed using the below described image processing system. The grain area was measured from those images and was divided by the number of grains.

Average Grain Length and width (cm)—A sample of ~200 grains was weighted, photographed and images were processed using the below described image processing system. The sum of grain lengths and width (longest axis) were measured from those images and were divided by the number of grains.

At the end of the growing period 14 'Heads' were photographed and images were processed using the below described image processing system.

Average Grain Perimeter (cm)—At the end of the growing period the grains were separated from the Plant 'Head'. A sample of ~200 grains were weighted, photographed and images were processed using the below described image processing system. The sum of grain perimeter was measured from those images and was divided by the number of grains.

Head Average Area ($cm^2$)—The 'Head' area was measured from those images and was divided by the number of 'Heads'.

Head Average Length and width (cm)—The 'Head' length and width (longest axis) were measured from those images and were divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Head weight (Kg.) and head number (num.)—At the end of the experiment, heads were harvested from each plot and were counted and weighted.

Total Grain Yield (gr.)—At the end of the experiment (plant 'Heads') heads from plots were collected, the heads were threshed and grains were weighted. In addition, the average grain weight per head was calculated by dividing the total grain weight by number of total heads per plot (based on plot).

1000 Seeds weight [gr.]—was calculated based on Formula XIV (above).

Biomass at harvest [kg]—At the end of the experiment the vegetative portion above ground (excluding roots) from plots was weighted.

Total dry mater per plot [kg]—Calculated as Vegetative portion above ground plus all the heads dry weight per plot.

Number (num) of days to anthesis—Calculated as the number of days from sowing till 50% of the plot arrives anthesis.

Maintenance of performance under drought conditions—Represent ratio for the specified parameter of Drought condition results divided by Normal conditions results (maintenance of phenotype under drought in comparison to normal conditions).

Data parameters collected are summarized in Tables 175-176, herein below.

TABLE 175

Foxtail millet correlated parameters under drought and normal conditions (vectors)

| Correlated parameter with | Correlation ID |
|---|---|
| 1000 grain weight [gr.] | 1 |
| Biomass at harvest [kg] | 2 |
| Grain Perimeter | 3 |
| Grain area [cm$^2$] | 4 |
| Grain length [cm] | 5 |
| Grain width [cm] | 6 |
| Grains yield per Head (plot) [gr.] | 7 |
| Head Area [cm$^2$] | 8 |
| Head Width [cm] | 9 |
| Head length [cm] | 10 |
| Heads number | 11 |
| Num days to Anthesis [days] | 12 |
| Total Grains yield [gr.] | 13 |
| Total dry matter [kg] | 14 |
| Total heads weight [kg] | 15 |

Table 175. Provided are the foxtail millet collected parameters under drought and normal conditions.

TABLE 176

Foxtail millet correlated parameters under drought vs normal conditions (maintenance) (vectors)

| Correlated parameter with | Correlation ID |
|---|---|
| 1000 grain weight D/N [gr.] | 1 |
| Biomass at harvest D/N [kg] | 2 |
| Grain Perimeter D/N [cm] | 3 |
| Grain area D/N [cm$^2$] | 4 |
| Grain length D/N [cm] | 5 |
| Grain width D/N [cm] | 6 |
| Grains yield per Head (plot) D/N [gr.] | 7 |
| Head Area D/N [cm$^2$] | 8 |
| Head Width D/N [cm] | 9 |
| Head length D/N [cm] | 10 |
| Heads num D/N [num] | 11 |
| Total Grains yield D/N [gr.] | 12 |
| Total dry matter D/N [kg] | 13 |
| Total heads weight D/N [kg] | 14 |

Table 176. Provided are the foxtail millet collected parameters under drought vs. normal conditions (maintenance).

Experimental Results

Fifteen different foxtail millet accessions were grown and characterized for different parameters as described above (Table 175-176). The average for each of the measured parameter was calculated using the JMP software and values are summarized in Tables 177-182 below. Subsequent correlation analysis between the various transcriptome sets and the average parameters was conducted (Tables 183-188). Follow, results were integrated to the database.

TABLE 177

Measured parameters of correlation IDs in foxtail millet accessions under drought conditions

| Line/Corr. ID | 1 | 2 | 3 | 4 | 5 | 6 | 7 | 8 |
|---|---|---|---|---|---|---|---|---|
| Line-1 | 2.639 | 1.528 | 0.683 | 0.033 | 0.242 | 0.175 | 3.053 | 35.748 |
| Line-2 | 3.329 | 3.459 | 0.722 | 0.037 | 0.244 | 0.194 | 8.832 | 50.714 |
| Line-3 | 2.610 | 2.872 | 0.689 | 0.033 | 0.250 | 0.171 | 1.336 | 18.400 |
| Line-4 | 2.295 | 2.935 | 0.683 | 0.032 | 0.254 | 0.160 | 1.093 | 14.938 |
| Line-5 | 2.304 | 3.022 | 0.690 | 0.033 | 0.257 | 0.162 | 1.309 | 17.686 |
| Line-6 | 2.642 | 2.665 | 0.692 | 0.033 | 0.250 | 0.170 | 0.486 | 9.911 |
| Line-7 | 2.215 | 2.975 | 0.648 | 0.030 | 0.233 | 0.163 | 1.628 | 20.986 |
| Line-8 | 1.837 | 0.765 | 0.569 | 0.024 | 0.194 | 0.156 | 3.737 | 39.929 |
| Line-9 | 2.540 | 2.662 | 0.661 | 0.032 | 0.223 | 0.181 | 9.900 | 42.149 |
| Line-10 | 1.691 | 2.946 | 0.593 | 0.025 | 0.203 | 0.158 | 4.143 | 43.524 |
| Line-11 | 3.096 | 3.230 | 0.720 | 0.037 | 0.261 | 0.178 | 2.975 | 26.931 |
| Line-12 | 2.541 | 3.303 | 0.675 | 0.032 | 0.245 | 0.167 | 1.305 | 21.229 |
| Line-13 | 3.238 | 2.632 | 0.748 | 0.039 | 0.270 | 0.184 | 0.363 | 7.302 |
| Line-14 | 2.245 | 0.886 | 0.659 | 0.030 | 0.242 | 0.159 | 1.741 | 13.126 |

Table 177: Provided are the values of each of the parameters (as described above) measured in Foxtail millet accessions (Line). Growth conditions are specified in the experimental procedure section.

TABLE 178

Additional measured parameters of correlation IDs in foxtail millet accessions under drought conditions

| Line/Corr. ID | 9 | 10 | 11 | 12 | 13 | 14 | 15 |
|---|---|---|---|---|---|---|---|
| Line-1 | 1.871 | 22.36 | 374.40 | 34.00 | 1141.49 | 0.504 | 2.888 |
| Line-2 | 2.677 | 21.89 | 127.00 | 41.00 | 1116.18 | 0.733 | 6.087 |
| Line-3 | 1.325 | 16.50 | 737.80 | 51.00 | 988.21 | 0.798 | 5.325 |
| Line-4 | 1.334 | 13.31 | 1100.80 | 41.00 | 1202.77 | 0.616 | 5.402 |
| Line-5 | 1.501 | 14.00 | 1047.20 | 41.00 | 1360.51 | 0.708 | 5.570 |
| Line-6 | 1.166 | 9.11 | 2050.00 | 30.00 | 995.17 | 0.470 | 5.280 |
| Line-7 | 1.666 | 15.10 | 581.50 | 38.00 | 946.85 | 0.608 | 5.121 |
| Line-8 | 2.153 | 21.13 | 311.60 | 30.00 | 1159.78 | 0.349 | 2.288 |

TABLE 178-continued

Additional measured parameters of correlation IDs in foxtail millet accessions under drought conditions

| Line/Corr. ID | 9 | 10 | 11 | 12 | 13 | 14 | 15 |
|---|---|---|---|---|---|---|---|
| Line-9 | 2.362 | 20.02 | 147.20 | 38.00 | 1391.39 | 0.437 | 5.834 |
| Line-10 | 2.322 | 21.80 | 95.40 | NA | 394.51 | 0.645 | 4.316 |
| Line-11 | 1.545 | 20.80 | 414.40 | 44.00 | 1199.50 | 0.748 | 5.639 |
| Line-12 | 1.590 | 15.85 | 667.80 | 51.00 | 872.48 | 0.872 | 5.132 |
| Line-13 | 1.254 | 6.45 | 2441.00 | 31.00 | 873.94 | 0.523 | 5.126 |
| Line-14 | 1.738 | 9.18 | 687.50 | 27.00 | 1187.98 | 0.361 | 2.307 |

Table 178: Provided are the values of each of the parameters (as described above) measured in Foxtail millet accessions (Line). Growth conditions are specified in the experimental procedure section.

TABLE 179

Measured parameters of correlation IDs in foxtail millet accessions for Maintenance of performance under drought conditions

| Line/Corr. ID | 1 | 2 | 3 | 4 | 5 | 6 | 7 |
|---|---|---|---|---|---|---|---|
| Line-1 | 107.285 | 63.803 | 101.149 | 103.094 | 100.719 | 102.266 | 89.854 |
| Line-2 | 97.440 | 86.662 | 100.635 | 101.059 | 101.132 | 100.031 | 121.191 |
| Line-3 | 99.893 | 90.611 | 101.035 | 102.805 | 100.392 | 102.389 | 76.406 |
| Line-4 | 97.291 | 81.978 | 100.282 | 100.875 | 100.432 | 100.423 | 83.957 |
| Line-5 | 95.731 | 84.030 | 100.570 | 101.565 | 100.177 | 101.334 | 83.228 |
| Line-6 | 99.523 | 87.176 | 99.367 | 99.754 | 99.501 | 100.231 | 70.037 |
| Line-7 | 101.384 | 73.573 | 100.868 | 101.139 | 101.033 | 100.218 | 77.372 |
| Line-8 | 102.163 | 66.771 | 99.648 | 99.961 | 99.169 | 100.784 | 111.740 |
| Line-9 | 94.538 | 83.217 | 99.837 | 98.886 | 100.709 | 98.159 | 86.386 |
| Line-10 | 102.691 | 75.471 | 101.821 | 102.672 | 102.004 | 100.612 | 57.788 |
| Line-11 | 97.607 | 90.154 | 98.935 | 97.949 | 99.401 | 98.504 | 68.366 |
| Line-12 | 97.815 | 89.810 | 97.988 | 96.377 | 97.778 | 98.545 | 57.646 |
| Line-13 | 101.686 | 89.510 | 100.391 | 101.190 | 100.335 | 100.858 | 83.164 |
| Line-14 | 99.502 | 59.886 | 99.194 | 99.248 | 98.983 | 100.258 | 132.380 |

Table 179: Provided are the values of each of the parameters (as described above) measured in Foxtail millet accessions (Line). Growth conditions are specified in the experimental procedure section.

TABLE 180

Additional measured parameters of correlation IDs in foxtail millet accessions for Maintenance of performance under drought conditions

| Line/Corr. ID | 8 | 9 | 10 | 11 | 12 | 13 | 14 |
|---|---|---|---|---|---|---|---|
| Line-1 | 94.502 | 98.178 | 96.690 | 87.558 | 78.744 | 71.703 | 75.808 |
| Line-2 | 87.634 | 98.291 | 90.250 | 85.121 | 104.523 | 85.768 | 102.306 |
| Line-3 | 93.932 | 99.878 | 93.972 | 85.098 | 64.382 | 82.890 | 85.901 |
| Line-4 | 87.357 | 98.420 | 89.958 | 91.429 | 76.747 | 66.681 | 95.835 |
| Line-5 | 89.510 | 97.942 | 91.006 | 91.347 | 75.803 | 78.325 | 88.824 |
| Line-6 | 105.260 | 98.755 | 106.443 | 96.154 | 67.418 | 98.019 | 86.916 |
| Line-7 | 91.555 | 98.976 | 93.881 | 77.307 | 59.830 | 66.278 | 81.036 |
| Line-8 | 97.651 | 101.337 | 96.594 | 79.046 | 88.004 | 77.030 | 81.183 |
| Line-9 | 93.057 | 94.533 | 98.097 | 78.885 | 65.274 | 73.539 | 80.433 |
| Line-10 | 88.210 | 95.663 | 93.498 | 72.382 | 42.062 | 64.635 | 82.305 |
| Line-11 | 97.271 | 99.482 | 99.655 | 95.440 | 63.796 | 81.972 | 85.754 |
| Line-12 | 87.804 | 100.351 | 88.132 | 103.311 | 61.136 | 84.963 | 87.702 |
| Line-13 | 102.458 | 100.818 | 101.471 | 87.247 | 71.855 | 83.890 | 91.152 |
| Line-14 | 89.377 | 95.464 | 93.807 | 69.123 | 91.616 | 77.761 | 84.425 |

Table 180: Provided are the values of each of the parameters (as described above) measured in Foxtail millet accessions (Line). Growth conditions are specified in the experimental procedure section.

TABLE 181

Measured parameters of correlation IDs in foxtail millet accessions under normal conditions

| Line/Corr. ID | 1 | 2 | 3 | 4 | 5 | 6 | 7 | 8 |
|---|---|---|---|---|---|---|---|---|
| Line-1 | 2.460 | 2.396 | 0.675 | 0.032 | 0.240 | 0.172 | 3.398 | 37.828 |
| Line-2 | 3.416 | 3.992 | 0.717 | 0.037 | 0.242 | 0.194 | 7.288 | 57.870 |
| Line-3 | 2.613 | 3.170 | 0.682 | 0.033 | 0.249 | 0.167 | 1.749 | 19.588 |
| Line-4 | 2.359 | 3.580 | 0.681 | 0.032 | 0.253 | 0.159 | 1.302 | 17.100 |
| Line-5 | 2.406 | 3.597 | 0.686 | 0.032 | 0.256 | 0.160 | 1.573 | 19.759 |
| Line-6 | 2.655 | 3.057 | 0.697 | 0.034 | 0.252 | 0.170 | 0.695 | 9.415 |
| Line-7 | 2.185 | 4.044 | 0.642 | 0.029 | 0.231 | 0.162 | 2.104 | 22.922 |
| Line-8 | 1.798 | 1.146 | 0.571 | 0.024 | 0.196 | 0.155 | 3.345 | 40.890 |
| Line-9 | 2.686 | 3.198 | 0.662 | 0.032 | 0.221 | 0.184 | 11.460 | 45.294 |
| Line-10 | 1.647 | 3.904 | 0.582 | 0.025 | 0.199 | 0.157 | 7.169 | 49.341 |
| Line-11 | 3.172 | 3.583 | 0.728 | 0.037 | 0.262 | 0.181 | 4.351 | 27.686 |
| Line-12 | 2.598 | 3.678 | 0.689 | 0.033 | 0.250 | 0.169 | 2.263 | 24.178 |
| Line-13 | 3.184 | 2.940 | 0.745 | 0.039 | 0.269 | 0.183 | 0.436 | 7.127 |
| Line-14 | 2.257 | 1.479 | 0.665 | 0.030 | 0.244 | 0.158 | 1.315 | 14.686 |

Table 181: Provided are the values of each of the parameters (as described above) measured in Foxtail millet accessions (Line). Growth conditions are specified in the experimental procedure section

TABLE 182

Additional measured parameters of correlation IDs in foxtail millet accessions under normal conditions

| Line/Corr. ID | 9 | 10 | 11 | 12 | 13 | 14 | 15 |
|---|---|---|---|---|---|---|---|
| Line-1 | 1.905 | 23.13 | 427.6 | 34.0 | 1449.6 | 0.703 | 3.810 |
| Line-2 | 2.723 | 24.25 | 149.2 | 41.0 | 1067.9 | 0.854 | 5.950 |
| Line-3 | 1.327 | 17.56 | 867.0 | 45.0 | 1534.9 | 0.963 | 6.199 |
| Line-4 | 1.356 | 14.79 | 1204.0 | 41.0 | 1567.2 | 0.924 | 5.637 |
| Line-5 | 1.532 | 15.38 | 1146.4 | 41.0 | 1794.8 | 0.904 | 6.271 |
| Line-6 | 1.181 | 8.56 | 2132.0 | 30.0 | 1476.1 | 0.480 | 6.075 |
| Line-7 | 1.683 | 16.08 | 752.2 | 38.0 | 1582.6 | 0.917 | 6.319 |
| Line-8 | 2.124 | 21.88 | 394.2 | 30.0 | 1317.9 | 0.453 | 2.819 |
| Line-9 | 2.499 | 20.41 | 186.6 | 38.0 | 2131.6 | 0.594 | 7.253 |
| Line-10 | 2.427 | 23.32 | 131.8 | 51.0 | 937.9 | 0.998 | 5.244 |
| Line-11 | 1.553 | 20.87 | 434.2 | 44.0 | 1880.2 | 0.913 | 6.576 |
| Line-12 | 1.585 | 17.98 | 646.4 | 51.0 | 1427.1 | 1.027 | 5.851 |
| Line-13 | 1.243 | 6.35 | 2797.8 | 31.0 | 1216.2 | 0.623 | 5.624 |
| Line-14 | 1.820 | 9.78 | 994.6 | 27.0 | 1296.7 | 0.464 | 2.732 |

Table 182: Provided are the values of each of the parameters (as described above) measured in Foxtail millet accessions (Line). Growth conditions are specified in the experimental procedure section.

TABLE 183

Correlation between the expression level of selected genes of some embodiments of the invention in various tissues and the phenotypic performance under drought conditions at flowering stage across foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY3 | 0.74 | 2.27E−02 | 3 | 9 | LBY3 | 0.85 | 3.67E−03 | 3 | 7 |
| LBY3 | 0.72 | 2.91E−02 | 3 | 8 | LBY3 | 0.77 | 8.98E−03 | 1 | 14 |
| LBY3 | 0.78 | 7.18E−03 | 1 | 4 | LBY3 | 0.82 | 3.64E−03 | 1 | 3 |
| LBY55 | 0.79 | 6.84E−03 | 1 | 1 | LBY55 | 0.78 | 7.54E−03 | 1 | 10 |
| LBY55 | 0.78 | 7.27E−03 | 1 | 6 | LBY55 | 0.73 | 1.67E−02 | 1 | 8 |
| LBY57 | 0.72 | 1.17E−02 | 2 | 14 | LBY57 | 0.79 | 7.01E−03 | 1 | 10 |
| LBY59 | 0.72 | 1.29E−02 | 2 | 14 | LBY59 | 0.72 | 1.18E−02 | 2 | 12 |
| LBY59 | 0.72 | 1.99E−02 | 1 | 13 | LBY66 | 0.78 | 1.32E−02 | 3 | 4 |
| LBY66 | 0.81 | 8.20E−03 | 3 | 3 | LBY67 | 0.77 | 1.54E−02 | 3 | 1 |
| LBY67 | 0.82 | 6.78E−03 | 3 | 4 | LBY67 | 0.80 | 1.04E−02 | 3 | 3 |
| LBY67 | 0.87 | 1.06E−03 | 1 | 1 | LBY67 | 0.88 | 8.30E−04 | 1 | 4 |
| LBY67 | 0.84 | 2.31E−03 | 1 | 3 | LBY69 | 0.75 | 1.88E−02 | 3 | 1 |
| LBY69 | 0.72 | 2.72E−02 | 3 | 4 | LBY69 | 0.76 | 1.77E−02 | 3 | 6 |
| LBY69 | 0.75 | 7.89E−03 | 2 | 6 | LBY70 | 0.83 | 3.14E−03 | 1 | 11 |
| LBY71 | 0.72 | 1.88E−02 | 1 | 13 | LBY75 | 0.76 | 1.13E−02 | 1 | 1 |

TABLE 183-continued

Correlation between the expression level of selected genes of some embodiments of the invention in various tissues and the phenotypic performance under drought conditions at flowering stage across foxtail millet varieties

| Gene Name | R | P value | Exp. set | Corr. Set ID | Gene Name | R | P value | Exp. set | Corr. Set ID |
| --- | --- | --- | --- | --- | --- | --- | --- | --- | --- |
| LBY75 | 0.75 | 1.31E−02 | 1 | 4 | LBY77 | 0.74 | 2.34E−02 | 3 | 2 |
| LBY77 | 0.89 | 5.26E−04 | 1 | 1 | LBY77 | 0.73 | 1.73E−02 | 1 | 10 |
| LBY77 | 0.79 | 6.33E−03 | 1 | 4 | LBY77 | 0.80 | 5.12E−03 | 1 | 6 |
| LBY77 | 0.75 | 1.33E−02 | 1 | 8 | LBY81 | 0.87 | 1.20E−03 | 1 | 10 |
| LBY82 | 0.74 | 2.13E−02 | 3 | 12 | LBY85 | 0.84 | 2.27E−03 | 1 | 1 |
| LBY85 | 0.75 | 1.30E−02 | 1 | 14 | LBY85 | 0.83 | 3.08E−03 | 1 | 4 |
| LBY85 | 0.73 | 1.70E−02 | 1 | 2 | LBY85 | 0.74 | 1.37E−02 | 1 | 3 |
| LBY85 | 0.73 | 1.64E−02 | 1 | 6 | LBY89 | 0.73 | 1.04E−02 | 2 | 13 |
| LGN52 | 0.83 | 3.00E−03 | 1 | 14 | LGN60 | 0.79 | 1.15E−02 | 3 | 11 |

Table 183. Provide are the correlations (R) between the genes expression levels in various tissues and the phenotypic performance. "Corr. ID"—correlation set ID according to the correlated parameters specified in Table 175. "Exp. Set"—Expression set specified in Table 171. "R" = Pearson correlation coefficient; "P" = p value.

TABLE 184

Correlation between the expression level of selected genes of some embodiments of the invention in various tissues and the phenotypic performance under drought conditions at grain filling stage across foxtail millet varieties

| Gene Name | R | P value | Exp. set | Corr. Set ID | Gene Name | R | P value | Exp. set | Corr. Set ID |
| --- | --- | --- | --- | --- | --- | --- | --- | --- | --- |
| LBY3 | 0.91 | 1.20E−02 | 1 | 15 | LBY3 | 0.87 | 2.60E−02 | 1 | 2 |
| LBY3 | 0.70 | 2.33E−02 | 2 | 9 | LBY3 | 0.75 | 1.33E−02 | 2 | 7 |
| LBY3 | 0.70 | 2.35E−02 | 3 | 8 | LBY55 | 0.84 | 3.72E−02 | 1 | 1 |
| LBY55 | 0.82 | 4.62E−02 | 1 | 4 | LBY55 | 0.75 | 8.61E−02 | 1 | 3 |
| LBY55 | 0.85 | 3.06E−02 | 1 | 6 | LBY55 | 0.72 | 1.98E−02 | 2 | 10 |
| LBY55 | 0.72 | 1.83E−02 | 2 | 9 | LBY55 | 0.86 | 1.55E−03 | 2 | 7 |
| LBY55 | 0.83 | 2.89E−03 | 2 | 8 | LBY57 | 0.74 | 1.44E−02 | 2 | 2 |
| LBY57 | 0.73 | 1.67E−02 | 3 | 15 | LBY57 | 0.76 | 1.05E−02 | 3 | 2 |
| LBY59 | 0.78 | 7.01E−02 | 1 | 2 | LBY59 | 0.70 | 2.31E−02 | 2 | 7 |
| LBY59 | 0.73 | 1.60E−02 | 3 | 2 | LBY61 | 0.89 | 1.86E−02 | 1 | 13 |
| LBY63 | 0.82 | 4.75E−02 | 1 | 11 | LBY64 | 0.89 | 1.64E−02 | 1 | 1 |
| LBY64 | 0.84 | 3.75E−02 | 1 | 4 | LBY64 | 0.75 | 8.51E−02 | 1 | 3 |
| LBY64 | 0.94 | 6.09E−03 | 1 | 6 | LBY64 | 0.73 | 1.76E−02 | 2 | 9 |
| LBY65 | 0.71 | 1.10E−01 | 1 | 15 | LBY65 | 0.76 | 8.18E−02 | 1 | 2 |
| LBY65 | 0.71 | 2.06E−02 | 2 | 2 | LBY65 | 0.81 | 4.25E−03 | 2 | 9 |
| LBY65 | 0.74 | 1.52E−02 | 2 | 7 | LBY65 | 0.72 | 1.85E−02 | 3 | 14 |
| LBY65 | 0.75 | 1.21E−02 | 3 | 2 | LBY66 | 0.75 | 8.77E−02 | 1 | 11 |
| LBY67 | 0.84 | 2.61E−03 | 3 | 13 | LBY67 | 0.74 | 1.54E−02 | 3 | 14 |
| LB8Y6 | 0.71 | 2.15E−02 | 2 | 9 | LBY68 | 0.73 | 1.76E−02 | 3 | 15 |
| LB8Y6 | 0.73 | 1.74E−02 | 3 | 12 | LBY68 | 0.76 | 1.03E−02 | 3 | 2 |
| LBY69 | 0.89 | 1.83E−02 | 1 | 1 | LBY69 | 0.86 | 2.97E−02 | 1 | 13 |
| LBY69 | 0.79 | 6.28E−02 | 1 | 5 | LBY69 | 0.89 | 1.68E−02 | 1 | 10 |
| LBY69 | 0.80 | 5.46E−02 | 1 | 12 | LBY69 | 0.93 | 6.24E−03 | 1 | 4 |
| LBY69 | 0.83 | 4.00E−02 | 1 | 11 | LBY69 | 0.90 | 1.42E−02 | 1 | 3 |
| LBY69 | 0.80 | 5.58E−02 | 1 | 6 | LBY69 | 0.74 | 9.30E−02 | 1 | 8 |
| LBY69 | 0.71 | 2.05E−02 | 2 | 11 | LBY69 | 0.73 | 1.63E−02 | 3 | 1 |
| LBY70 | 0.79 | 6.07E−02 | 1 | 13 | LBY70 | 0.76 | 1.09E−02 | 2 | 10 |
| LBY70 | 0.71 | 2.24E−02 | 2 | 9 | LBY70 | 0.86 | 1.59E−03 | 2 | 7 |
| LBY70 | 0.81 | 4.20E−03 | 2 | 8 | LBY73 | 0.70 | 1.18E−01 | 1 | 13 |
| LBY75 | 0.94 | 5.65E−03 | 1 | 13 | LBY75 | 0.80 | 5.92E−03 | 2 | 9 |
| LBY78 | 0.80 | 5.42E−02 | 1 | 5 | LBY78 | 0.91 | 1.11E−02 | 1 | 11 |
| LBY79 | 0.72 | 1.07E−01 | 1 | 4 | LBY80 | 0.70 | 2.40E−02 | 2 | 10 |
| LBY80 | 0.72 | 1.81E−02 | 2 | 8 | LBY80 | 0.75 | 1.33E−02 | 3 | 13 |
| LBY81 | 0.75 | 1.33E−02 | 2 | 10 | LBY81 | 0.76 | 1.00E−02 | 2 | 8 |
| LBY82 | 0.79 | 6.23E−02 | 1 | 10 | LBY82 | 0.86 | 2.88E−02 | 1 | 9 |
| LBY82 | 0.74 | 9.18E−02 | 1 | 7 | LBY82 | 0.82 | 4.33E−02 | 1 | 8 |
| LBY82 | 0.73 | 1.65E−02 | 2 | 5 | LBY83 | 0.85 | 3.17E−02 | 1 | 1 |
| LBY83 | 0.77 | 7.04E−02 | 1 | 4 | LBY83 | 0.92 | 9.15E−03 | 1 | 6 |
| LBY85 | 0.77 | 8.50E−03 | 3 | 14 | LBY86 | 0.95 | 3.64E−03 | 1 | 13 |
| LBY87 | 0.76 | 8.12E−02 | 1 | 4 | LBY87 | 0.75 | 8.83E−02 | 1 | 3 |
| LBY88 | 0.88 | 8.70E−04 | 3 | 14 | LBY88 | 0.89 | 5.11E−04 | 3 | 12 |
| LBY89 | 0.85 | 3.06E−02 | 1 | 1 | LBY89 | 0.77 | 7.23E−02 | 1 | 4 |
| LBY89 | 0.80 | 5.65E−02 | 1 | 9 | LBY89 | 0.83 | 4.27E−02 | 1 | 7 |
| LBY89 | 0.93 | 7.46E−03 | 1 | 6 | LBY91 | 0.79 | 6.39E−02 | 1 | 9 |

TABLE 184-continued

Correlation between the expression level of selected genes of some embodiments of the invention in various tissues and the phenotypic performance under drought conditions at grain filling stage across foxtail millet varieties

| Gene Name | R | P value | Exp. set | Corr. Set ID | Gene Name | R | P value | Exp. set | Corr. Set ID |
|---|---|---|---|---|---|---|---|---|---|
| LB1Y9 | 0.74 | 9.51E−02 | 1 | 8 | LBY92 | 0.90 | 1.54E−02 | 1 | 13 |
| LBY92 | 0.78 | 6.74E−02 | 1 | 12 | LBY92 | 0.70 | 2.30E−02 | 3 | 7 |
| LGN52 | 0.80 | 5.38E−02 | 1 | 11 | LGN60 | 0.95 | 3.79E−03 | 1 | 11 |

Table 184. Provided are the correlations (R) between the genes expression levels in various tissues and the phenotypic performance. "Corr. ID "—correlation set ID according to the correlated parameters specified in Table 175. "Exp. Set"—Expression set specified in Table 172. "R" = Pearson correlation coefficient; "P" = p value.

TABLE 185

Correlation between the expression level of selected genes of some embodiments of the invention in various tissues and the phenotypic performance under normal conditions at flowering stage across foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY3 | 0.76 | 6.43E−03 | 1 | 12 | LBY55 | 0.74 | 1.54E−02 | 2 | 13 |
| LBY57 | 0.75 | 8.25E−03 | 1 | 10 | LBY59 | 0.78 | 4.68E−03 | 1 | 12 |
| LBY62 | 0.74 | 8.79E−03 | 1 | 7 | LBY65 | 0.71 | 1.46E−02 | 1 | 7 |
| LBY77 | 0.86 | 1.47E−03 | 2 | 9 | LBY77 | 0.80 | 5.22E−03 | 2 | 7 |
| LBY77 | 0.78 | 7.84E−03 | 2 | 8 | LBY81 | 0.82 | 2.07E−03 | 1 | 12 |
| LBY84 | 0.73 | 1.09E−02 | 1 | 11 | LBY88 | 0.83 | 1.60E−03 | 1 | 12 |
| LBY91 | 0.76 | 6.79E−03 | 1 | 7 | | | | | |

Table 185. Provided are the correlations (R) between the genes expression levels in various tissues and the phenotypic performance. "Corr. ID "—correlation set ID according to the correlated parameters specified in Table 175. "Exp. Set"—Expression set specified in Table 173. "R" = Pearson correlation coefficient; "P" = p value.

TABLE 186

Correlation between the expression level of selected genes of some embodiments of the invention in various tissues and the phenotypic performance under normal conditions at grain filling stage across foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY3 | 0.73 | 1.76E−02 | 2 | 1 | LBY3 | 0.79 | 1.90E−02 | 3 | 1 |
| LBY3 | 0.77 | 2.59E−02 | 3 | 13 | LBY3 | 0.74 | 3.71E−02 | 3 | 4 |
| LBY3 | 0.82 | 1.18E−02 | 3 | 9 | LBY3 | 0.92 | 1.30E−03 | 3 | 7 |
| LBY3 | 0.87 | 5.15E−03 | 3 | 8 | LBY3 | 0.86 | 2.90E−02 | 1 | 11 |
| LBY55 | 0.73 | 1.55E−02 | 2 | 13 | LBY55 | 0.77 | 9.15E−03 | 2 | 9 |
| LBY55 | 0.87 | 1.11E−03 | 2 | 7 | LBY55 | 0.70 | 2.40E−02 | 2 | 8 |
| LBY55 | 0.78 | 2.27E−02 | 3 | 15 | LBY55 | 0.73 | 1.02E−01 | 1 | 10 |
| LBY55 | 0.95 | 3.29E−03 | 1 | 9 | LBY55 | 0.95 | 3.11E−03 | 1 | 7 |
| LBY55 | 0.90 | 1.42E−02 | 1 | 6 | LBY55 | 0.89 | 1.88E−02 | 1 | 8 |
| LBY57 | 0.76 | 2.88E−02 | 3 | 11 | LBY57 | 0.82 | 4.43E−02 | 1 | 10 |
| LBY59 | 0.76 | 1.06E−02 | 2 | 15 | LBY59 | 0.81 | 4.79E−02 | 2 | 13 |
| LBY59 | 0.70 | 5.09E−02 | 3 | 15 | LBY59 | 0.93 | 7.50E−04 | 3 | 13 |
| LBY59 | 0.73 | 4.00E−02 | 3 | 10 | LBY59 | 0.76 | 2.96E−02 | 3 | 9 |
| LBY59 | 0.92 | 1.23E−03 | 3 | 7 | LBY59 | 0.89 | 3.18E−03 | 3 | 8 |
| LBY61 | 0.72 | 1.91E−02 | 2 | 4 | LBY61 | 0.76 | 1.05E−02 | 2 | 11 |
| LBY61 | 0.71 | 2.15E−02 | 2 | 3 | LBY61 | 0.72 | 4.26E−02 | 3 | 12 |
| LBY62 | 0.76 | 7.64E−02 | 1 | 14 | LBY62 | 0.89 | 1.84E−02 | 1 | 5 |
| LBY62 | 0.88 | 1.98E−02 | 1 | 11 | LBY63 | 0.95 | 3.18E−03 | 1 | 12 |
| LBY63 | 0.72 | 1.05E−01 | 1 | 2 | LBY64 | 0.81 | 1.39E−02 | 3 | 7 |
| LBY64 | 0.80 | 1.73E−02 | 3 | 6 | LBY64 | 0.70 | 5.17E−02 | 3 | 8 |
| LBY64 | 0.75 | 8.47E−02 | 1 | 1 | LBY64 | 0.84 | 3.53E−02 | 1 | 10 |
| LBY64 | 0.84 | 3.80E−02 | 1 | 9 | LBY64 | 0.85 | 3.37E−02 | 1 | 6 |
| LBY64 | 0.88 | 2.22E−02 | 1 | 8 | LBY65 | 0.72 | 4.53E−02 | 3 | 5 |
| LBY65 | 0.82 | 4.77E−02 | 1 | 15 | LBY65 | 0.70 | 1.20E−01 | 1 | 7 |
| LBY67 | 0.72 | 1.86E−02 | 2 | 13 | LBY67 | 0.79 | 6.31E−03 | 2 | 9 |
| LBY67 | 0.95 | 3.49E−05 | 2 | 7 | LBY67 | 0.71 | 2.09E−02 | 2 | 8 |
| LBY67 | 0.92 | 1.42E−03 | 3 | 13 | LBY67 | 0.83 | 1.01E−02 | 3 | 10 |
| LBY67 | 0.73 | 3.99E−02 | 3 | 7 | LBY67 | 0.83 | 1.09E−02 | 3 | 8 |
| LBY67 | 0.83 | 4.15E−02 | 1 | 13 | LBY67 | 0.76 | 8.17E−02 | 1 | 2 |
| LBY67 | 0.86 | 2.75E−02 | 1 | 11 | LBY67 | 0.71 | 1.11E−01 | 1 | 9 |
| LBY68 | 0.79 | 6.86E−03 | 2 | 7 | LBY68 | 0.80 | 1.75E−02 | 3 | 11 |
| LBY68 | 0.73 | 9.88E−02 | 1 | 1 | LBY68 | 0.95 | 3.68E−03 | 1 | 10 |

TABLE 186-continued

Correlation between the expression level of selected genes of some embodiments of the invention in various tissues and the phenotypic performance under normal conditions at grain filling stage across foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY68 | 0.89 | 1.62E−02 | 1 | 9 | LBY68 | 0.80 | 5.44E−02 | 1 | 7 |
| LBY68 | 0.91 | 1.30E−02 | 1 | 6 | LBY68 | 0.94 | 4.82E−03 | 1 | 8 |
| LBY69 | 0.78 | 7.63E−03 | 2 | 7 | LBY69 | 0.72 | 4.25E−02 | 3 | 7 |
| LBY70 | 0.78 | 7.24E−03 | 2 | 9 | LBY70 | 0.86 | 1.60E−03 | 2 | 7 |
| LBY70 | 0.73 | 1.75E−02 | 2 | 8 | LBY70 | 0.77 | 7.35E−02 | 1 | 10 |
| LBY71 | 0.86 | 2.78E−02 | 1 | 10 | LBY71 | 0.83 | 4.11E−02 | 1 | 9 |
| LBY71 | 0.79 | 5.89E−02 | 1 | 6 | LBY71 | 0.85 | 3.38E−02 | 1 | 8 |
| LBY72 | 0.72 | 1.05E−01 | 1 | 1 | LBY72 | 0.73 | 9.91E−02 | 1 | 4 |
| LBY73 | 0.76 | 8.12E−02 | 1 | 5 | LBY73 | 0.72 | 1.09E−01 | 1 | 11 |
| LBY74 | 0.75 | 1.32E−02 | 2 | 9 | LBY74 | 0.80 | 5.44E−02 | 1 | 10 |
| LBY75 | 0.81 | 5.03E−02 | 1 | 15 | LBY75 | 0.91 | 1.13E−02 | 1 | 1 |
| LBY75 | 0.89 | 1.61E−02 | 1 | 13 | LBY75 | 0.83 | 3.91E−02 | 1 | 10 |
| LBY75 | 0.85 | 3.10E−02 | 1 | 4 | LBY75 | 0.96 | 2.74E−03 | 1 | 9 |
| LBY75 | 0.72 | 1.07E−01 | 1 | 7 | LBY75 | 0.95 | 4.07E−03 | 1 | 6 |
| LBY75 | 0.95 | 3.54E−03 | 1 | 8 | LBY76 | 0.73 | 4.11E−02 | 3 | 9 |
| LBY76 | 0.78 | 6.64E−02 | 1 | 10 | LBY77 | 0.79 | 5.90E−02 | 1 | 9 |
| LBY77 | 0.77 | 7.20E−02 | 1 | 6 | LBY77 | 0.71 | 1.17E−01 | 1 | 8 |
| LBY78 | 0.71 | 1.15E−01 | 1 | 2 | LBY79 | 0.94 | 5.31E−03 | 1 | 10 |
| LBY79 | 0.90 | 1.36E−02 | 1 | 9 | LBY79 | 0.73 | 1.02E−01 | 1 | 7 |
| LBY79 | 0.90 | 1.56E−02 | 1 | 6 | LBY79 | 0.94 | 5.31E−03 | 1 | 8 |
| LBY80 | 0.89 | 4.95E−04 | 2 | 9 | LBY80 | 0.84 | 2.34E−03 | 2 | 7 |
| LBY80 | 0.85 | 1.89E−03 | 2 | 8 | LBY80 | 0.73 | 3.90E−02 | 3 | 1 |
| LBY80 | 0.90 | 2.21E−03 | 3 | 9 | LBY80 | 0.90 | 2.44E−03 | 3 | 7 |
| LBY80 | 0.79 | 2.06E−02 | 3 | 8 | LBY80 | 0.78 | 6.56E−02 | 1 | 7 |
| LBY81 | 0.80 | 5.22E−03 | 2 | 9 | LBY81 | 0.82 | 3.85E−03 | 2 | 7 |
| LBY81 | 0.81 | 4.65E−03 | 2 | 8 | LBY81 | 0.82 | 1.24E−02 | 3 | 15 |
| LBY81 | 0.81 | 1.48E−02 | 3 | 13 | LBY81 | 0.71 | 4.82E−02 | 3 | 7 |
| LBY81 | 0.91 | 1.25E−02 | 1 | 9 | LBY81 | 0.85 | 3.35E−02 | 1 | 7 |
| LBY81 | 0.84 | 3.57E−02 | 1 | 6 | LBY81 | 0.80 | 5.36E−02 | 1 | 8 |
| LBY82 | 0.71 | 4.80E−02 | 3 | 14 | LBY82 | 0.76 | 8.01E−02 | 1 | 1 |
| LBY82 | 0.82 | 4.44E−02 | 1 | 10 | LBY82 | 0.81 | 5.01E−02 | 1 | 4 |
| LBY82 | 0.71 | 1.17E−01 | 1 | 3 | LBY82 | 0.71 | 1.11E−01 | 1 | 8 |
| LBY83 | 0.80 | 5.67E−02 | 1 | 1 | LBY83 | 0.74 | 9.45E−02 | 1 | 10 |
| LBY83 | 0.70 | 1.21E−01 | 1 | 4 | LBY83 | 0.76 | 7.86E−02 | 1 | 9 |
| LBY83 | 0.78 | 6.66E−02 | 1 | 6 | LBY83 | 0.80 | 5.68E−02 | 1 | 8 |
| LBY84 | 0.74 | 9.01E−02 | 1 | 5 | LBY84 | 0.72 | 1.09E−01 | 1 | 11 |
| LBY85 | 0.73 | 1.56E−02 | 2 | 10 | LBY85 | 0.78 | 8.15E−03 | 2 | 8 |
| LBY85 | 0.85 | 3.31E−02 | 1 | 1 | LBY85 | 0.84 | 3.62E−02 | 1 | 4 |
| LBY85 | 0.82 | 4.35E−02 | 1 | 2 | LBY85 | 0.77 | 7.32E−02 | 1 | 3 |
| LBY86 | 0.71 | 1.13E−01 | 1 | 14 | LBY88 | 0.74 | 9.34E−02 | 1 | 11 |
| LBY89 | 0.78 | 2.24E−02 | 3 | 13 | LBY89 | 0.75 | 3.12E−02 | 3 | 9 |
| LBY89 | 0.95 | 2.73E−04 | 3 | 7 | LBY89 | 0.75 | 3.23E−02 | 3 | 6 |
| LBY89 | 0.85 | 7.56E−03 | 3 | 8 | LBY89 | 0.78 | 6.48E−02 | 1 | 1 |
| LBY89 | 0.87 | 2.33E−02 | 1 | 10 | LBY89 | 0.88 | 2.18E−02 | 1 | 9 |
| LBY89 | 0.88 | 2.13E−02 | 1 | 6 | LBY89 | 0.91 | 1.17E−02 | 1 | 8 |
| LBY91 | 0.73 | 1.02E−01 | 1 | 1 | LGN52 | 0.77 | 2.44E−02 | 3 | 9 |
| LGN52 | 0.75 | 3.12E−02 | 3 | 7 | LGN52 | 0.82 | 4.69E−02 | 1 | 5 |
| LGN52 | 0.70 | 1.20E−01 | 1 | 11 | LGN60 | 0.81 | 4.26E−03 | 2 | 13 |
| LGN60 | 0.84 | 2.50E−03 | 2 | 10 | LGN60 | 0.74 | 1.38E−02 | 2 | 8 |
| LGN60 | 0.74 | 3.57E−02 | 3 | 13 | LGN60 | 0.76 | 8.17E−02 | 1 | 7 |

Table 186. Provide are the correlations (R) between the genes expression levels in various tissues and the phenotypic performance. "Corr. ID "—correlation set ID according to the correlated parameters specified in Table 175. "Exp. Set"—Expression set specified in Table 174. "R" = Pearson correlation coefficient; "P" = p value.

TABLE 187

Correlation between the expression level of selected genes of some embodiments of the invention in various tissues and the phenotypic performance of maintenance of performance under drought vs normal conditions at flowering stage across foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY56 | 0.77 | 5.90E−03 | 2 | 1 | LBY57 | 0.81 | 2.40E−03 | 2 | 11 |
| LBY58 | 0.82 | 6.62E−03 | 3 | 1 | LBY59 | 0.83 | 1.50E−03 | 2 | 11 |
| LBY61 | 0.74 | 2.35E−02 | 3 | 12 | LBY62 | 0.78 | 1.35E−02 | 3 | 1 |
| LBY62 | 0.84 | 4.57E−03 | 3 | 10 | LBY62 | 0.84 | 4.95E−03 | 3 | 8 |
| LBY63 | 0.72 | 1.24E−02 | 2 | 12 | LBY63 | 0.87 | 4.23E−04 | 2 | 7 |
| LBY64 | 0.78 | 7.91E−03 | 1 | 3 | LBY64 | 0.80 | 5.26E−03 | 1 | 4 |

TABLE 187-continued

Correlation between the expression level of selected genes of some embodiments of the invention in various tissues and the phenotypic performance of maintenance of performance under drought vs normal conditions at flowering stage across foxtail millet varieties

| Gene Name | R | P value | Exp. set | Corr. Set ID | Gene Name | R | P value | Exp. set | Corr. Set ID |
| --- | --- | --- | --- | --- | --- | --- | --- | --- | --- |
| LBY64 | 0.75 | 1.32E−02 | 1 | 6 | LBY65 | 0.81 | 7.64E−03 | 3 | 1 |
| LBY65 | 0.74 | 1.34E−02 | 1 | 1 | LBY66 | 0.78 | 5.03E−03 | 2 | 7 |
| LBY67 | 0.77 | 5.30E−03 | 2 | 6 | LBY67 | 0.85 | 1.93E−03 | 1 | 12 |
| LBY68 | 0.70 | 2.31E−02 | 1 | 12 | LBY68 | 0.75 | 1.26E−02 | 1 | 7 |
| LBY69 | 0.74 | 2.14E−02 | 3 | 10 | LBY69 | 0.72 | 2.98E−02 | 3 | 8 |
| LBY70 | 0.77 | 1.57E−02 | 3 | 12 | LBY70 | 0.79 | 1.08E−02 | 3 | 4 |
| LBY70 | 0.83 | 5.73E−03 | 3 | 6 | LBY70 | 0.71 | 2.09E−02 | 1 | 13 |
| LBY71 | 0.81 | 4.65E−03 | 1 | 3 | LBY71 | 0.73 | 1.73E−02 | 1 | 4 |
| LBY71 | 0.76 | 1.04E−02 | 1 | 5 | LBY72 | 0.76 | 1.67E−02 | 3 | 13 |
| LBY72 | 0.83 | 6.03E−03 | 3 | 11 | LBY73 | 0.72 | 3.01E−02 | 3 | 12 |
| LBY73 | 0.82 | 6.40E−03 | 3 | 14 | LBY75 | 0.71 | 3.13E−02 | 3 | 14 |
| LBY75 | 0.71 | 3.14E−02 | 3 | 7 | LBY75 | 0.77 | 9.49E−03 | 1 | 8 |
| LBY77 | 0.73 | 2.49E−02 | 3 | 14 | LBY78 | 0.75 | 7.68E−03 | 2 | 7 |
| LBY80 | 0.76 | 1.81E−02 | 3 | 1 | LBY83 | 0.80 | 5.35E−03 | 1 | 3 |
| LBY83 | 0.85 | 2.03E−03 | 1 | 5 | LBY84 | 0.79 | 3.70E−03 | 2 | 8 |
| LBY85 | 0.75 | 8.32E−03 | 2 | 11 | LBY85 | 0.71 | 2.02E−02 | 1 | 2 |
| LBY87 | 0.72 | 1.82E−02 | 1 | 1 | LBY89 | 0.79 | 6.80E−03 | 1 | 5 |
| LBY92 | 0.71 | 1.43E−02 | 2 | 2 | LBY92 | 0.74 | 8.72E−03 | 2 | 11 |
| LGN52 | 0.76 | 1.82E−02 | 3 | 11 | LGN52 | 0.83 | 1.74E−03 | 2 | 7 |
| LGN52 | 0.70 | 2.36E−02 | 1 | 2 | LGN52 | 0.73 | 1.61E−02 | 1 | 9 |
| LGN52 | 0.86 | 1.38E−03 | 1 | 11 | | | | | |

Table 187. Provided are the correlations (R) between the genes expression levels in various tissues and the phenotypic performance. "Corr. ID "—correlation set ID according to the correlated parameters specified in Table 176. "Exp. Set"—Expression set specified in Table 171. "R" = Pearson correlation coefficient; "P" = p value.

TABLE 188

Correlation between the expression level of selected genes of some embodiments of the invention in various tissues and the phenotypic performance of maintenance of performance under drought vs normal conditions at grain filling stage across foxtail millet varieties

| Gene Name | R | P value | Exp. set | Corr. Set ID | Gene Name | R | P value | Exp. set | Corr. Set ID |
| --- | --- | --- | --- | --- | --- | --- | --- | --- | --- |
| LBY3 | 0.83 | 3.99E−02 | 1 | 2 | LBY3 | 0.72 | 2.00E−02 | 3 | 14 |
| LBY56 | 0.81 | 5.25E−02 | 1 | 1 | LBY56 | 0.87 | 2.46E−02 | 1 | 4 |
| LBY56 | 0.90 | 1.42E−02 | 1 | 6 | LBY57 | 0.91 | 1.25E−02 | 1 | 4 |
| LBY57 | 0.87 | 2.35E−02 | 1 | 6 | LBY58 | 0.73 | 1.03E−01 | 1 | 1 |
| LBY58 | 0.77 | 7.32E−02 | 1 | 3 | LBY58 | 0.72 | 1.77E−02 | 2 | 7 |
| LBY58 | 0.70 | 2.33E−02 | 3 | 12 | LBY61 | 0.84 | 3.79E−02 | 1 | 12 |
| LBY61 | 0.76 | 7.93E−02 | 1 | 7 | LBY62 | 0.72 | 1.08E−01 | 1 | 13 |
| LBY62 | 0.82 | 4.41E−02 | 1 | 10 | LBY62 | 0.76 | 8.16E−02 | 1 | 8 |
| LBY64 | 0.74 | 8.97E−02 | 1 | 12 | LBY64 | 0.77 | 7.41E−02 | 1 | 7 |
| LBY64 | 0.75 | 1.29E−02 | 2 | 14 | LBY65 | 0.80 | 5.42E−02 | 1 | 5 |
| LBY68 | 0.77 | 7.27E−02 | 1 | 1 | LBY68 | 0.90 | 1.47E−02 | 1 | 4 |
| LBY68 | 0.96 | 2.83E−03 | 1 | 6 | LBY68 | 0.87 | 1.15E−03 | 2 | 12 |
| LBY68 | 0.74 | 1.46E−02 | 2 | 10 | LBY68 | 0.78 | 7.16E−03 | 2 | 7 |
| LBY68 | 0.71 | 2.09E−02 | 2 | 8 | LBY68 | 0.82 | 3.41E−03 | 3 | 14 |
| LBY69 | 0.76 | 7.86E−02 | 1 | 3 | LBY69 | 0.95 | 3.49E−03 | 1 | 9 |
| LBY69 | 0.82 | 4.41E−02 | 1 | 5 | LBY69 | 0.72 | 1.08E−01 | 1 | 8 |
| LBY69 | 0.76 | 1.13E−02 | 3 | 14 | LBY69 | 0.74 | 1.34E−02 | 3 | 10 |
| LBY69 | 0.77 | 9.69E−03 | 3 | 8 | LBY70 | 0.80 | 5.44E−02 | 1 | 12 |
| LBY71 | 0.82 | 4.58E−02 | 1 | 1 | LBY71 | 0.91 | 1.30E−02 | 1 | 3 |
| LBY71 | 0.85 | 3.31E−02 | 1 | 4 | LBY72 | 0.90 | 1.45E−02 | 1 | 9 |
| LBY73 | 0.80 | 5.45E−02 | 1 | 11 | LBY74 | 0.82 | 4.79E−02 | 1 | 1 |
| LBY75 | 0.74 | 9.19E−02 | 1 | 1 | LBY75 | 0.81 | 4.97E−02 | 1 | 4 |
| LBY75 | 0.94 | 6.09E−03 | 1 | 6 | LBY75 | 0.75 | 1.32E−02 | 2 | 12 |
| LBY75 | 0.73 | 1.58E−02 | 2 | 7 | LBY75 | 0.74 | 1.45E−02 | 3 | 12 |
| LBY75 | 0.89 | 6.48E−04 | 3 | 7 | LBY76 | 0.82 | 4.53E−02 | 1 | 1 |
| LBY76 | 0.84 | 3.62E−02 | 1 | 4 | LBY76 | 0.94 | 4.78E−03 | 1 | 6 |
| LBY77 | 0.86 | 1.53E−03 | 3 | 12 | LBY77 | 0.70 | 2.32E−02 | 3 | 7 |
| LBY78 | 0.77 | 7.17E−02 | 1 | 1 | LBY78 | 0.77 | 7.15E−02 | 1 | 10 |
| LBY78 | 0.90 | 1.46E−02 | 1 | 4 | LBY78 | 0.87 | 2.27E−02 | 1 | 9 |
| LBY78 | 0.90 | 1.43E−02 | 1 | 6 | LBY78 | 0.85 | 3.27E−02 | 1 | 8 |
| LBY78 | 0.72 | 1.87E−02 | 2 | 6 | LBY78 | 0.77 | 9.44E−03 | 3 | 7 |
| LBY80 | 0.80 | 5.66E−02 | 1 | 1 | LBY80 | 0.84 | 3.50E−02 | 1 | 4 |
| LBY80 | 0.93 | 6.96E−03 | 1 | 6 | LBY81 | 0.72 | 1.07E−01 | 1 | 3 |
| LBY81 | 0.87 | 2.45E−02 | 1 | 5 | LBY82 | 0.83 | 4.26E−02 | 1 | 3 |
| LBY82 | 0.88 | 2.19E−02 | 1 | 5 | LBY83 | 0.71 | 1.12E−01 | 1 | 12 |

TABLE 188-continued

Correlation between the expression level of selected genes of some embodiments of the invention in various tissues and the phenotypic performance of maintenance of performance under drought vs normal conditions at grain filling stage across foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY83 | 0.76 | 8.23E−02 | 1 | 7 | LBY84 | 0.93 | 6.32E−03 | 1 | 11 |
| LBY87 | 0.70 | 2.36E−02 | 2 | 11 | LBY89 | 0.81 | 5.12E−02 | 1 | 12 |
| LBY89 | 0.89 | 1.61E−02 | 1 | 7 | LBY91 | 0.84 | 3.61E−02 | 1 | 3 |
| LBY91 | 0.82 | 4.69E−02 | 1 | 5 | LGN60 | 0.74 | 9.54E−02 | 1 | 1 |
| LGN60 | 0.82 | 4.33E−02 | 1 | 10 | LGN60 | 0.82 | 4.63E−02 | 1 | 9 |
| LGN60 | 0.89 | 1.70E−02 | 1 | 6 | LGN60 | 0.88 | 2.15E−02 | 1 | 8 |
| LGN60 | 0.77 | 9.77E−03 | 2 | 10 | LGN60 | 0.70 | 2.38E−02 | 2 | 4 |
| LGN60 | 0.73 | 1.59E−02 | 2 | 6 | LGN60 | 0.72 | 1.83E−02 | 2 | 8 |

Table 188. Provided are the correlations (R) between the genes expression levels in various tissues and the phenotypic performance. "Corr. ID "—correlation set ID according to the correlated parameters specified in Table 176. "Exp. Set"—Expression set specified in Table 172. "R" = Pearson correlation coefficient; "P" = p value.

Example 21

Production of Foxtail Millet Transcriptome and High Throughput Correlation Analysis Using 60K Foxtail Millet Oligonucleotide Micro-Array In order to produce a high throughput correlation analysis comparing between plant phenotype and gene expression level, the present inventors utilized a foxtail millet oligonucleotide micro-array, produced by Agilent Technologies [chem. (dot) agilent (dot) com/Scripts/PDS (dot) asp?1Page=50879]. The array oligonucleotide represents about 60K foxtail millet genes and transcripts. In order to define correlations between the levels of RNA expression and yield or vigor related parameters, various plant characteristics of 14 different foxtail millet accessions were analyzed. Among them, 11 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Fourteen Foxtail millet accessions in 5 repetitive plots, in the field. Foxtail millet seeds were sown in soil and grown under normal condition [15 units of Nitrogen (kg nitrogen per dunam)], reduced nitrogen fertilization (2.5-3.0 units of Nitrogen in the soil (based on soil measurements) and reduced stands in the field [i.e., 8 plants per meter per row as compared to "standard" stands of 17 plants per meter row].

Analyzed Foxtail millet tissues—three tissues at different developmental stages [leaf, flower, and stem], representing different plant characteristics, were sampled and RNA was extracted as described above. Each micro-array expression information tissue type has received a Set ID as summarized in Tables 189-190 below.

TABLE 189

Foxtail millet transcriptome expression sets under normal conditions

| Expression Set | Set ID |
|---|---|
| flag leaf grown under Normal conditions, grain filling stage | 1 |
| flag leaf grown under Normal conditions, heading stage | 2 |
| flower grown under Normal conditions, heading stage | 3 |
| head grown under Normal conditions, grain filling stage | 4 |
| leaf grown under Normal conditions, seedling stage | 5 |
| low stem grown under Normal conditions, heading stage | 6 |
| mature leaf grown under Normal conditions, grain filling stage | 7 |
| root grown under Normal conditions, seedling stage | 8 |
| stem grown under Normal conditions, seedling stage | 9 |
| stem node grown under Normal conditions, grain filling stage | 10 |
| up stem grown under Normal conditions, grain filling stage | 11 |
| up stem grown under Normal conditions, heading stage | 12 |
| vein grown under Normal conditions, grain filling stage | 13 |

Table 189. Provided are the foxtail millet transcriptome expression sets under normal conditions

TABLE 190

Foxtail millet transcriptome expression sets under low N conditions

| Expression Set | Set ID |
|---|---|
| flag leaf grown under Low N conditions, grain filling stage | 1 |
| flag leaf grown under Low N conditions, heading stage | 2 |
| flower grown under Low N conditions, heading stage | 3 |
| head grown under Low N conditions, grain filling stage | 4 |
| low stem grown under Low N conditions, heading stage | 5 |
| mature leaf grown under Low N conditions, grain filling stage | 6 |
| stem node grown under Low N conditions, grain filling stage | 7 |
| up stem grown under Low N conditions, grain filling stage | 8 |
| up stem grown under Low N conditions, heading stage | 9 |
| vein grown under Low N conditions, grain filling stage | 10 |

Table 190. Provided are the foxtail millet transcriptome expression sets under low N conditions.

Foxtail millet yield components and vigor related parameters assessment—Plants were continuously phenotyped during the growth period and at harvest (Tables 191-192, below). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The following parameters were collected using digital imaging system:

At the end of the growing period the grains were separated from the Plant 'Head' and the following parameters were measured and collected:

(i) Average Grain Area (cm²)—A sample of ~200 grains was weighted, photographed and images were processed using the below described image processing system. The grain area was measured from those images and was divided by the number of grains.

(ii) Average Grain Length and width (cm)—A sample of ~200 grains was weighted, photographed and images were processed using the below described image processing system. The sum of grain lengths and width (longest axis) was measured from those images and was divided by the number of grains.

At the end of the growing period 14 'Heads' were photographed and images were processed using the below described image processing system.

(i) Head Average Area (cm²)—The 'Head' area was measured from those images and was divided by the number of 'Heads'.

(ii) Head Average Length (mm)—The 'Head' length (longest axis) was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot (SP) or by measuring the parameter across all the plants within the plot (RP).

Total Grain Weight (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Head weight and head number—At the end of the experiment, heads were harvested from each plot and were counted and weighted (kg.).

Biomass at harvest—At the end of the experiment the vegetative material from plots was weighted.

Dry weight—total weight of the vegetative portion above ground (excluding roots) after drying at 70° C. in oven for 48 hours at harvest.

Total dry mater per plot—Calculated as Vegetative portion above ground plus all the heads dry weight per plot.

Number days to anthesis—Calculated as the number of days from sowing till 50% of the plot arrives anthesis.

Total No. of tillers—all tillers were counted per plot at two time points at the Vegetative growth (30 days after sowing) and at harvest.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—one plant per plot (5 repeated plots) were selected for measurement of root weight, root length and for counting the number of lateral roots formed.

Shoot FW (fresh weight)—weight of one plant per plot were recorded at different time-points.

Grain N (H)—% N (nitrogen) content of dry matter in the grain at harvest.

Head N (GF)—% N content of dry matter in the head at grain filling.

Total shoot N—calculated as the % N content multiplied by the weight of plant shoot Total grain N—calculated as the % N content multiplied by the weight of plant grain yield.

NUE [kg/kg]—was calculated based on Formula LI.

NUpE [kg/kg]—was calculated based on Formula LII.

Grain NUtE—was calculated based on Formula LV.

Total NUtE was calculated based on Formula LIII.

Stem volume—was calculated based on Formula L above.

Stem density—was calculated based on Formula LIV.

Maintenance of performance under low N conditions—Represent ratio for the specified parameter of low N condition results divided by Normal conditions results (maintenance of phenotype under low N in comparison to normal conditions).

Data parameters collected are summarized in Tables 191-192 herein below

TABLE 191

Foxtail millet correlated parameters under normal and lowN conditions (vectors)-set 1

| Correlated parameter with | Correlation ID |
| --- | --- |
| 1000 grain weight [gr.] | 1 |
| Grain Perimeter [mm] | 2 |
| Grain area [mm²] | 3 |
| Grain length [mm] | 4 |
| Grain width [mm] | 5 |
| Grains Yield per plant (RP) [gr.] | 6 |
| Grains yield (RP) [gr.] | 7 |
| Heads FW (RP) [gr.] | 8 |
| Heads FW (SP) [gr.] | 9 |
| Heads num (SP) [number] | 10 |
| Heads weight (RP) [gr.] | 11 |
| Heads weight (SP) [gr.] | 12 |
| Heads weight per plant (RP) [gr.] | 13 |
| Leaves num_1 [number] | 14 |
| Leaves num_2 [number] | 15 |
| Leaves num_3 [number] | 16 |
| Leaves num_4 [number] | 17 |
| Leaves temperature_1 [° C.] | 18 |
| Leaves temperature_2 [° C.] | 19 |
| Lower Stem DW (F) [gr.] | 20 |
| Lower Stem FW (F) [gr.] | 21 |
| Lower Stem length (F) [cm] | 22 |
| Lower Stem width (F) [cm] | 23 |
| Num days to Heading (field) [days] | 24 |
| Num days to Maturity [days] | 25 |
| Num lateral roots [number] | 26 |
| Plant height growth [cm/day] | 27 |
| Plant height_1 [cm] | 28 |
| Plant height_2 [cm] | 29 |
| Plant height_3 [cm] | 30 |
| Plant height_4 [cm] | 31 |
| Plant num at harvest [number] | 32 |
| Plant weight growth [gr./day] | 33 |
| Root length [cm] | 34 |

TABLE 191-continued

Foxtail millet correlated parameters under normal and lowN conditions (vectors)-set 1

| Correlated parameter with | Correlation ID |
|---|---|
| SPAD (F) [SPAD unit] | 35 |
| SPAD_1 [SPAD unit] | 36 |
| SPAD_2 [SPAD unit] | 37 |
| Shoot DW_1 [gr.] | 38 |
| Shoot DW_2 [gr.] | 39 |
| Shoot DW_3 [gr.] | 40 |
| Tillering_1 [number] | 41 |
| Tillering_2 [number] | 42 |
| Tillering_3 [number] | 43 |
| Upper Stem DW (F) [gr.] | 44 |
| Upper Stem FW (F) [gr.] | 45 |
| Upper Stem length (F) [cm] | 46 |
| Upper Stem width (F) [cm] | 47 |
| Vegetative DW (RP) [gr.] | 48 |
| Vegetative DW (SP) [gr.] | 49 |
| Vegetative DW per plant [gr.] | 50 |
| Vegetative FW (RP) [gr.] | 51 |
| Vegetative FW (SP) [gr.] | 52 |

Table 191. Provided are the foxtail millet collected parameters under normal conditions. "num" = number; "gr." = grams; "F" = flowering stage; "H" = harvest stage; "cm" = centimeter; "N" = nitrogen; "GF" = grain filling stage; "FW" = fresh weight; "DW" = dry weight; "num" = number; "NutE" = Nitrogen utilization efficiency; "NHI" = nitrogen harvest index; "NupE" = Nitrogen uptake efficiency; "SPAD" = chlorophyll levels; "Avr" = average; "RGR' = relative growth rate.

TABLE 192

Foxtail millet additional correlated parameters under normal and low N conditions (vectors)-set 2

| Correlated parameter with | Correlation ID |
|---|---|
| Grain N (H) [%] | 1 |
| Head C_vs._N (GF) [ratio] | 2 |
| Head N (GF) [%] | 3 |
| N harvest index [ratio] | 4 |
| NUE [ratio] | 5 |
| NUpE [ratio] | 6 |
| Shoot N (H) [%] | 7 |
| Total grain N (H) [mg] | 8 |
| Total shoot N (H) [mg] | 9 |
| Grain C_vs_N (H) [ratio] | 10 |
| Grain NUtE [ratio] | 11 |
| Shoot C_vs_N (H) [ratio] | 12 |
| Total NUtE [ratio] | 13 |

Table 192. Provided are the foxtail millet collected parameters under normal conditions. "num" = number; "gr." = grams; "mg" = milligram; "F" = flowering stage; "H" = harvest stage; "cm" = centimeter; "N" = nitrogen; "GF" = grain filling stage; "FW" = fresh weight; "DW" = dry weight; "num" = number; "NutE" = Nitrogen utilization efficiency; "NUE" = Nitrogen use efficiency; "NHI" = nitrogen harvest index; "NupE" = Nitrogen uptake efficiency; "SPAD" = chlorophyll levels; "vs." = versus.

Experimental Results

Fourteen different foxtail millet accessions were grown and characterized for different parameters as described above. The average for each of the measured parameters was calculated using the JMP software and values are summarized in Tables 193-200 below. Subsequent correlation analysis between the various transcriptome sets and the average parameters was conducted (Tables 201-204). Follow, results were integrated to the database.

TABLE 193

Measured parameters of correlation IDs in foxtail millet accessions under normal conditions (set 1 parameters)

| Line/Corr. ID | Line-1 | Line-2 | Line-3 | Line-4 | Line-5 | Line-6 | Line-7 |
|---|---|---|---|---|---|---|---|
| 1 | 3.478 | 2.197 | 2.486 | 2.626 | 2.662 | 2.664 | 2.175 |
| 2 | 0.722 | 0.675 | 0.685 | 0.687 | 0.719 | 0.723 | 0.581 |
| 3 | 0.0357 | 0.0295 | 0.0308 | 0.0315 | 0.0341 | 0.0339 | 0.0243 |
| 4 | 0.245 | 0.256 | 0.256 | 0.251 | 0.268 | 0.274 | 0.197 |
| 5 | 0.185 | 0.147 | 0.153 | 0.160 | 0.162 | 0.158 | 0.157 |
| 6 | 34.714 | 22.998 | 24.837 | 31.068 | 26.644 | 28.315 | 34.919 |
| 7 | 1086.0 | 679.2 | 727.6 | 797.6 | 792.4 | 856.8 | 902.8 |
| 8 | 1.799 | 1.115 | 1.074 | 1.344 | 1.320 | 1.114 | 1.364 |
| 9 | 0.245 | 0.171 | 0.177 | 0.271 | 0.209 | 0.227 | 0.282 |
| 10 | 7.2 | 94.0 | 87.6 | 295.4 | 114.0 | 122.4 | 29.8 |
| 11 | 1.306 | 0.865 | 0.888 | 1.069 | 1.022 | 0.984 | 1.103 |
| 12 | 0.181 | 0.104 | 0.117 | 0.245 | 0.213 | 0.227 | 0.222 |
| 13 | 41.780 | 29.325 | 30.259 | 41.568 | 34.377 | 32.516 | 41.812 |
| 14 | 4.067 | 5.333 | 4.133 | 5.067 | 5.000 | 4.267 | 3.667 |
| 15 | NA | NA | NA | NA | NA | NA | NA |
| 16 | 5.3 | 2.9 | 2.9 | 3.6 | 3.9 | 4.1 | 4.4 |
| 17 | 7.9 | 4.7 | 4.5 | 5.3 | 6.6 | 6.4 | 7.2 |
| 18 | NA | NA | NA | 27.698 | 28.019 | 28.345 | 28.233 |
| 19 | 30.179 | NA | NA | NA | NA | NA | NA |
| 20 | 0.708 | NA | 0.304 | 0.156 | 0.153 | 0.198 | 0.606 |
| 21 | 4.213 | NA | 1.427 | 0.685 | 0.640 | 0.643 | 2.495 |
| 22 | 8.350 | NA | 10.253 | 8.750 | 6.688 | 7.638 | 8.075 |
| 23 | 7.240 | NA | 4.157 | 3.120 | 3.334 | 3.179 | 5.573 |
| 24 | 54.0 | 63.4 | 59.4 | 39.6 | 46.0 | 40.8 | 50.0 |
| 25 | NA | NA | NA | NA | 75.0 | 75.0 | NA |
| 26 | NA | NA | NA | NA | NA | NA | NA |
| 27 | 2.097 | 1.419 | 1.321 | 2.098 | 1.934 | 2.445 | 1.845 |
| 28 | 3.717 | 2.917 | 3.250 | 3.550 | 3.450 | 3.683 | 2.917 |
| 29 | NA | NA | NA | NA | NA | NA | NA |
| 30 | 26.625 | 17.675 | 18.000 | 25.825 | 23.350 | 28.600 | 21.525 |
| 31 | 45.975 | 31.800 | 29.750 | 46.075 | 42.875 | 53.625 | 40.675 |
| 32 | 31.4 | 29.6 | 29.8 | 26.0 | 30.0 | 30.2 | 27.8 |
| 33 | 2.849 | 3.118 | 5.111 | 4.353 | 2.875 | 3.110 | 2.932 |
| 34 | NA | NA | NA | NA | NA | NA | NA |

TABLE 193-continued

Measured parameters of correlation IDs in foxtail millet accessions under normal conditions (set 1 parameters)

| Line/Corr. ID | Line-1 | Line-2 | Line-3 | Line-4 | Line-5 | Line-6 | Line-7 |
|---|---|---|---|---|---|---|---|
| 35 | 60.823 | NA | NA | 54.677 | 49.935 | 57.472 | 58.590 |
| 36 | NA | NA | NA | 54.677 | 49.935 | 57.472 | 58.590 |
| 37 | 60.823 | NA | NA | NA | NA | NA | NA |
| 38 | 12.746 | 19.518 | 14.434 | 20.696 | 20.626 | 21.008 | 14.012 |
| 39 | 57.056 | 65.700 | 54.290 | 59.784 | 60.760 | 71.992 | 53.975 |
| 40 | 88.870 | 97.874 | 162.658 | 135.962 | 100.392 | 103.332 | 97.308 |
| 41 | NA | NA | NA | NA | NA | NA | NA |
| 42 | 1.063 | 21.150 | 16.750 | 34.300 | 17.150 | 10.850 | 3.286 |
| 43 | 1.400 | 10.300 | 7.600 | 10.700 | 6.400 | 9.200 | 2.222 |
| 44 | 0.806 | NA | 0.241 | 0.244 | 0.135 | 0.208 | 0.322 |
| 45 | 3.244 | NA | 0.482 | 0.670 | 0.434 | 0.503 | 1.279 |
| 46 | 33.667 | NA | 17.660 | 36.250 | 19.600 | 27.875 | 26.175 |
| 47 | 3.678 | NA | 1.776 | 1.513 | 1.593 | 1.499 | 2.553 |
| 48 | 1.059 | 1.557 | 1.166 | 0.668 | 0.668 | 0.712 | 0.866 |
| 49 | 0.126 | 0.231 | 0.206 | 0.108 | 0.112 | 0.128 | 0.158 |
| 50 | 33.349 | 52.770 | 41.100 | 25.796 | 22.521 | 23.543 | 31.899 |
| 51 | 3.186 | 3.853 | 2.777 | 1.979 | 2.152 | 1.574 | 2.188 |
| 52 | 0.445 | 0.568 | 0.528 | 0.389 | 0.267 | 0.374 | NA |

Table 193: Provided are the values of each of the parameters (as described above) measured in Foxtail millet accessions (L = Line). Growth conditions are specified in the experimental procedure section. "NA" = not available

TABLE 194

Measured parameters of correlation IDs in additional foxtail millet accessions under normal conditions (set 1 parameters)

| Line/Corr. ID | Line-8 | Line-9 | Line-10 | Line-11 | Line-12 | Line-13 | Line-14 |
|---|---|---|---|---|---|---|---|
| 1 | 2.568 | 2.897 | 1.935 | 2.194 | 2.816 | 2.488 | 3.185 |
| 2 | 0.665 | 0.684 | 0.616 | 0.616 | 0.707 | 0.669 | 0.744 |
| 3 | 0.0295 | 0.0319 | 0.0263 | 0.0262 | 0.0338 | 0.0303 | 0.0372 |
| 4 | 0.242 | 0.230 | 0.212 | 0.221 | 0.259 | 0.241 | 0.272 |
| 5 | 0.156 | 0.177 | 0.158 | 0.151 | 0.166 | 0.161 | 0.174 |
| 6 | 26.396 | 48.351 | 22.349 | 9.376 | 31.527 | 30.097 | 29.978 |
| 7 | 803.6 | 1120.8 | 584.4 | 268.0 | 818.8 | 800.8 | 818.4 |
| 8 | 1.158 | 1.693 | 1.441 | 0.567 | 1.129 | 1.232 | 1.266 |
| 9 | 0.250 | 0.395 | 0.245 | 0.130 | 0.254 | 0.312 | 0.286 |
| 10 | 129.2 | 11.0 | 13.2 | 53.6 | 32.8 | 60.6 | 323.2 |
| 11 | 0.984 | 1.286 | 1.035 | 0.421 | 0.999 | 0.990 | 1.023 |
| 12 | 0.244 | 0.296 | 0.178 | 0.101 | 0.224 | 0.244 | 0.231 |
| 13 | 32.103 | 60.605 | 39.914 | 14.615 | 38.414 | 37.473 | 37.417 |
| 14 | 3.767 | 3.792 | 3.733 | 4.000 | 3.900 | 4.033 | 5.233 |
| 15 | NA | NA | NA | NA | NA | NA | NA |
| 16 | 4.1 | 3.9 | 4.4 | 3.3 | 3.3 | 3.8 | 3.7 |
| 17 | 7.0 | 6.7 | 5.9 | 4.8 | 5.2 | 5.2 | 9.3 |
| 18 | 27.962 | NA | NA | NA | NA | NA | 27.535 |
| 19 | NA | 30.921 | NA | NA | NA | NA | NA |
| 20 | 0.168 | 0.865 | NA | NA | 0.548 | 0.934 | 0.085 |
| 21 | 0.759 | 3.128 | NA | NA | 3.636 | 5.487 | 0.393 |
| 22 | 7.150 | 9.150 | NA | NA | 10.181 | 12.256 | 8.975 |
| 23 | 3.610 | 6.952 | NA | NA | 6.229 | 6.751 | 2.235 |
| 24 | 39.0 | 54.0 | 71.0 | 61.0 | 63.0 | 61.0 | 42.0 |
| 25 | 75.0 | NA | 98.0 | 109.0 | 98.0 | 98.0 | NA |
| 26 | NA | NA | NA | NA | NA | NA | NA |
| 27 | 2.560 | 1.905 | 0.966 | 1.161 | 1.348 | 1.499 | 2.119 |
| 28 | 3.630 | 4.117 | 2.467 | 3.100 | 3.583 | 3.433 | 3.633 |
| 29 | NA | NA | NA | NA | NA | NA | NA |
| 30 | 30.525 | 26.025 | 16.775 | 17.800 | 19.525 | 20.750 | 24.550 |
| 31 | 55.625 | 42.100 | 20.525 | 25.750 | 30.300 | 33.300 | 47.313 |
| 32 | 30.8 | 23.6 | 26.0 | 29.4 | 26.2 | 27.0 | 27.4 |
| 33 | 3.401 | 4.787 | 3.153 | 3.414 | 3.116 | 2.036 | 4.507 |
| 34 | NA | NA | NA | NA | NA | NA | NA |
| 35 | 55.397 | 55.038 | NA | NA | NA | NA | 55.900 |
| 36 | 55.397 | NA | NA | NA | NA | NA | 55.900 |
| 37 | NA | 55.038 | NA | NA | NA | NA | NA |
| 38 | 18.796 | 14.166 | 11.616 | 19.620 | 18.364 | 10.813 | 17.130 |
| 39 | 71.678 | 87.548 | 52.626 | 52.328 | 77.312 | 63.495 | 66.484 |
| 40 | 118.420 | 142.376 | 98.228 | 116.824 | 103.248 | 72.938 | 143.646 |
| 41 | NA | NA | NA | NA | NA | NA | NA |
| 42 | 11.810 | 2.200 | 3.000 | 9.500 | 6.800 | 4.450 | 39.100 |

TABLE 194-continued

Measured parameters of correlation IDs in additional foxtail millet accessions under normal conditions (set 1 parameters)

| Line/Corr. ID | Line-8 | Line-9 | Line-10 | Line-11 | Line-12 | Line-13 | Line-14 |
|---|---|---|---|---|---|---|---|
| 43 | 4.667 | 2.700 | 3.500 | 6.500 | 5.800 | 6.800 | 16.700 |
| 44 | 0.532 | 0.411 | NA | NA | 0.373 | 0.767 | 0.083 |
| 45 | 0.928 | 1.491 | NA | NA | 0.683 | 0.890 | 0.213 |
| 46 | 38.738 | 24.471 | NA | NA | 21.925 | 16.469 | 21.900 |
| 47 | 1.900 | 3.191 | NA | NA | 1.921 | 2.695 | 0.966 |
| 48 | 0.584 | 0.976 | 1.909 | 2.798 | 1.343 | 1.535 | 0.883 |
| 49 | 0.116 | 0.182 | 0.340 | 0.566 | 0.288 | 0.442 | 0.175 |
| 50 | 18.926 | 41.958 | 73.707 | 101.164 | 51.448 | 57.703 | 35.066 |
| 51 | 1.679 | 2.420 | 5.516 | 5.171 | 3.339 | 3.632 | 2.047 |
| 52 | 0.367 | 0.580 | 0.971 | 1.100 | 0.715 | 1.044 | 0.442 |

Table 194: Provided are the values of each of the parameters (as described above) measured in Foxtail millet accessions (L = Line). Growth conditions are specified in the experimental procedure section. "NA" = not available

TABLE 195

Additional measured parameters of correlation IDs in foxtail millet accessions under normal conditions (set 2 parameters)

| Line/Corr. ID | 1 | 2 | 3 | 4 | 5 | 6 | 7 |
|---|---|---|---|---|---|---|---|
| Line-1 | 1.765 | 24.763 | 1.719 | 1.827 | 1.827 | 35.539 | 1.871 |
| Line-2 | 2.364 | 19.628 | 2.213 | 1.210 | 1.210 | 32.850 | 1.525 |
| Line-3 | NA | NA | NA | 1.307 | 1.307 | NA | NA |
| Line-4 | 1.976 | 18.324 | 2.300 | 1.635 | 1.635 | 34.717 | 1.778 |
| Line-5 | 2.071 | 21.671 | 1.967 | 1.402 | 1.402 | 31.398 | 1.989 |
| Line-6 | 2.126 | 20.253 | 2.066 | 1.490 | 1.490 | 33.898 | 1.786 |
| Line-7 | 2.127 | 16.983 | 2.445 | 1.838 | 1.838 | 41.822 | 1.625 |
| Line-8 | NA | NA | NA | 1.389 | 1.389 | NA | NA |
| Line-9 | 1.789 | 21.707 | 1.929 | 2.545 | 2.545 | 48.899 | 1.526 |
| Line-10 | 3.052 | 24.075 | 1.808 | 1.176 | 1.176 | 40.598 | 1.210 |
| Line-11 | NA | NA | NA | 0.493 | 0.493 | 0.000 | NA |
| Line-12 | 1.851 | 19.823 | 2.165 | 1.659 | 1.659 | 34.037 | 1.225 |
| Line-13 | NA | NA | NA | 1.584 | 1.584 | NA | NA |
| Line-14 | 1.971 | 18.396 | 2.265 | 1.578 | 1.578 | 35.904 | 2.603 |

Table 195: Provided are the values of each of the parameters (as described above) measured in Foxtail millet accessions (L = Line). Growth conditions are specified in the experimental procedure section. "NA" = not available

TABLE 196

Additional measured parameters of correlation IDs in additional foxtail millet accessions under normal conditions (set 2 parameters)

| Line/Corr. ID | 8 | 9 | 10 | 11 | 12 | 13 |
|---|---|---|---|---|---|---|
| Line-1 | 612.841 | 62.403 | 23.774 | 0.556 | 22.225 | 0.101 |
| Line-2 | 543.686 | 80.468 | 17.992 | 0.286 | 27.621 | 0.121 |
| Line-3 | NA | NA | NA | NA | NA | NA |
| Line-4 | 613.745 | 45.876 | 21.319 | 0.677 | 23.037 | 0.086 |
| Line-5 | 551.781 | 44.789 | 20.358 | 0.595 | 19.754 | 0.082 |
| Line-6 | 602.010 | 42.048 | 19.684 | 0.673 | 19.987 | 0.081 |
| Line-7 | 742.765 | 51.849 | 19.477 | 0.673 | 23.574 | 0.084 |
| Line-8 | NA | NA | NA | NA | NA | NA |
| Line-9 | 865.048 | 64.025 | 23.184 | 0.755 | 24.995 | 0.097 |
| Line-10 | 682.138 | 89.217 | 13.645 | 0.251 | 31.679 | 0.125 |
| Line-11 | NA | NA | NA | NA | NA | NA |
| Line-12 | 583.649 | 63.049 | 22.670 | 0.500 | 30.770 | 0.128 |
| Line-13 | NA | NA | NA | NA | NA | NA |
| Line-14 | 590.902 | 91.268 | 21.513 | 0.328 | 15.642 | 0.095 |

Table 196: Provided are the values of each of the parameters (as described above) measured in Foxtail millet accessions (L = Line). Growth conditions are specified in the experimental procedure section. "NA" = not available

TABLE 197

Measured parameters of correlation IDs in foxtail millet accessions under low N conditions (set 1 parameters)

| Line/Corr. ID | Line-1 | Line-2 | Line-3 | Line-4 | Line-5 | Line-6 | Line-7 |
|---|---|---|---|---|---|---|---|
| 1 | 3.706 | 2.375 | 2.523 | 2.725 | 2.782 | 2.824 | 2.297 |
| 2 | 0.728 | 0.678 | 0.690 | 0.698 | 0.718 | 0.728 | 0.577 |
| 3 | 0.0356 | 0.0299 | 0.0311 | 0.0324 | 0.0339 | 0.0343 | 0.0240 |
| 4 | 0.245 | 0.256 | 0.261 | 0.253 | 0.266 | 0.275 | 0.195 |
| 5 | 0.185 | 0.149 | 0.152 | 0.163 | 0.162 | 0.159 | 0.157 |
| 6 | 29.853 | 20.461 | 34.437 | 29.746 | 22.314 | 23.019 | 22.590 |
| 7 | 936.4 | 622.8 | 923.6 | 819.5 | 726.8 | 683.5 | 622.8 |
| 8 | 1.597 | 1.007 | 1.382 | 1.416 | 1.140 | 0.887 | 0.966 |
| 9 | 0.255 | 0.162 | 0.221 | 0.259 | 0.155 | 0.184 | 0.194 |
| 10 | 8.2 | 57.0 | 64.6 | 214.0 | 69.2 | 117.8 | 31.8 |
| 11 | 1.178 | 0.807 | 1.168 | 1.065 | 0.879 | 0.768 | 0.761 |
| 12 | 0.180 | 0.157 | 0.184 | 0.229 | 0.168 | 0.187 | 0.143 |
| 13 | 37.588 | 26.525 | 37.223 | 38.705 | 26.978 | 25.858 | 27.608 |
| 14 | 4.267 | 2.600 | 2.800 | 2.533 | 2.600 | 2.280 | 3.567 |
| 15 | NA | NA | NA | NA | NA | NA | NA |
| 16 | 5.90 | 3.45 | 3.20 | 3.50 | 3.95 | 4.15 | 4.90 |
| 17 | 6.50 | 3.65 | 3.15 | 3.90 | 3.75 | 5.05 | 6.15 |
| 18 | NA | NA | NA | 26.298 | 27.093 | 27.808 | 27.653 |
| 19 | 30.827 | NA | NA | NA | NA | NA | NA |
| 20 | 0.992 | NA | 0.296 | 0.180 | 0.143 | 0.247 | 0.553 |
| 21 | 3.569 | NA | 1.501 | 0.675 | 0.536 | 0.939 | 1.928 |

TABLE 197-continued

Measured parameters of correlation IDs in foxtail millet accessions under low N conditions (set 1 parameters)

| Line/Corr. ID | Line-1 | Line-2 | Line-3 | Line-4 | Line-5 | Line-6 | Line-7 |
|---|---|---|---|---|---|---|---|
| 22 | 6.813 | NA | 10.456 | 8.338 | 6.763 | 7.463 | 6.438 |
| 23 | 6.851 | NA | 3.894 | 2.958 | 3.191 | 3.176 | 5.075 |
| 24 | 54.0 | 64.0 | 58.6 | 40.4 | 46.0 | 41.6 | 51.6 |
| 25 | 90.0 | 90.0 | 90.0 | NA | 75.0 | NA | NA |
| 26 | NA | NA | NA | NA | NA | NA | NA |
| 27 | 1.638 | 0.998 | 1.011 | 1.812 | 1.497 | 1.875 | 1.376 |
| 28 | 4.213 | 3.757 | 3.717 | 3.873 | 4.270 | 4.192 | 3.427 |
| 29 | NA | NA | NA | NA | NA | NA | NA |
| 30 | 22.500 | 13.975 | 16.200 | 23.925 | 20.950 | 25.050 | 17.775 |
| 31 | 37.075 | 24.125 | 23.545 | 40.300 | 34.325 | 41.906 | 31.375 |
| 32 | 31.4 | 31.0 | 28.6 | 27.5 | 32.4 | 30.0 | 28.2 |
| 33 | 2.207 | 3.424 | 3.313 | 2.207 | 2.825 | 3.793 | 1.746 |
| 34 | NA | NA | NA | NA | NA | NA | NA |
| 35 | 58.570 | 35.917 | 39.054 | 48.283 | 40.650 | 52.329 | 59.100 |
| 36 | 57.919 | 35.917 | 39.054 | 48.283 | 40.650 | 52.329 | 59.100 |
| 37 | 60.614 | NA | NA | NA | NA | NA | NA |
| 38 | 11.042 | 8.184 | 9.418 | 14.438 | 13.458 | 14.918 | 8.044 |
| 39 | 54.660 | 53.940 | 70.220 | 67.833 | 76.020 | 85.675 | 48.275 |
| 40 | 67.282 | 101.450 | 95.214 | 66.740 | 84.320 | 100.265 | 55.045 |
| 41 | NA | NA | NA | NA | NA | NA | NA |
| 42 | 1.1 | 11.0 | 12.4 | 22.6 | 14.0 | 10.6 | 1.6 |
| 43 | 1.300 | 9.100 | 8.250 | 17.000 | 8.100 | 12.250 | 2.200 |
| 44 | 0.749 | NA | 0.313 | 0.182 | 0.181 | 0.252 | 0.511 |
| 45 | 2.654 | NA | 0.589 | 0.543 | 0.485 | 0.548 | 1.565 |
| 46 | 29.075 | NA | 20.069 | 34.925 | 26.950 | 32.650 | 28.313 |
| 47 | 3.285 | NA | 1.709 | 1.335 | 1.526 | 1.536 | 2.581 |
| 48 | 0.965 | 1.108 | 1.143 | 0.594 | 0.506 | 0.578 | 0.560 |
| 49 | 0.125 | 0.161 | 0.183 | 0.111 | 0.080 | 0.115 | 0.108 |
| 50 | 30.745 | 35.916 | 36.871 | 21.658 | 15.539 | 19.349 | 20.205 |
| 51 | 3.033 | 2.548 | 2.862 | 2.219 | 1.966 | 1.208 | 1.369 |
| 52 | 0.390 | 0.364 | 0.437 | 0.380 | 0.186 | 0.321 | NA |

Table 197: Provided are the values of each of the parameters (as described above) measured in Foxtail millet accessions (L = Line). Growth conditions are specified in the experimental procedure section. "NA" = not available.

TABLE 198

Measured parameters of correlation IDs in additional foxtail millet accessions under low N conditions (set 1 parameters)

| Line/Corr. ID | Line-8 | Line-9 | Line-10 | Line-11 | Line-12 | Line-13 | Line-14 |
|---|---|---|---|---|---|---|---|
| 1 | 2.591 | 3.152 | 2.027 | 2.483 | 3.448 | 2.852 | 3.059 |
| 2 | 0.676 | 0.686 | 0.621 | 0.632 | 0.719 | 0.692 | 0.752 |
| 3 | 0.0303 | 0.0325 | 0.0257 | 0.0277 | 0.0353 | 0.0321 | 0.0373 |
| 4 | 0.246 | 0.228 | 0.212 | 0.227 | 0.260 | 0.249 | 0.276 |
| 5 | 0.157 | 0.182 | 0.157 | 0.155 | 0.173 | 0.164 | 0.173 |
| 6 | 20.658 | 37.088 | 25.387 | 20.968 | 33.964 | 34.850 | 26.215 |
| 7 | 636.5 | 944.0 | 693.6 | 644.8 | 866.4 | 896.0 | 662.5 |
| 8 | 0.980 | 1.520 | 1.475 | 0.992 | 1.151 | 1.276 | 0.985 |
| 9 | 0.172 | 0.313 | 0.279 | 0.146 | 0.271 | 0.303 | 0.226 |
| 10 | 99.2 | 7.0 | 14.6 | 30.8 | 28.8 | 68.2 | 215.3 |
| 11 | 0.781 | 1.144 | 1.067 | 0.805 | 1.013 | 1.087 | 0.824 |
| 12 | 0.177 | 0.242 | 0.207 | 0.121 | 0.241 | 0.263 | 0.169 |
| 13 | 25.301 | 45.060 | 39.256 | 26.079 | 39.719 | 42.378 | 32.667 |
| 14 | 3.000 | 3.400 | 3.833 | 2.900 | 3.067 | 3.367 | 3.200 |
| 15 | NA | NA | NA | NA | NA | NA | NA |
| 16 | 5.00 | 3.95 | 4.45 | 3.55 | 3.75 | 3.80 | 3.35 |
| 17 | 5.20 | 4.75 | 5.15 | 3.20 | 3.65 | 4.30 | 3.30 |
| 18 | 27.922 | NA | NA | NA | NA | NA | 27.175 |
| 19 | NA | 30.606 | NA | NA | NA | NA | NA |
| 20 | 0.162 | 0.955 | NA | NA | 0.476 | 0.935 | 0.079 |
| 21 | 0.538 | 2.975 | NA | NA | 3.934 | 4.391 | 0.303 |
| 22 | 7.163 | 8.500 | NA | NA | 9.944 | 11.844 | 8.671 |
| 23 | 3.111 | 6.431 | NA | NA | 6.516 | 6.079 | 2.133 |
| 24 | 39.0 | 55.4 | 72.4 | 61.0 | 62.2 | 62.4 | 42.8 |
| 25 | 75.0 | 90.0 | 98.0 | 109.0 | 98.0 | 98.0 | NA |
| 26 | NA | NA | NA | NA | NA | NA | NA |
| 27 | 2.104 | 1.468 | 0.839 | 0.831 | 1.103 | 1.178 | 1.252 |
| 28 | 3.723 | 4.663 | 3.107 | 3.567 | 4.007 | 3.753 | 3.480 |
| 29 | NA | NA | NA | NA | NA | NA | NA |

TABLE 198-continued

Measured parameters of correlation IDs in additional foxtail millet accessions under low N conditions (set 1 parameters)

| Line/Corr. ID | Line-8 | Line-9 | Line-10 | Line-11 | Line-12 | Line-13 | Line-14 |
|---|---|---|---|---|---|---|---|
| 30 | 24.188 | 20.656 | 15.063 | 14.025 | 17.675 | 17.450 | 19.175 |
| 31 | 47.500 | 32.750 | 18.225 | 19.800 | 25.625 | 27.175 | 27.950 |
| 32 | 30.8 | 25.2 | 27.6 | 30.6 | 26.8 | 26.6 | 25.5 |
| 33 | 2.181 | 2.521 | 2.712 | 2.375 | 2.632 | 4.087 | 3.436 |
| 34 | NA | NA | NA | NA | NA | NA | NA |
| 35 | 52.853 | 52.217 | 43.756 | 36.613 | 38.742 | 46.165 | 45.377 |
| 36 | 52.853 | 52.323 | 43.756 | 36.613 | 38.742 | 46.165 | 45.377 |
| 37 | NA | 52.495 | NA | NA | NA | NA | NA |
| 38 | 12.852 | 7.882 | 5.622 | 9.900 | 8.688 | 7.605 | 12.704 |
| 39 | 64.020 | 54.780 | 47.975 | 34.775 | 40.275 | 61.960 | 92.375 |
| 40 | 65.934 | 74.170 | 69.474 | 76.900 | 81.097 | 118.808 | 94.587 |
| 41 | NA | NA | NA | NA | NA | NA | NA |
| 42 | 8.5 | 1.2 | 2.2 | 7.8 | 4.9 | 7.6 | 27.0 |
| 43 | 5.400 | 1.900 | 3.300 | 6.111 | 4.000 | 8.600 | 20.625 |
| 44 | 0.339 | 0.505 | NA | NA | 0.683 | 0.756 | 0.088 |
| 45 | 0.715 | 1.525 | NA | NA | 0.898 | 1.343 | 0.204 |
| 46 | 38.638 | 22.288 | NA | NA | 27.169 | 18.073 | 26.913 |
| 47 | 1.715 | 2.823 | NA | NA | 1.999 | 2.569 | 0.896 |
| 48 | 0.470 | 0.737 | 1.742 | 2.394 | 1.172 | 1.533 | 0.739 |
| 49 | 0.078 | 0.132 | 0.326 | 0.349 | 0.283 | 0.384 | 0.127 |
| 50 | 15.385 | 29.062 | 59.541 | 76.549 | 45.176 | 59.121 | 28.725 |
| 51 | 1.346 | 1.987 | 4.548 | 4.367 | 2.751 | 2.670 | 1.435 |
| 52 | 0.243 | 0.426 | 0.869 | 0.635 | 0.647 | 0.799 | 0.326 |

Table 198: Provided are the values of each of the parameters (as described above) measured in Foxtail millet accessions (L = Line). Growth conditions are specified in the experimental procedure section. "NA" = not available

TABLE 199

Measured parameters of correlation IDs in foxtail millet accessions under low N conditions (set 2 parameters)

| Line/Corr. ID | 1 | 2 | 3 | 4 | 5 | 6 | 7 |
|---|---|---|---|---|---|---|---|
| Line-1 | NA | NA | NA | NA | 29.853 | NA | NA |
| Line-2 | 2.030 | 59.677 | 1.974 | 0.894 | 20.461 | 464.773 | 1.377 |
| Line-3 | 1.861 | 23.324 | 1.840 | 0.931 | 34.437 | 688.197 | 1.281 |
| Line-4 | 1.599 | 35.999 | 1.198 | 0.922 | 29.746 | 516.068 | 1.864 |
| Line-5 | 1.586 | 25.739 | 1.638 | 0.931 | 22.314 | 380.021 | 1.683 |
| Line-6 | 1.971 | 33.810 | 1.229 | 0.936 | 23.019 | 484.900 | 1.609 |
| Line-7 | NA | NA | NA | NA | 22.590 | NA | NA |
| Line-8 | 2.260 | 22.593 | 1.910 | 0.946 | 20.658 | 493.501 | 1.733 |
| Line-9 | 1.429 | 22.112 | 1.920 | 0.925 | 37.088 | 572.757 | 1.474 |
| Line-10 | 1.759 | 25.388 | 1.711 | 0.862 | 25.387 | 517.928 | 1.200 |
| Line-11 | NA | NA | NA | NA | 20.968 | 0.000 | NA |
| Line-12 | 1.809 | 20.586 | 2.096 | 0.929 | 33.964 | 661.856 | 1.047 |
| Line-13 | NA | NA | NA | NA | 34.850 | NA | NA |
| Line-14 | 1.941 | 19.832 | 2.127 | 0.900 | 26.215 | 565.170 | 1.963 |

Table 199: Provided are the values of each of the parameters (as described above) measured in Foxtail millet accessions (L = Line). Growth conditions are specified in the experimental procedure section. "NA" = not available

TABLE 200

Measured parameters of correlation IDs in additional foxtail millet accessions under low N conditions (set 2 parameters)

| Line/Corr. ID | 8 | 9 | 10 | 11 | 12 | 13 |
|---|---|---|---|---|---|---|
| Line-1 | NA | NA | NA | NA | NA | NA |
| Line-2 | 415.320 | 49.453 | 20.741 | 0.414 | 28.238 | 0.121 |
| Line-3 | 640.958 | 47.239 | 22.651 | 0.729 | 29.551 | 0.104 |
| Line-4 | 475.705 | 40.363 | 25.730 | 0.737 | 20.639 | 0.100 |
| Line-5 | 353.866 | 26.155 | 26.368 | 0.853 | 22.450 | 0.100 |
| Line-6 | 453.769 | 31.131 | 21.260 | 0.739 | 20.204 | 0.087 |
| Line-7 | NA | NA | NA | NA | NA | NA |
| Line-8 | 466.836 | 26.665 | 18.842 | 0.775 | 22.138 | 0.073 |
| Line-9 | 529.913 | 42.844 | 28.928 | 0.866 | 25.048 | 0.115 |
| Line-10 | 446.456 | 71.472 | 23.919 | 0.355 | 31.807 | 0.164 |
| Line-11 | NA | NA | NA | NA | NA | NA |
| Line-12 | 614.571 | 47.285 | 23.217 | 0.718 | 35.765 | 0.120 |
| Line-13 | NA | NA | NA | NA | NA | NA |
| Line-14 | 508.793 | 56.377 | 21.670 | 0.465 | 20.076 | 0.097 |

Table 200: Provided are the values of each of the parameters (as described above) measured in Foxtail millet accessions (L = Line). Growth conditions are specified in the experimental procedure section. "NA" = not available

TABLE 201

Correlation between the expression level of selected genes of some embodiments of the invention in various tissues and the phenotypic performance under normal conditions across Foxtail millet varieties (set 1)

| Gene Name | R | P value | Exp. set | Corr. Set ID | Gene Name | R | P value | Exp. set | Corr. Set ID |
|---|---|---|---|---|---|---|---|---|---|
| LBY3 | 0.84 | 3.73E−02 | 8 | 48 | LBY3 | 0.75 | 8.91E−02 | 8 | 51 |
| LBY3 | 0.78 | 7.00E−02 | 8 | 50 | LBY3 | 0.80 | 5.75E−02 | 8 | 24 |
| LBY3 | 0.73 | 1.73E−02 | 3 | 48 | LBY3 | 0.77 | 9.58E−03 | 3 | 24 |
| LBY3 | 0.82 | 2.33E−02 | 5 | 47 | LBY3 | 0.71 | 7.23E−02 | 5 | 45 |
| LBY3 | 0.84 | 8.92E−03 | 11 | 23 | LBY3 | 0.78 | 2.28E−02 | 11 | 47 |
| LBY3 | 0.79 | 6.88E−03 | 11 | 6 | LBY3 | 0.90 | 2.37E−03 | 11 | 20 |
| LBY3 | 0.72 | 1.83E−02 | 11 | 7 | LBY3 | 0.79 | 1.95E−02 | 11 | 21 |

TABLE 201-continued

Correlation between the expression level of selected genes of some embodiments of the invention in various tissues and the phenotypic performance under normal conditions across Foxtail millet varieties (set 1)

| Gene Name | R | P value | Exp. set | Corr. Set ID | Gene Name | R | P value | Exp. set | Corr. Set ID |
|---|---|---|---|---|---|---|---|---|---|
| LBY3 | 0.72 | 1.96E−02 | 1 | 49 | LBY3 | 0.74 | 3.77E−02 | 12 | 21 |
| LBY55 | 0.73 | 9.96E−02 | 8 | 8 | LBY55 | 0.73 | 2.42E−02 | 4 | 11 |
| LBY55 | 0.73 | 2.68E−02 | 4 | 8 | LBY55 | 0.82 | 7.35E−03 | 4 | 5 |
| LBY55 | 0.72 | 1.93E−02 | 3 | 27 | LBY55 | 0.97 | 4.76E−06 | 3 | 16 |
| LBY55 | 0.77 | 4.41E−02 | 3 | 35 | LBY55 | 0.72 | 2.00E−02 | 3 | 31 |
| LBY55 | 0.78 | 7.24E−03 | 3 | 17 | LBY55 | 0.71 | 3.28E−02 | 2 | 9 |
| LBY55 | 0.91 | 4.85E−03 | 2 | 23 | LBY55 | 0.91 | 4.07E−03 | 2 | 47 |
| LBY55 | 0.77 | 1.53E−02 | 2 | 6 | LBY55 | 0.91 | 7.45E−04 | 2 | 11 |
| LBY55 | 0.85 | 3.49E−03 | 2 | 13 | LBY55 | 0.92 | 5.08E−04 | 2 | 8 |
| LBY55 | 0.76 | 4.63E−02 | 2 | 45 | LBY55 | 0.90 | 6.21E−03 | 2 | 20 |
| LBY55 | 0.73 | 2.62E−02 | 2 | 7 | LBY55 | 0.81 | 2.66E−02 | 2 | 21 |
| LBY55 | 0.90 | 9.19E−04 | 2 | 5 | LBY55 | 0.72 | 6.67E−02 | 5 | 23 |
| LBY55 | 0.81 | 2.59E−02 | 5 | 47 | LBY55 | 0.70 | 7.82E−02 | 5 | 45 |
| LBY55 | 0.71 | 7.21E−02 | 5 | 20 | LBY55 | 0.71 | 2.18E−02 | 11 | 13 |
| LBY55 | 0.88 | 6.75E−04 | 1 | 9 | LBY55 | 0.92 | 1.74E−04 | 1 | 6 |
| LBY55 | 0.76 | 1.06E−02 | 1 | 11 | LBY55 | 0.94 | 3.96E−05 | 1 | 13 |
| LBY55 | 0.74 | 2.29E−02 | 1 | 20 | LBY55 | 0.74 | 1.42E−02 | 1 | 7 |
| LBY55 | 0.71 | 2.14E−02 | 12 | 9 | LBY56 | 0.72 | 1.03E−01 | 8 | 3 |
| LBY56 | 0.70 | 7.84E−02 | 2 | 22 | LBY57 | 0.86 | 3.10E−03 | 2 | 4 |
| LBY57 | 0.77 | 1.46E−02 | 2 | 3 | LBY57 | 0.82 | 6.39E−03 | 2 | 2 |
| LBY57 | 0.78 | 7.47E−03 | 1 | 43 | LBY57 | 0.75 | 1.16E−02 | 1 | 14 |
| LBY57 | 0.71 | 2.02E−02 | 1 | 10 | LBY57 | 0.79 | 7.08E−03 | 1 | 4 |
| LBY57 | 0.77 | 9.58E−03 | 1 | 42 | LBY57 | 0.74 | 2.21E−02 | 9 | 52 |
| LBY58 | 0.72 | 2.87E−02 | 9 | 43 | LBY58 | 0.74 | 2.31E−02 | 9 | 3 |
| LBY58 | 0.74 | 2.38E−02 | 9 | 17 | LBY58 | 0.71 | 3.05E−02 | 9 | 2 |
| LBY58 | 0.71 | 7.29E−02 | 12 | 35 | LBY59 | 0.76 | 1.76E−02 | 4 | 4 |
| LBY59 | 0.78 | 1.27E−02 | 4 | 38 | LBY59 | 0.75 | 1.24E−02 | 3 | 9 |
| LBY59 | 0.79 | 6.15E−03 | 3 | 12 | LBY59 | 0.88 | 1.93E−03 | 2 | 9 |
| LBY59 | 0.85 | 3.59E−03 | 2 | 6 | LBY59 | 0.76 | 1.65E−02 | 2 | 11 |
| LBY59 | 0.88 | 1.69E−03 | 2 | 13 | LBY59 | 0.71 | 3.28E−02 | 2 | 28 |
| LBY59 | 0.72 | 2.93E−02 | 2 | 12 | LBY59 | 0.75 | 2.11E−02 | 2 | 7 |
| LBY59 | 0.71 | 3.33E−02 | 2 | 5 | LBY59 | 0.80 | 3.23E−02 | 5 | 47 |
| LBY59 | 0.77 | 9.22E−03 | 11 | 9 | LBY59 | 0.81 | 1.55E−02 | 11 | 23 |
| LBY59 | 0.75 | 3.10E−02 | 11 | 47 | LBY59 | 0.94 | 4.06E−05 | 11 | 6 |
| LBY59 | 0.85 | 2.05E−03 | 11 | 11 | LBY59 | 0.85 | 1.96E−03 | 11 | 13 |
| LBY59 | 0.71 | 2.12E−02 | 11 | 8 | LBY59 | 0.89 | 2.83E−03 | 11 | 20 |
| LBY59 | 0.91 | 2.83E−04 | 11 | 7 | LBY59 | 0.76 | 2.99E−02 | 11 | 21 |
| LBY59 | 0.71 | 2.05E−02 | 11 | 5 | LBY59 | 0.74 | 5.97E−02 | 1 | 35 |
| LBY59 | 0.71 | 2.25E−02 | 1 | 24 | LBY59 | 0.72 | 2.84E−02 | 1 | 22 |
| LBY59 | 0.83 | 2.19E−02 | 9 | 44 | LBY59 | 0.93 | 2.79E−03 | 9 | 23 |
| LBY59 | 0.70 | 7.94E−02 | 9 | 47 | LBY59 | 0.90 | 8.22E−04 | 9 | 48 |
| LBY59 | 0.89 | 1.14E−03 | 9 | 51 | LBY59 | 0.91 | 7.74E−04 | 9 | 50 |
| LBY59 | 0.90 | 9.10E−04 | 9 | 24 | LBY59 | 0.87 | 1.08E−02 | 9 | 22 |
| LBY59 | 0.87 | 1.12E−02 | 9 | 20 | LBY59 | 0.84 | 4.16E−03 | 9 | 49 |
| LBY59 | 0.88 | 1.59E−03 | 9 | 52 | LBY59 | 0.98 | 1.71E−04 | 9 | 21 |
| LBY59 | 0.79 | 7.13E−03 | 12 | 48 | LBY59 | 0.83 | 3.15E−03 | 12 | 50 |
| LBY59 | 0.76 | 1.01E−02 | 12 | 24 | LBY59 | 0.71 | 4.66E−02 | 12 | 22 |
| LBY59 | 0.82 | 3.55E−03 | 12 | 49 | LBY59 | 0.87 | 2.08E−03 | 12 | 52 |
| LBY61 | 0.71 | 1.13E−01 | 8 | 14 | LBY61 | 0.76 | 8.09E−02 | 8 | 4 |
| LBY61 | 0.72 | 1.05E−01 | 8 | 2 | LBY61 | 0.74 | 2.15E−02 | 4 | 48 |
| LBY61 | 0.76 | 1.63E−02 | 4 | 50 | LBY61 | 0.74 | 5.52E−02 | 4 | 22 |
| LBY61 | 0.88 | 1.63E−03 | 4 | 49 | LBY61 | 0.76 | 1.72E−02 | 4 | 52 |
| LBY61 | 0.95 | 9.10E−05 | 5 | 43 | LBY61 | 0.77 | 1.59E−02 | 5 | 10 |
| LBY61 | 0.87 | 2.40E−03 | 5 | 4 | LBY61 | 0.76 | 1.73E−02 | 5 | 2 |
| LBY61 | 0.76 | 1.70E−02 | 5 | 42 | LBY61 | 0.74 | 2.22E−02 | 1 | 44 |
| LBY61 | 0.77 | 1.43E−02 | 1 | 46 | LBY61 | 0.81 | 7.96E−03 | 9 | 43 |
| LBY61 | 0.75 | 1.89E−02 | 12 | 52 | LBY62 | 0.81 | 4.83E−02 | 8 | 16 |
| LBY62 | 0.89 | 1.64E−02 | 8 | 17 | LBY62 | 0.80 | 9.44E−03 | 2 | 27 |
| LBY62 | 0.79 | 1.07E−02 | 2 | 31 | LBY62 | 0.89 | 1.31E−03 | 2 | 17 |
| LBY62 | 0.91 | 4.15E−03 | 2 | 46 | LBY62 | 0.79 | 1.09E−02 | 2 | 30 |
| LBY62 | 0.71 | 3.17E−02 | 5 | 14 | LBY62 | 0.74 | 2.35E−02 | 5 | 38 |
| LBY62 | 0.82 | 6.65E−03 | 9 | 9 | LBY62 | 0.80 | 9.39E−03 | 9 | 6 |
| LBY62 | 0.81 | 7.64E−03 | 9 | 11 | LBY62 | 0.80 | 9.08E−03 | 9 | 13 |
| LBY62 | 0.71 | 7.50E−02 | 9 | 45 | LBY62 | 0.73 | 6.48E−02 | 9 | 46 |
| LBY62 | 0.74 | 2.39E−02 | 9 | 30 | LBY62 | 0.76 | 1.65E−02 | 9 | 12 |
| LBY62 | 0.72 | 2.89E−02 | 9 | 7 | LBY62 | 0.79 | 6.02E−03 | 12 | 27 |
| LBY62 | 0.78 | 7.72E−03 | 12 | 31 | LBY62 | 0.82 | 3.35E−03 | 12 | 30 |
| LBY63 | 0.83 | 3.28E−03 | 3 | 43 | LBY63 | 0.88 | 8.69E−04 | 3 | 10 |
| LBY63 | 0.84 | 2.23E−03 | 3 | 42 | LBY63 | 0.96 | 4.26E−05 | 2 | 27 |
| LBY63 | 0.95 | 9.51E−05 | 2 | 31 | LBY63 | 0.72 | 2.85E−02 | 2 | 17 |
| LBY63 | 0.92 | 3.28E−03 | 2 | 46 | LBY63 | 0.94 | 1.50E−04 | 2 | 30 |
| LBY63 | 0.71 | 2.05E−02 | 11 | 43 | LBY63 | 0.74 | 1.51E−02 | 11 | 10 |
| LBY63 | 0.73 | 1.69E−02 | 11 | 40 | LBY63 | 0.97 | 6.14E−06 | 12 | 43 |

TABLE 201-continued

Correlation between the expression level of selected genes of some embodiments of the invention in various tissues and the phenotypic performance under normal conditions across Foxtail millet varieties (set 1)

| Gene Name | R | P value | Exp. set | Corr. Set ID | Gene Name | R | P value | Exp. set | Corr. Set ID |
|---|---|---|---|---|---|---|---|---|---|
| LBY63 | 0.82 | 3.88E−03 | 12 | 14 | LBY63 | 0.88 | 8.45E−04 | 12 | 10 |
| LBY63 | 0.76 | 1.06E−02 | 12 | 4 | LBY63 | 0.93 | 1.07E−04 | 12 | 42 |
| LBY64 | 0.79 | 6.17E−02 | 8 | 32 | LBY64 | 0.74 | 9.41E−02 | 8 | 39 |
| LBY64 | 0.74 | 2.37E−02 | 2 | 50 | LBY64 | 0.75 | 1.92E−02 | 2 | 24 |
| LBY64 | 0.77 | 4.39E−02 | 2 | 22 | LBY64 | 0.80 | 1.76E−02 | 11 | 23 |
| LBY64 | 0.74 | 3.61E−02 | 11 | 47 | LBY64 | 0.92 | 1.88E−04 | 11 | 48 |
| LBY64 | 0.92 | 1.68E−04 | 11 | 51 | LBY64 | 0.92 | 1.59E−04 | 11 | 50 |
| LBY64 | 0.93 | 1.16E−04 | 11 | 24 | LBY64 | 0.81 | 1.51E−02 | 11 | 22 |
| LBY64 | 0.79 | 2.03E−02 | 11 | 20 | LBY64 | 0.84 | 2.15E−03 | 11 | 49 |
| LBY64 | 0.92 | 5.13E−04 | 11 | 52 | LBY64 | 0.85 | 8.20E−03 | 11 | 21 |
| LBY64 | 0.79 | 6.68E−03 | 1 | 48 | LBY64 | 0.73 | 6.24E−02 | 1 | 35 |
| LBY64 | 0.76 | 1.10E−02 | 1 | 51 | LBY64 | 0.76 | 1.07E−02 | 1 | 50 |
| LBY64 | 0.80 | 4.99E−03 | 1 | 24 | LBY64 | 0.90 | 8.35E−04 | 1 | 22 |
| LBY64 | 0.71 | 2.13E−02 | 1 | 49 | LBY64 | 0.77 | 1.45E−02 | 1 | 52 |
| LBY64 | 0.87 | 1.05E−03 | 12 | 12 | LBY65 | 0.74 | 9.52E−02 | 8 | 17 |
| LBY65 | 0.75 | 2.03E−02 | 4 | 17 | LBY65 | 0.73 | 1.57E−02 | 3 | 27 |
| LBY65 | 0.82 | 3.91E−03 | 3 | 16 | LBY65 | 0.73 | 1.59E−02 | 3 | 31 |
| LBY65 | 0.80 | 5.03E−03 | 3 | 28 | LBY65 | 0.74 | 1.35E−02 | 3 | 17 |
| LBY65 | 0.75 | 1.25E−02 | 3 | 30 | LBY65 | 0.75 | 1.20E−02 | 3 | 39 |
| LBY65 | 0.73 | 1.65E−02 | 3 | 12 | LBY65 | 0.71 | 3.20E−02 | 2 | 51 |
| LBY65 | 0.78 | 3.94E−02 | 5 | 23 | LBY65 | 0.73 | 6.46E−02 | 5 | 47 |
| LBY65 | 0.71 | 7.61E−02 | 5 | 21 | LBY65 | 0.80 | 5.88E−03 | 11 | 9 |
| LBY65 | 0.90 | 2.36E−03 | 11 | 23 | LBY65 | 0.86 | 5.75E−03 | 11 | 47 |
| LBY65 | 0.74 | 1.35E−02 | 11 | 6 | LBY65 | 0.74 | 1.47E−02 | 11 | 11 |
| LBY65 | 0.85 | 1.73E−03 | 11 | 13 | LBY65 | 0.79 | 6.21E−03 | 11 | 8 |
| LBY65 | 0.90 | 2.38E−03 | 11 | 20 | LBY65 | 0.80 | 5.05E−03 | 11 | 12 |
| LBY65 | 0.84 | 8.98E−03 | 11 | 21 | LBY65 | 0.87 | 1.21E−03 | 1 | 48 |
| LBY65 | 0.79 | 3.62E−02 | 1 | 35 | LBY65 | 0.83 | 3.16E−03 | 1 | 51 |
| LBY65 | 0.81 | 4.37E−03 | 1 | 50 | LBY65 | 0.86 | 1.37E−03 | 1 | 24 |
| LBY65 | 0.76 | 1.87E−02 | 1 | 22 | LBY65 | 0.71 | 2.15E−02 | 1 | 49 |
| LBY65 | 0.79 | 1.07E−02 | 1 | 52 | LBY65 | 0.81 | 7.55E−03 | 9 | 32 |
| LBY65 | 0.77 | 8.85E−03 | 12 | 50 | LBY65 | 0.73 | 1.64E−02 | 12 | 24 |
| LBY65 | 0.72 | 4.26E−02 | 12 | 22 | LBY65 | 0.83 | 3.08E−03 | 12 | 49 |
| LBY65 | 0.88 | 1.71E−03 | 12 | 52 | LBY66 | 0.83 | 2.77E−03 | 3 | 43 |
| LBY66 | 0.75 | 1.31E−02 | 3 | 10 | LBY66 | 0.84 | 2.12E−03 | 3 | 42 |
| LBY66 | 0.78 | 1.23E−02 | 2 | 27 | LBY66 | 0.78 | 1.32E−02 | 2 | 31 |
| LBY66 | 0.73 | 2.62E−02 | 2 | 10 | LBY66 | 0.72 | 2.99E−02 | 2 | 30 |
| LBY66 | 0.78 | 7.27E−03 | 12 | 43 | LBY66 | 0.73 | 1.56E−02 | 12 | 42 |
| LBY67 | 0.79 | 5.99E−02 | 8 | 9 | LBY67 | 0.73 | 1.01E−01 | 8 | 6 |
| LBY67 | 0.80 | 5.62E−02 | 8 | 11 | LBY67 | 0.91 | 1.08E−02 | 8 | 13 |
| LBY67 | 0.91 | 1.10E−02 | 8 | 8 | LBY67 | 0.83 | 4.23E−02 | 8 | 5 |
| LBY67 | 0.87 | 1.14E−02 | 4 | 44 | LBY67 | 0.78 | 3.91E−02 | 4 | 23 |
| LBY67 | 0.73 | 6.42E−02 | 4 | 47 | LBY67 | 0.85 | 3.27E−02 | 4 | 35 |
| LBY67 | 0.80 | 2.94E−02 | 4 | 45 | LBY67 | 0.72 | 6.75E−02 | 4 | 20 |
| LBY67 | 0.72 | 3.00E−02 | 4 | 32 | LBY67 | 0.87 | 1.07E−02 | 4 | 21 |
| LBY67 | 0.83 | 3.14E−03 | 3 | 43 | LBY67 | 0.71 | 2.21E−02 | 3 | 10 |
| LBY67 | 0.86 | 1.54E−03 | 3 | 4 | LBY67 | 0.72 | 1.99E−02 | 3 | 38 |
| LBY67 | 0.78 | 7.47E−03 | 3 | 2 | LBY67 | 0.71 | 2.07E−02 | 3 | 42 |
| LBY67 | 0.72 | 2.90E−02 | 2 | 1 | LBY67 | 0.86 | 1.32E−02 | 2 | 44 |
| LBY67 | 0.71 | 7.51E−02 | 2 | 47 | LBY67 | 0.74 | 2.33E−02 | 2 | 27 |
| LBY67 | 0.86 | 2.83E−03 | 2 | 48 | LBY67 | 0.73 | 2.47E−02 | 2 | 16 |
| LBY67 | 0.78 | 1.40E−02 | 2 | 51 | LBY67 | 0.73 | 2.49E−02 | 2 | 31 |
| LBY67 | 0.72 | 2.77E−02 | 2 | 10 | LBY67 | 0.93 | 3.14E−04 | 2 | 50 |
| LBY67 | 0.88 | 1.60E−03 | 2 | 24 | LBY67 | 0.83 | 5.81E−03 | 2 | 4 |
| LBY67 | 0.92 | 3.58E−03 | 2 | 45 | LBY67 | 0.72 | 2.84E−02 | 2 | 17 |
| LBY67 | 0.85 | 1.51E−02 | 2 | 22 | LBY67 | 0.73 | 2.70E−02 | 2 | 2 |
| LBY67 | 0.72 | 2.78E−02 | 2 | 30 | LBY67 | 0.91 | 6.89E−04 | 2 | 49 |
| LBY67 | 0.87 | 4.79E−03 | 2 | 52 | LBY67 | 0.77 | 4.30E−02 | 5 | 46 |
| LBY67 | 0.80 | 9.60E−03 | 5 | 30 | LBY67 | 0.79 | 7.05E−03 | 11 | 9 |
| LBY67 | 0.74 | 1.44E−02 | 11 | 6 | LBY67 | 0.82 | 3.74E−03 | 11 | 13 |
| LBY67 | 0.77 | 1.62E−02 | 1 | 22 | LBY67 | 0.80 | 1.02E−02 | 9 | 16 |
| LBY67 | 0.78 | 8.29E−03 | 12 | 50 | LBY67 | 0.82 | 1.24E−02 | 12 | 22 |
| LBY67 | 0.77 | 9.80E−03 | 12 | 49 | LBY67 | 0.70 | 2.28E−02 | 12 | 39 |
| LBY67 | 0.81 | 7.58E−03 | 12 | 52 | LBY68 | 0.70 | 7.69E−02 | 4 | 21 |
| LBY68 | 0.89 | 1.20E−03 | 3 | 23 | LBY68 | 0.76 | 1.80E−02 | 3 | 47 |
| LBY68 | 0.76 | 1.10E−02 | 3 | 48 | LBY68 | 0.74 | 1.36E−02 | 3 | 51 |
| LBY68 | 0.75 | 1.29E−02 | 3 | 50 | LBY68 | 0.84 | 2.19E−03 | 3 | 24 |
| LBY68 | 0.80 | 1.02E−02 | 3 | 22 | LBY68 | 0.88 | 1.79E−03 | 3 | 20 |
| LBY68 | 0.83 | 5.22E−03 | 3 | 52 | LBY68 | 0.83 | 5.77E−03 | 3 | 21 |
| LBY68 | 0.77 | 4.13E−02 | 2 | 22 | LBY68 | 0.78 | 3.79E−02 | 5 | 44 |
| LBY68 | 0.91 | 4.32E−03 | 5 | 23 | LBY68 | 0.80 | 2.94E−02 | 5 | 47 |
| LBY68 | 0.72 | 6.76E−02 | 5 | 45 | LBY68 | 0.78 | 3.65E−02 | 5 | 22 |
| LBY68 | 0.89 | 8.00E−03 | 5 | 20 | LBY68 | 0.90 | 6.38E−03 | 5 | 21 |

TABLE 201-continued

Correlation between the expression level of selected genes of some embodiments of the invention in various tissues and the phenotypic performance under normal conditions across Foxtail millet varieties (set 1)

| Gene Name | R | P value | Exp. set | Corr. Set ID | Gene Name | R | P value | Exp. set | Corr. Set ID |
|---|---|---|---|---|---|---|---|---|---|
| LBY68 | 0.97 | 3.84E−04 | 9 | 44 | LBY68 | 0.95 | 1.05E−03 | 9 | 23 |
| LBY68 | 0.93 | 2.06E−03 | 9 | 47 | LBY68 | 0.71 | 3.26E−02 | 9 | 13 |
| LBY68 | 0.91 | 4.54E−03 | 9 | 45 | LBY68 | 0.97 | 4.03E−04 | 9 | 20 |
| LBY68 | 0.87 | 1.06E−02 | 9 | 21 | LBY68 | 0.72 | 1.99E−02 | 12 | 48 |
| LBY68 | 0.70 | 2.31E−02 | 12 | 51 | LBY68 | 0.74 | 1.43E−02 | 12 | 50 |
| LBY68 | 0.76 | 1.09E−02 | 12 | 24 | LBY68 | 0.78 | 7.36E−03 | 12 | 49 |
| LBY68 | 0.84 | 4.97E−03 | 12 | 52 | LBY69 | 0.70 | 1.19E−01 | 8 | 9 |
| LBY69 | 0.72 | 1.05E−01 | 8 | 11 | LBY69 | 0.72 | 1.07E−01 | 8 | 16 |
| LBY69 | 0.84 | 3.86E−02 | 8 | 8 | LBY69 | 0.72 | 2.74E−02 | 4 | 9 |
| LBY69 | 0.88 | 1.81E−03 | 4 | 27 | LBY69 | 0.75 | 2.07E−02 | 4 | 11 |
| LBY69 | 0.81 | 8.13E−03 | 4 | 33 | LBY69 | 0.87 | 2.28E−03 | 4 | 31 |
| LBY69 | 0.83 | 6.04E−03 | 4 | 40 | LBY69 | 0.73 | 2.42E−02 | 4 | 8 |
| LBY69 | 0.71 | 3.23E−02 | 4 | 28 | LBY69 | 0.78 | 1.33E−02 | 4 | 17 |
| LBY69 | 0.91 | 7.07E−04 | 4 | 30 | LBY69 | 0.86 | 3.20E−03 | 4 | 5 |
| LBY69 | 0.86 | 1.60E−03 | 3 | 27 | LBY69 | 0.85 | 1.64E−03 | 3 | 31 |
| LBY69 | 0.80 | 5.33E−03 | 3 | 30 | LBY69 | 0.72 | 1.97E−02 | 3 | 12 |
| LBY69 | 0.85 | 3.86E−03 | 2 | 9 | LBY69 | 0.75 | 5.23E−02 | 2 | 23 |
| LBY69 | 0.90 | 5.30E−03 | 2 | 47 | LBY69 | 0.93 | 2.29E−04 | 2 | 6 |
| LBY69 | 0.84 | 4.14E−03 | 2 | 27 | LBY69 | 0.93 | 3.41E−04 | 2 | 11 |
| LBY69 | 0.92 | 3.77E−04 | 2 | 13 | LBY69 | 0.78 | 1.33E−02 | 2 | 16 |
| LBY69 | 0.83 | 5.48E−03 | 2 | 31 | LBY69 | 0.95 | 1.10E−04 | 2 | 8 |
| LBY69 | 0.71 | 7.41E−02 | 2 | 45 | LBY69 | 0.86 | 2.82E−03 | 2 | 17 |
| LBY69 | 0.81 | 2.67E−02 | 2 | 46 | LBY69 | 0.85 | 1.58E−02 | 2 | 20 |
| LBY69 | 0.92 | 4.79E−04 | 2 | 30 | LBY69 | 0.84 | 4.72E−03 | 2 | 12 |
| LBY69 | 0.83 | 5.50E−03 | 2 | 7 | LBY69 | 0.78 | 1.23E−02 | 2 | 5 |
| LBY69 | 0.76 | 1.74E−02 | 5 | 9 | LBY69 | 0.81 | 2.58E−02 | 5 | 23 |
| LBY69 | 0.80 | 1.01E−02 | 5 | 11 | LBY69 | 0.75 | 1.94E−02 | 5 | 13 |
| LBY69 | 0.73 | 2.57E−02 | 5 | 51 | LBY69 | 0.86 | 2.64E−03 | 5 | 8 |
| LBY69 | 0.70 | 3.51E−02 | 5 | 50 | LBY69 | 0.78 | 1.41E−02 | 5 | 24 |
| LBY69 | 0.76 | 4.64E−02 | 5 | 20 | LBY69 | 0.76 | 1.73E−02 | 5 | 49 |
| LBY69 | 0.74 | 2.18E−02 | 5 | 52 | LBY69 | 0.81 | 2.88E−02 | 5 | 21 |
| LBY69 | 0.75 | 2.10E−02 | 5 | 5 | LBY69 | 0.90 | 3.86E−04 | 11 | 9 |
| LBY69 | 0.87 | 1.16E−03 | 11 | 6 | LBY69 | 0.81 | 4.52E−03 | 11 | 11 |
| LBY69 | 0.96 | 6.44E−06 | 11 | 13 | LBY69 | 0.79 | 6.49E−03 | 11 | 8 |
| LBY69 | 0.77 | 2.67E−02 | 11 | 46 | LBY69 | 0.71 | 4.94E−02 | 11 | 20 |
| LBY69 | 0.71 | 2.13E−02 | 11 | 5 | LBY69 | 0.79 | 6.03E−03 | 1 | 9 |
| LBY69 | 0.71 | 2.27E−02 | 1 | 6 | LBY69 | 0.71 | 2.05E−02 | 1 | 11 |
| LBY69 | 0.77 | 8.71E−03 | 1 | 13 | LBY69 | 0.87 | 9.51E−04 | 1 | 16 |
| LBY69 | 0.81 | 8.59E−03 | 1 | 45 | LBY69 | 0.83 | 5.26E−03 | 9 | 9 |
| LBY69 | 0.74 | 2.24E−02 | 9 | 6 | LBY69 | 0.70 | 3.57E−02 | 9 | 48 |
| LBY69 | 0.84 | 4.35E−03 | 9 | 11 | LBY69 | 0.80 | 9.94E−03 | 9 | 13 |
| LBY69 | 0.84 | 4.67E−03 | 9 | 8 | LBY69 | 0.72 | 2.85E−02 | 9 | 50 |
| LBY69 | 0.86 | 1.33E−02 | 9 | 22 | LBY69 | 0.72 | 2.82E−02 | 9 | 12 |
| LBY69 | 0.76 | 1.81E−02 | 9 | 52 | LBY69 | 0.78 | 1.41E−02 | 9 | 5 |
| LBY69 | 0.76 | 1.10E−02 | 12 | 9 | LBY69 | 0.72 | 1.83E−02 | 12 | 33 |
| LBY69 | 0.71 | 2.19E−02 | 12 | 40 | LBY69 | 0.75 | 1.31E−02 | 12 | 17 |
| LBY69 | 0.72 | 1.96E−02 | 12 | 5 | LBY70 | 0.85 | 3.02E−02 | 8 | 33 |
| LBY70 | 0.87 | 2.39E−02 | 8 | 10 | LBY70 | 0.79 | 6.29E−02 | 8 | 40 |
| LBY70 | 0.80 | 5.80E−02 | 4 | 35 | LBY70 | 0.78 | 3.68E−02 | 4 | 22 |
| LBY70 | 0.71 | 2.18E−02 | 3 | 27 | LBY70 | 0.71 | 2.04E−02 | 3 | 31 |
| LBY70 | 0.91 | 5.68E−04 | 5 | 43 | LBY70 | 0.72 | 2.79E−02 | 5 | 27 |
| LBY70 | 0.72 | 2.77E−02 | 5 | 31 | LBY70 | 0.84 | 4.47E−03 | 5 | 10 |
| LBY70 | 0.76 | 1.75E−02 | 5 | 42 | LBY70 | 0.72 | 1.80E−02 | 11 | 3 |
| LBY70 | 0.78 | 7.88E−03 | 1 | 48 | LBY70 | 0.77 | 9.11E−03 | 1 | 51 |
| LBY70 | 0.71 | 2.28E−02 | 1 | 50 | LBY70 | 0.85 | 1.86E−03 | 1 | 24 |
| LBY70 | 0.78 | 1.22E−02 | 1 | 22 | LBY70 | 0.84 | 4.91E−03 | 9 | 43 |
| LBY70 | 0.71 | 3.09E−02 | 9 | 14 | LBY70 | 0.83 | 5.74E−03 | 9 | 10 |
| LBY70 | 0.87 | 2.53E−03 | 9 | 42 | LBY71 | 0.80 | 3.15E−02 | 4 | 22 |
| LBY71 | 0.76 | 1.15E−02 | 3 | 38 | LBY71 | 0.72 | 6.69E−02 | 2 | 22 |
| LBY71 | 0.80 | 2.90E−02 | 5 | 23 | LBY71 | 0.80 | 9.52E−03 | 5 | 24 |
| LBY71 | 0.77 | 4.21E−02 | 5 | 21 | LBY71 | 0.80 | 5.86E−03 | 11 | 48 |
| LBY71 | 0.77 | 9.35E−03 | 11 | 51 | LBY71 | 0.77 | 8.69E−03 | 11 | 50 |
| LBY71 | 0.81 | 4.45E−03 | 11 | 24 | LBY71 | 0.82 | 3.59E−03 | 11 | 49 |
| LBY71 | 0.83 | 5.19E−03 | 11 | 52 | LBY71 | 0.78 | 3.73E−02 | 1 | 35 |
| LBY71 | 0.77 | 9.76E−03 | 1 | 24 | LBY71 | 0.81 | 8.76E−03 | 1 | 22 |
| LBY71 | 0.71 | 2.07E−02 | 1 | 49 | LBY71 | 0.76 | 1.71E−02 | 9 | 48 |
| LBY71 | 0.84 | 4.74E−03 | 9 | 51 | LBY71 | 0.73 | 2.61E−02 | 9 | 50 |
| LBY71 | 0.89 | 1.15E−03 | 9 | 24 | LBY71 | 0.72 | 2.77E−02 | 9 | 49 |
| LBY71 | 0.76 | 1.05E−02 | 12 | 33 | LBY72 | 0.71 | 1.15E−01 | 8 | 3 |
| LBY72 | 0.85 | 3.94E−03 | 4 | 17 | LBY72 | 0.77 | 8.67E−03 | 3 | 27 |
| LBY72 | 0.78 | 8.28E−03 | 3 | 31 | LBY72 | 0.77 | 2.66E−02 | 2 | 52 |
| LBY72 | 0.71 | 3.25E−02 | 5 | 16 | LBY72 | 0.79 | 3.33E−02 | 5 | 46 |
| LBY72 | 0.76 | 1.80E−02 | 1 | 23 | LBY72 | 0.82 | 7.28E−03 | 1 | 47 |

TABLE 201-continued

Correlation between the expression level of selected genes of some embodiments of the invention in various tissues and the phenotypic performance under normal conditions across Foxtail millet varieties (set 1)

| Gene Name | R | P value | Exp. set | Corr. Set ID | Gene Name | R | P value | Exp. set | Corr. Set ID |
|---|---|---|---|---|---|---|---|---|---|
| LBY72 | 0.73 | 1.63E−02 | 1 | 8 | LBY72 | 0.78 | 1.37E−02 | 1 | 45 |
| LBY72 | 0.79 | 1.06E−02 | 1 | 22 | LBY72 | 0.70 | 3.41E−02 | 1 | 20 |
| LBY72 | 0.73 | 2.65E−02 | 1 | 21 | LBY72 | 0.75 | 1.93E−02 | 9 | 9 |
| LBY72 | 0.74 | 2.37E−02 | 9 | 14 | LBY72 | 0.77 | 4.37E−02 | 9 | 46 |
| LBY72 | 0.71 | 3.18E−02 | 9 | 12 | LBY72 | 0.73 | 1.67E−02 | 12 | 43 |
| LBY72 | 0.74 | 1.54E−02 | 12 | 14 | LBY72 | 0.87 | 1.07E−03 | 12 | 10 |
| LBY72 | 0.73 | 1.59E−02 | 12 | 4 | LBY72 | 0.73 | 1.65E−02 | 12 | 3 |
| LBY72 | 0.74 | 1.48E−02 | 12 | 2 | LBY72 | 0.85 | 2.07E−03 | 12 | 42 |
| LBY73 | 0.74 | 2.31E−02 | 4 | 6 | LBY73 | 0.73 | 2.43E−02 | 4 | 13 |
| LBY73 | 0.76 | 1.68E−02 | 4 | 12 | LBY73 | 0.73 | 2.58E−02 | 1 | 44 |
| LBY73 | 0.78 | 3.82E−02 | 9 | 46 | LBY74 | 0.84 | 3.58E−02 | 8 | 16 |
| LBY74 | 0.71 | 1.18E−01 | 8 | 8 | LBY74 | 0.74 | 5.51E−02 | 4 | 44 |
| LBY74 | 0.78 | 3.77E−02 | 4 | 23 | LBY74 | 0.84 | 1.94E−02 | 4 | 21 |
| LBY74 | 0.73 | 1.59E−02 | 11 | 48 | LBY74 | 0.74 | 1.49E−02 | 11 | 51 |
| LBY74 | 0.76 | 1.06E−02 | 11 | 50 | LBY74 | 0.82 | 3.50E−03 | 11 | 49 |
| LBY74 | 0.86 | 3.19E−03 | 11 | 52 | LBY74 | 0.72 | 1.84E−02 | 1 | 30 |
| LBY74 | 0.82 | 2.28E−02 | 9 | 46 | LBY74 | 0.80 | 9.62E−03 | 12 | 52 |
| LBY75 | 0.82 | 4.41E−02 | 8 | 32 | LBY75 | 0.79 | 6.40E−03 | 8 | 39 |
| LBY75 | 0.75 | 1.20E−02 | 3 | 48 | LBY75 | 0.71 | 2.10E−02 | 3 | 31 |
| LBY75 | 0.70 | 2.40E−02 | 3 | 10 | LBY75 | 0.80 | 4.96E−03 | 3 | 50 |
| LBY75 | 0.85 | 1.66E−03 | 3 | 17 | LBY75 | 0.74 | 2.36E−02 | 3 | 22 |
| LBY75 | 0.80 | 5.52E−03 | 3 | 49 | LBY75 | 0.70 | 3.54E−02 | 3 | 52 |
| LBY75 | 0.77 | 4.27E−02 | 2 | 44 | LBY75 | 0.87 | 1.01E−02 | 2 | 47 |
| LBY75 | 0.75 | 2.07E−02 | 2 | 48 | LBY75 | 0.77 | 1.55E−02 | 2 | 51 |
| LBY75 | 0.74 | 2.16E−02 | 2 | 50 | LBY75 | 0.75 | 2.02E−02 | 2 | 24 |
| LBY75 | 0.89 | 6.94E−03 | 2 | 45 | LBY75 | 0.76 | 1.67E−02 | 2 | 49 |
| LBY75 | 0.74 | 3.57E−02 | 2 | 52 | LBY75 | 0.74 | 5.48E−02 | 2 | 21 |
| LBY75 | 0.85 | 1.55E−02 | 5 | 23 | LBY75 | 0.86 | 1.24E−02 | 5 | 47 |
| LBY75 | 0.77 | 1.49E−02 | 5 | 48 | LBY75 | 0.75 | 2.12E−02 | 5 | 51 |
| LBY75 | 0.74 | 2.30E−02 | 5 | 50 | LBY75 | 0.89 | 1.45E−03 | 5 | 24 |
| LBY75 | 0.73 | 6.52E−02 | 5 | 45 | LBY75 | 0.84 | 1.69E−02 | 5 | 20 |
| LBY75 | 0.83 | 2.13E−02 | 5 | 21 | LBY75 | 0.79 | 6.86E−03 | 11 | 48 |
| LBY75 | 0.75 | 1.18E−02 | 11 | 51 | LBY75 | 0.72 | 1.86E−02 | 11 | 50 |
| LBY75 | 0.87 | 1.08E−03 | 11 | 24 | LBY75 | 0.88 | 8.07E−04 | 1 | 48 |
| LBY75 | 0.80 | 5.97E−03 | 1 | 51 | LBY75 | 0.84 | 2.29E−03 | 1 | 50 |
| LBY75 | 0.83 | 2.68E−03 | 1 | 24 | LBY75 | 0.86 | 3.10E−03 | 1 | 22 |
| LBY75 | 0.89 | 6.43E−04 | 1 | 49 | LBY75 | 0.87 | 2.26E−03 | 1 | 52 |
| LBY75 | 0.75 | 1.21E−02 | 12 | 48 | LBY75 | 0.77 | 9.16E−03 | 12 | 50 |
| LBY75 | 0.91 | 1.79E−03 | 12 | 22 | LBY75 | 0.79 | 6.42E−03 | 12 | 49 |
| LBY75 | 0.71 | 3.10E−02 | 12 | 52 | LBY76 | 0.89 | 1.67E−02 | 8 | 43 |
| LBY76 | 0.73 | 9.68E−02 | 8 | 14 | LBY76 | 0.72 | 1.03E−01 | 8 | 33 |
| LBY76 | 0.88 | 2.05E−02 | 8 | 10 | LBY76 | 0.74 | 9.54E−02 | 8 | 38 |
| LBY76 | 0.87 | 2.39E−02 | 8 | 42 | LBY76 | 0.72 | 6.91E−02 | 4 | 23 |
| LBY76 | 0.77 | 4.32E−02 | 4 | 47 | LBY76 | 0.94 | 1.97E−04 | 4 | 48 |
| LBY76 | 0.94 | 1.97E−04 | 4 | 51 | LBY76 | 0.90 | 1.04E−03 | 4 | 50 |
| LBY76 | 0.88 | 1.57E−03 | 4 | 24 | LBY76 | 0.80 | 2.94E−02 | 4 | 20 |
| LBY76 | 0.78 | 1.32E−02 | 4 | 49 | LBY76 | 0.77 | 1.47E−02 | 4 | 52 |
| LBY76 | 0.75 | 5.11E−02 | 4 | 21 | LBY76 | 0.72 | 2.90E−02 | 2 | 9 |
| LBY76 | 0.81 | 8.22E−03 | 2 | 6 | LBY76 | 0.74 | 2.23E−02 | 2 | 50 |
| LBY76 | 0.75 | 4.99E−02 | 2 | 20 | LBY76 | 0.89 | 3.24E−03 | 2 | 52 |
| LBY76 | 0.82 | 6.30E−03 | 5 | 27 | LBY76 | 0.82 | 6.36E−03 | 5 | 31 |
| LBY76 | 0.71 | 3.14E−02 | 5 | 4 | LBY76 | 0.84 | 4.46E−03 | 5 | 38 |
| LBY76 | 0.72 | 6.92E−02 | 5 | 46 | LBY76 | 0.74 | 2.14E−02 | 5 | 30 |
| LBY76 | 0.74 | 1.46E−02 | 11 | 6 | LBY76 | 0.76 | 1.00E−02 | 11 | 48 |
| LBY76 | 0.75 | 1.27E−02 | 11 | 13 | LBY76 | 0.76 | 1.07E−02 | 11 | 50 |
| LBY76 | 0.82 | 3.55E−03 | 11 | 24 | LBY76 | 0.85 | 7.49E−03 | 11 | 22 |
| LBY76 | 0.77 | 9.67E−03 | 11 | 49 | LBY76 | 0.74 | 2.22E−02 | 11 | 52 |
| LBY76 | 0.82 | 6.76E−03 | 1 | 44 | LBY76 | 0.81 | 8.52E−03 | 1 | 23 |
| LBY76 | 0.88 | 1.77E−03 | 1 | 47 | LBY76 | 0.87 | 1.14E−03 | 1 | 6 |
| LBY76 | 0.75 | 1.16E−02 | 1 | 11 | LBY76 | 0.78 | 7.80E−03 | 1 | 13 |
| LBY76 | 0.81 | 4.50E−03 | 1 | 8 | LBY76 | 0.89 | 1.12E−03 | 1 | 45 |
| LBY76 | 0.81 | 8.64E−03 | 1 | 20 | LBY76 | 0.72 | 1.92E−02 | 1 | 7 |
| LBY76 | 0.80 | 1.04E−02 | 1 | 21 | LBY76 | 0.71 | 7.37E−02 | 9 | 46 |
| LBY76 | 0.75 | 3.35E−02 | 12 | 23 | LBY76 | 0.83 | 3.29E−02 | 12 | 6 |
| LBY76 | 0.84 | 9.60E−03 | 12 | 20 | LBY76 | 0.71 | 3.14E−02 | 12 | 52 |
| LBY77 | 0.74 | 1.52E−02 | 3 | 17 | LBY77 | 0.77 | 1.53E−02 | 2 | 9 |
| LBY77 | 0.75 | 2.11E−02 | 2 | 6 | LBY77 | 0.74 | 2.38E−02 | 2 | 11 |
| LBY77 | 0.75 | 2.00E−02 | 2 | 13 | LBY77 | 0.71 | 3.27E−02 | 2 | 7 |
| LBY77 | 0.71 | 3.20E−02 | 5 | 51 | LBY77 | 0.92 | 1.35E−04 | 11 | 48 |
| LBY77 | 0.85 | 1.82E−03 | 11 | 51 | LBY77 | 0.93 | 1.19E−04 | 11 | 50 |
| LBY77 | 0.84 | 2.58E−03 | 11 | 24 | LBY77 | 0.90 | 2.13E−03 | 11 | 22 |
| LBY77 | 0.92 | 1.31E−04 | 11 | 49 | LBY77 | 0.88 | 1.68E−03 | 11 | 52 |
| LBY77 | 0.91 | 2.62E−04 | 1 | 48 | LBY77 | 0.78 | 3.67E−02 | 1 | 35 |

TABLE 201-continued

Correlation between the expression level of selected genes of some embodiments of the invention in various tissues and the phenotypic performance under normal conditions across Foxtail millet varieties (set 1)

| Gene Name | R | P value | Exp. set | Corr. Set ID | Gene Name | R | P value | Exp. set | Corr. Set ID |
|---|---|---|---|---|---|---|---|---|---|
| LBY77 | 0.86 | 1.47E−03 | 1 | 51 | LBY77 | 0.89 | 5.99E−04 | 1 | 50 |
| LBY77 | 0.88 | 7.44E−04 | 1 | 24 | LBY77 | 0.83 | 5.50E−03 | 1 | 22 |
| LBY77 | 0.94 | 3.89E−05 | 1 | 49 | LBY77 | 0.92 | 5.06E−04 | 1 | 52 |
| LBY78 | 0.74 | 2.23E−02 | 4 | 17 | LBY78 | 0.71 | 3.06E−02 | 4 | 49 |
| LBY78 | 0.81 | 4.61E−03 | 3 | 27 | LBY78 | 0.81 | 4.33E−03 | 3 | 16 |
| LBY78 | 0.81 | 4.70E−03 | 3 | 31 | LBY78 | 0.71 | 3.09E−02 | 3 | 46 |
| LBY78 | 0.83 | 2.89E−03 | 3 | 30 | LBY78 | 0.81 | 7.61E−03 | 2 | 27 |
| LBY78 | 0.79 | 1.06E−02 | 2 | 31 | LBY78 | 0.70 | 3.50E−02 | 2 | 17 |
| LBY78 | 0.71 | 7.19E−02 | 2 | 46 | LBY78 | 0.82 | 7.22E−03 | 2 | 30 |
| LBY78 | 0.84 | 1.82E−02 | 5 | 47 | LBY78 | 0.71 | 3.21E−02 | 5 | 24 |
| LBY78 | 0.70 | 7.90E−02 | 5 | 45 | LBY78 | 0.72 | 6.79E−02 | 5 | 20 |
| LBY78 | 0.77 | 8.85E−03 | 1 | 9 | LBY78 | 0.74 | 1.54E−02 | 1 | 10 |
| LBY78 | 0.76 | 1.01E−02 | 1 | 17 | LBY78 | 0.76 | 2.94E−02 | 12 | 47 |
| LBY78 | 0.89 | 4.71E−04 | 12 | 6 | LBY78 | 0.78 | 7.82E−03 | 12 | 11 |
| LBY78 | 0.74 | 1.52E−02 | 12 | 13 | LBY78 | 0.76 | 1.07E−02 | 12 | 17 |
| LBY78 | 0.82 | 1.19E−02 | 12 | 20 | LBY78 | 0.72 | 1.82E−02 | 12 | 12 |
| LBY78 | 0.91 | 2.33E−04 | 12 | 7 | LBY79 | 0.74 | 8.99E−02 | 8 | 8 |
| LBY79 | 0.74 | 1.42E−02 | 3 | 2 | LBY79 | 0.73 | 1.58E−02 | 11 | 51 |
| LBY79 | 0.72 | 1.77E−02 | 11 | 50 | LBY79 | 0.78 | 7.82E−03 | 11 | 49 |
| LBY79 | 0.88 | 1.52E−03 | 11 | 52 | LBY79 | 0.82 | 6.29E−03 | 9 | 48 |
| LBY79 | 0.81 | 8.59E−03 | 9 | 51 | LBY79 | 0.85 | 3.93E−03 | 9 | 50 |
| LBY79 | 0.74 | 5.96E−02 | 9 | 22 | LBY79 | 0.81 | 8.64E−03 | 9 | 49 |
| LBY79 | 0.86 | 2.92E−03 | 9 | 52 | LBY79 | 0.82 | 3.69E−03 | 12 | 48 |
| LBY79 | 0.95 | 8.70E−04 | 12 | 35 | LBY79 | 0.84 | 2.13E−03 | 12 | 51 |
| LBY79 | 0.82 | 3.91E−03 | 12 | 50 | LBY79 | 0.73 | 1.62E−02 | 12 | 24 |
| LBY79 | 0.78 | 7.51E−03 | 12 | 49 | LBY79 | 0.88 | 1.72E−02 | 12 | 52 |
| LBY80 | 0.75 | 8.69E−03 | 8 | 17 | LBY80 | 0.75 | 2.08E−02 | 4 | 9 |
| LBY80 | 0.85 | 3.88E−03 | 4 | 6 | LBY80 | 0.70 | 3.42E−02 | 4 | 33 |
| LBY80 | 0.74 | 2.33E−02 | 4 | 13 | LBY80 | 0.71 | 3.15E−02 | 4 | 39 |
| LBY80 | 0.77 | 1.56E−02 | 4 | 7 | LBY80 | 0.72 | 1.97E−02 | 3 | 9 |
| LBY80 | 0.89 | 1.16E−03 | 2 | 27 | LBY80 | 0.90 | 9.11E−04 | 2 | 31 |
| LBY80 | 0.84 | 4.99E−03 | 2 | 30 | LBY80 | 0.82 | 2.34E−02 | 5 | 47 |
| LBY80 | 0.77 | 1.56E−02 | 5 | 6 | LBY80 | 0.80 | 9.43E−03 | 5 | 11 |
| LBY80 | 0.77 | 1.55E−02 | 5 | 13 | LBY80 | 0.79 | 1.05E−02 | 5 | 8 |
| LBY80 | 0.81 | 2.78E−02 | 5 | 45 | LBY80 | 0.73 | 6.24E−02 | 5 | 20 |
| LBY80 | 0.76 | 1.70E−02 | 5 | 7 | LBY80 | 0.71 | 2.17E−02 | 11 | 9 |
| LBY80 | 0.79 | 7.12E−03 | 11 | 6 | LBY80 | 0.72 | 1.84E−02 | 11 | 13 |
| LBY80 | 0.73 | 4.14E−02 | 11 | 20 | LBY80 | 0.82 | 3.91E−03 | 1 | 9 |
| LBY80 | 0.84 | 2.50E−03 | 1 | 6 | LBY80 | 0.80 | 5.06E−03 | 1 | 13 |
| LBY80 | 0.76 | 1.79E−02 | 9 | 9 | LBY80 | 0.78 | 3.87E−02 | 9 | 47 |
| LBY80 | 0.79 | 1.09E−02 | 9 | 6 | LBY80 | 0.74 | 2.18E−02 | 9 | 11 |
| LBY80 | 0.82 | 6.85E−03 | 9 | 13 | LBY80 | 0.74 | 2.21E−02 | 9 | 8 |
| LBY80 | 0.84 | 1.75E−02 | 9 | 45 | LBY80 | 0.72 | 6.77E−02 | 9 | 20 |
| LBY80 | 0.78 | 7.68E−03 | 12 | 9 | LBY80 | 0.81 | 4.58E−03 | 12 | 6 |
| LBY80 | 0.72 | 1.98E−02 | 12 | 13 | LBY81 | 0.72 | 1.07E−01 | 8 | 17 |
| LBY81 | 0.70 | 2.33E−02 | 3 | 30 | LBY81 | 0.81 | 4.41E−03 | 3 | 12 |
| LBY81 | 0.78 | 1.39E−02 | 5 | 24 | LBY81 | 0.79 | 6.81E−03 | 11 | 9 |
| LBY81 | 0.80 | 1.67E−02 | 11 | 23 | LBY81 | 0.75 | 3.18E−02 | 11 | 47 |
| LBY81 | 0.81 | 4.56E−03 | 11 | 6 | LBY81 | 0.78 | 7.36E−03 | 11 | 11 |
| LBY81 | 0.87 | 1.21E−03 | 11 | 13 | LBY81 | 0.74 | 1.47E−02 | 11 | 8 |
| LBY81 | 0.89 | 3.27E−03 | 11 | 20 | LBY81 | 0.77 | 2.59E−02 | 11 | 21 |
| LBY81 | 0.75 | 2.00E−02 | 1 | 47 | LBY81 | 0.78 | 7.48E−03 | 1 | 11 |
| LBY81 | 0.78 | 7.95E−03 | 1 | 13 | LBY81 | 0.83 | 3.05E−03 | 1 | 8 |
| LBY81 | 0.76 | 1.71E−02 | 1 | 20 | LBY81 | 0.75 | 1.32E−02 | 12 | 50 |
| LBY81 | 0.73 | 3.99E−02 | 12 | 22 | LBY81 | 0.76 | 1.06E−02 | 12 | 49 |
| LBY81 | 0.82 | 6.75E−03 | 12 | 52 | LBY81 | 0.87 | 2.27E−02 | 8 | 6 |
| LBY82 | 0.72 | 1.06E−01 | 8 | 3 | LBY82 | 0.74 | 5.98E−02 | 4 | 47 |
| LBY82 | 0.73 | 6.22E−02 | 4 | 45 | LBY82 | 0.81 | 4.92E−03 | 3 | 1 |
| LBY82 | 0.74 | 2.40E−02 | 3 | 44 | LBY82 | 0.73 | 1.65E−02 | 3 | 16 |
| LBY82 | 0.78 | 1.36E−02 | 3 | 45 | LBY82 | 0.72 | 2.01E−02 | 3 | 5 |
| LBY82 | 0.72 | 2.80E−02 | 5 | 11 | LBY82 | 0.70 | 7.92E−02 | 5 | 46 |
| LBY82 | 0.74 | 2.16E−02 | 5 | 12 | LBY82 | 0.78 | 1.27E−02 | 11 | 52 |
| LBY82 | 0.72 | 7.03E−02 | 9 | 46 | LBY82 | 0.81 | 4.63E−03 | 12 | 9 |
| LBY82 | 0.80 | 1.83E−02 | 12 | 23 | LBY82 | 0.94 | 5.54E−05 | 12 | 6 |
| LBY82 | 0.70 | 2.38E−02 | 12 | 11 | LBY82 | 0.86 | 1.45E−03 | 12 | 13 |
| LBY82 | 0.73 | 4.12E−02 | 12 | 22 | LBY82 | 0.88 | 3.58E−03 | 12 | 20 |
| LBY82 | 0.80 | 5.94E−03 | 12 | 7 | LBY82 | 0.75 | 3.30E−02 | 12 | 21 |
| LBY83 | 0.83 | 3.11E−03 | 3 | 16 | LBY83 | 0.76 | 4.79E−02 | 3 | 35 |
| LBY83 | 0.75 | 5.36E−02 | 5 | 47 | LBY83 | 0.77 | 9.07E−03 | 11 | 43 |
| LBY83 | 0.90 | 4.49E−04 | 11 | 10 | LBY83 | 0.72 | 1.83E−02 | 11 | 42 |
| LBY84 | 0.73 | 9.91E−02 | 8 | 4 | LBY84 | 0.82 | 3.70E−03 | 3 | 43 |
| LBY84 | 0.76 | 1.04E−02 | 3 | 14 | LBY84 | 0.70 | 2.31E−02 | 3 | 10 |
| LBY84 | 0.82 | 3.68E−03 | 3 | 42 | LBY84 | 0.73 | 2.61E−02 | 5 | 10 |

TABLE 201-continued

Correlation between the expression level of selected genes of some embodiments of the invention in various tissues and the phenotypic performance under normal conditions across Foxtail millet varieties (set 1)

| Gene Name | R | P value | Exp. set | Corr. Set ID | Gene Name | R | P value | Exp. set | Corr. Set ID |
|---|---|---|---|---|---|---|---|---|---|
| LBY84 | 0.86 | 1.25E−02 | 5 | 46 | LBY84 | 0.73 | 6.06E−02 | 11 | 35 |
| LBY84 | 0.84 | 4.39E−03 | 1 | 44 | LBY84 | 0.70 | 3.52E−02 | 1 | 23 |
| LBY84 | 0.82 | 7.04E−03 | 1 | 47 | LBY84 | 0.71 | 2.21E−02 | 1 | 11 |
| LBY84 | 0.83 | 5.49E−03 | 1 | 45 | LBY84 | 0.72 | 2.89E−02 | 12 | 52 |
| LBY85 | 0.90 | 1.02E−03 | 2 | 14 | LBY85 | 0.73 | 2.71E−02 | 2 | 30 |
| LBY85 | 0.77 | 4.26E−02 | 5 | 23 | LBY85 | 0.81 | 2.86E−02 | 5 | 47 |
| LBY85 | 0.72 | 2.86E−02 | 5 | 51 | LBY85 | 0.80 | 9.11E−03 | 5 | 24 |
| LBY85 | 0.73 | 6.43E−02 | 5 | 20 | LBY85 | 0.70 | 2.34E−02 | 11 | 50 |
| LBY85 | 0.77 | 8.66E−03 | 11 | 24 | LBY85 | 0.70 | 5.13E−02 | 11 | 22 |
| LBY85 | 0.75 | 1.18E−02 | 1 | 48 | LBY85 | 0.75 | 1.18E−02 | 1 | 50 |
| LBY85 | 0.79 | 6.18E−03 | 1 | 24 | LBY85 | 0.80 | 1.02E−02 | 1 | 22 |
| LBY85 | 0.87 | 1.09E−03 | 1 | 49 | LBY85 | 0.83 | 5.34E−03 | 1 | 52 |
| LBY85 | 0.84 | 1.80E−02 | 9 | 44 | LBY85 | 0.78 | 3.95E−02 | 9 | 23 |
| LBY85 | 0.88 | 8.24E−03 | 9 | 47 | LBY85 | 0.71 | 3.33E−02 | 9 | 50 |
| LBY85 | 0.82 | 2.25E−02 | 9 | 45 | LBY85 | 0.85 | 1.55E−02 | 9 | 20 |
| LBY85 | 0.78 | 1.39E−02 | 9 | 52 | LBY85 | 0.88 | 7.82E−04 | 12 | 48 |
| LBY85 | 0.85 | 1.87E−03 | 12 | 51 | LBY85 | 0.93 | 1.17E−04 | 12 | 50 |
| LBY85 | 0.80 | 5.42E−03 | 12 | 24 | LBY85 | 0.86 | 6.59E−03 | 12 | 22 |
| LBY85 | 0.92 | 1.73E−04 | 12 | 49 | LBY85 | 0.95 | 8.82E−05 | 12 | 52 |
| LBY86 | 0.73 | 9.84E−02 | 8 | 1 | LBY86 | 0.77 | 7.44E−02 | 8 | 4 |
| LBY86 | 0.92 | 1.02E−02 | 8 | 3 | LBY86 | 0.87 | 2.48E−02 | 8 | 2 |
| LBY86 | 0.71 | 1.11E−01 | 8 | 39 | LBY86 | 0.73 | 1.00E−01 | 8 | 7 |
| LBY86 | 0.91 | 6.76E−04 | 3 | 52 | LBY86 | 0.79 | 1.86E−02 | 2 | 52 |
| LBY86 | 0.90 | 8.00E−04 | 5 | 43 | LBY86 | 0.93 | 2.79E−04 | 5 | 10 |
| LBY86 | 0.71 | 3.29E−02 | 5 | 3 | LBY86 | 0.87 | 2.16E−03 | 5 | 42 |
| LBY86 | 0.76 | 1.12E−02 | 11 | 27 | LBY86 | 0.76 | 1.13E−02 | 11 | 31 |
| LBY86 | 0.74 | 1.42E−02 | 11 | 30 | LBY86 | 0.80 | 5.80E−03 | 1 | 48 |
| LBY86 | 0.83 | 3.11E−03 | 1 | 50 | LBY86 | 0.88 | 7.92E−04 | 1 | 24 |
| LBY86 | 0.89 | 1.37E−03 | 1 | 22 | LBY86 | 0.86 | 1.33E−03 | 1 | 49 |
| LBY86 | 0.82 | 7.34E−03 | 1 | 52 | LBY87 | 0.71 | 1.10E−01 | 8 | 6 |
| LBY87 | 0.70 | 3.44E−02 | 4 | 17 | LBY87 | 0.75 | 2.09E−02 | 4 | 52 |
| LBY87 | 0.73 | 1.62E−02 | 3 | 27 | LBY87 | 0.74 | 1.54E−02 | 3 | 31 |
| LBY87 | 0.77 | 9.18E−03 | 3 | 30 | LBY87 | 0.92 | 1.50E−04 | 11 | 48 |
| LBY87 | 0.74 | 5.62E−02 | 11 | 35 | LBY87 | 0.90 | 3.73E−04 | 11 | 51 |
| LBY87 | 0.93 | 1.01E−04 | 11 | 50 | LBY87 | 0.83 | 3.00E−03 | 11 | 24 |
| LBY87 | 0.89 | 3.38E−03 | 11 | 22 | LBY87 | 0.96 | 8.57E−06 | 11 | 49 |
| LBY87 | 0.95 | 8.94E−05 | 11 | 52 | LBY87 | 0.70 | 2.41E−02 | 12 | 9 |
| LBY87 | 0.80 | 5.26E−03 | 12 | 33 | LBY87 | 0.71 | 2.06E−02 | 12 | 13 |
| LBY88 | 0.98 | 3.85E−04 | 8 | 8 | LBY88 | 0.79 | 6.65E−03 | 3 | 51 |
| LBY88 | 0.74 | 5.73E−02 | 2 | 23 | LBY88 | 0.72 | 6.89E−02 | 2 | 21 |
| LBY88 | 0.86 | 3.30E−03 | 5 | 24 | LBY88 | 0.73 | 1.58E−02 | 1 | 24 |
| LBY88 | 0.79 | 1.05E−02 | 1 | 22 | LBY88 | 0.72 | 2.98E−02 | 9 | 48 |
| LBY88 | 0.73 | 2.42E−02 | 9 | 50 | LBY88 | 0.86 | 1.30E−02 | 9 | 22 |
| LBY88 | 0.70 | 3.47E−02 | 9 | 49 | LBY88 | 0.79 | 1.13E−02 | 9 | 52 |
| LBY88 | 0.77 | 9.62E−03 | 12 | 48 | LBY88 | 0.73 | 1.55E−02 | 12 | 51 |
| LBY88 | 0.81 | 4.14E−03 | 12 | 50 | LBY88 | 0.74 | 1.46E−02 | 12 | 24 |
| LBY88 | 0.76 | 1.09E−02 | 12 | 49 | LBY88 | 0.86 | 2.89E−03 | 12 | 52 |
| LBY89 | 0.73 | 9.62E−02 | 8 | 8 | LBY89 | 0.72 | 1.09E−01 | 8 | 52 |
| LBY89 | 0.75 | 1.87E−02 | 3 | 44 | LBY89 | 0.71 | 3.07E−02 | 3 | 47 |
| LBY89 | 0.80 | 5.72E−03 | 3 | 16 | LBY89 | 0.82 | 2.43E−02 | 3 | 35 |
| LBY89 | 0.82 | 6.22E−03 | 3 | 45 | LBY89 | 0.80 | 3.19E−02 | 5 | 47 |
| LBY89 | 0.83 | 2.88E−03 | 11 | 10 | LBY89 | 0.71 | 2.02E−02 | 11 | 42 |
| LBY89 | 0.74 | 2.39E−02 | 12 | 52 | LBY90 | 0.75 | 8.86E−02 | 8 | 51 |
| LBY90 | 0.75 | 8.38E−02 | 8 | 50 | LBY90 | 0.70 | 1.19E−01 | 8 | 24 |
| LBY90 | 0.83 | 3.92E−02 | 8 | 49 | LBY90 | 0.90 | 1.44E−02 | 8 | 52 |
| LBY90 | 0.80 | 5.53E−03 | 3 | 48 | LBY90 | 0.74 | 1.44E−02 | 3 | 51 |
| LBY90 | 0.72 | 3.04E−02 | 3 | 22 | LBY90 | 0.74 | 2.23E−02 | 2 | 50 |
| LBY90 | 0.75 | 1.95E−02 | 2 | 24 | LBY90 | 0.87 | 1.16E−02 | 2 | 22 |
| LBY90 | 0.85 | 3.44E−03 | 2 | 49 | LBY90 | 0.77 | 2.52E−02 | 2 | 52 |
| LBY90 | 0.72 | 1.88E−02 | 11 | 48 | LBY90 | 0.74 | 1.42E−02 | 11 | 51 |
| LBY90 | 0.74 | 1.51E−02 | 11 | 50 | LBY90 | 0.76 | 1.00E−02 | 11 | 49 |
| LBY90 | 0.81 | 8.45E−03 | 11 | 52 | LBY90 | 0.72 | 1.77E−02 | 1 | 48 |
| LBY90 | 0.71 | 2.24E−02 | 1 | 50 | LBY90 | 0.79 | 6.17E−03 | 1 | 24 |
| LBY90 | 0.73 | 2.68E−02 | 1 | 22 | LBY90 | 0.82 | 3.49E−03 | 1 | 49 |
| LBY90 | 0.71 | 3.24E−02 | 1 | 52 | LBY90 | 0.75 | 1.21E−02 | 12 | 48 |
| LBY90 | 0.78 | 3.73E−02 | 12 | 35 | LBY90 | 0.83 | 3.17E−03 | 12 | 51 |
| LBY90 | 0.77 | 8.63E−03 | 12 | 50 | LBY90 | 0.75 | 1.28E−02 | 12 | 49 |
| LBY90 | 0.82 | 6.30E−03 | 12 | 52 | LBY90 | 0.71 | 5.04E−02 | 12 | 21 |
| LBY91 | 0.72 | 1.10E−01 | 8 | 48 | LBY91 | 0.81 | 2.84E−02 | 4 | 44 |
| LBY91 | 0.70 | 3.55E−02 | 4 | 48 | LBY91 | 0.72 | 1.09E−01 | 4 | 35 |
| LBY91 | 0.82 | 7.23E−03 | 4 | 51 | LBY91 | 0.88 | 9.41E−03 | 4 | 45 |
| LBY91 | 0.73 | 2.68E−02 | 4 | 52 | LBY91 | 0.72 | 2.95E−02 | 9 | 43 |
| LBY91 | 0.93 | 2.47E−04 | 9 | 10 | LBY91 | 0.91 | 7.70E−04 | 9 | 42 |

TABLE 201-continued

Correlation between the expression level of selected genes of some embodiments of the invention in various tissues and the phenotypic performance under normal conditions across Foxtail millet varieties (set 1)

| Gene Name | R | P value | Exp. set | Corr. Set ID | Gene Name | R | P value | Exp. set | Corr. Set ID |
|---|---|---|---|---|---|---|---|---|---|
| LBY91 | 0.70 | 5.27E−02 | 12 | 22 | LBY91 | 0.75 | 1.32E−02 | 12 | 49 |
| LBY92 | 0.72 | 1.09E−01 | 8 | 8 | LBY92 | 0.76 | 1.80E−02 | 4 | 16 |
| LBY92 | 0.75 | 8.55E−02 | 4 | 35 | LBY92 | 0.82 | 1.23E−02 | 11 | 23 |
| LBY92 | 0.73 | 3.85E−02 | 11 | 47 | LBY92 | 0.88 | 8.74E−04 | 11 | 13 |
| LBY92 | 0.71 | 2.28E−02 | 11 | 8 | LBY92 | 0.91 | 1.46E−03 | 11 | 20 |
| LBY92 | 0.74 | 3.43E−02 | 11 | 21 | LBY92 | 0.80 | 8.92E−03 | 1 | 22 |
| LBY92 | 0.76 | 1.15E−02 | 12 | 50 | LBY92 | 0.72 | 4.37E−02 | 12 | 20 |
| LBY92 | 0.76 | 1.12E−02 | 12 | 49 | LBY92 | 0.92 | 4.14E−04 | 12 | 52 |
| LGN52 | 0.76 | 7.80E−02 | 8 | 14 | LGN52 | 0.71 | 1.12E−01 | 8 | 49 |
| LGN52 | 0.72 | 1.06E−01 | 8 | 52 | LGN52 | 0.71 | 1.15E−01 | 8 | 5 |
| LGN52 | 0.87 | 1.04E−03 | 3 | 43 | LGN52 | 0.75 | 1.32E−02 | 3 | 10 |
| LGN52 | 0.85 | 1.84E−03 | 3 | 42 | LGN52 | 0.97 | 2.18E−05 | 2 | 27 |
| LGN52 | 0.96 | 4.90E−05 | 2 | 31 | LGN52 | 0.74 | 2.27E−02 | 2 | 17 |
| LGN52 | 0.87 | 1.11E−02 | 2 | 46 | LGN52 | 0.93 | 2.74E−03 | 2 | 30 |
| LGN52 | 0.88 | 7.74E−04 | 11 | 10 | LGN52 | 0.79 | 6.14E−03 | 11 | 42 |
| LGN52 | 0.72 | 2.71E−02 | 9 | 52 | LGN52 | 0.84 | 2.11E−03 | 12 | 43 |
| LGN52 | 0.77 | 9.66E−03 | 12 | 14 | LGN52 | 0.82 | 3.33E−03 | 12 | 10 |
| LGN52 | 0.85 | 1.92E−03 | 12 | 4 | LGN52 | 0.70 | 2.28E−02 | 12 | 38 |
| LGN52 | 0.75 | 3.14E−02 | 12 | 46 | LGN52 | 0.73 | 1.74E−02 | 12 | 2 |
| LGN52 | 0.83 | 3.16E−03 | 12 | 42 | LGN60 | 0.87 | 9.92E−03 | 4 | 44 |
| LGN60 | 0.71 | 7.55E−02 | 4 | 23 | LGN60 | 0.90 | 6.09E−03 | 4 | 47 |
| LGN60 | 0.71 | 3.16E−02 | 4 | 11 | LGN60 | 0.74 | 2.32E−02 | 4 | 13 |
| LGN60 | 0.77 | 1.44E−02 | 4 | 8 | LGN60 | 0.96 | 5.57E−04 | 4 | 45 |
| LGN60 | 0.73 | 2.47E−02 | 2 | 48 | LGN60 | 0.71 | 3.33E−02 | 2 | 50 |
| LGN60 | 0.81 | 8.79E−03 | 2 | 24 | LGN60 | 0.89 | 7.27E−03 | 2 | 22 |
| LGN60 | 0.80 | 1.01E−02 | 2 | 49 | LGN60 | 0.76 | 4.87E−02 | 5 | 44 |
| LGN60 | 0.86 | 1.23E−02 | 5 | 23 | LGN60 | 0.85 | 1.50E−02 | 5 | 20 |
| LGN60 | 0.93 | 2.40E−03 | 5 | 21 | LGN60 | 0.81 | 4.19E−03 | 12 | 48 |
| LGN60 | 0.83 | 2.92E−03 | 12 | 51 | LGN60 | 0.87 | 9.49E−04 | 12 | 50 |
| LGN60 | 0.78 | 8.33E−03 | 12 | 24 | LGN60 | 0.78 | 2.11E−02 | 12 | 20 |
| LGN60 | 0.85 | 1.74E−03 | 12 | 49 | LGN60 | 0.92 | 4.26E−04 | 12 | 52 |

Table 201. Provided are the correlations (R) between the genes expression levels in various tissues and the phenotypic performance. "Corr. ID "—correlation set ID according to the correlated parameters specified in Table 191. "Exp. Set"—Expression set specified in Table 189. "R" = Pearson correlation coefficient; "P" = p value

TABLE 202

Correlation between the expression level of selected genes of some embodiments of the invention in various tissues and the phenotypic performance under normal conditions (set 2 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY3 | 0.72 | 4.40E−02 | 3 | 12 | LBY3 | 0.71 | 7.31E−02 | 2 | 7 |
| LBY3 | 0.72 | 6.53E−02 | 2 | 11 | LBY3 | 0.75 | 3.25E−02 | 5 | 2 |
| LBY3 | 0.71 | 4.66E−02 | 5 | 12 | LBY3 | 0.84 | 8.66E−03 | 5 | 8 |
| LBY3 | 0.82 | 1.31E−02 | 5 | 6 | LBY3 | 0.79 | 6.88E−03 | 11 | 5 |
| LBY3 | 0.79 | 6.88E−03 | 11 | 4 | LBY3 | 0.75 | 3.33E−02 | 11 | 11 |
| LBY3 | 0.71 | 4.86E−02 | 1 | 12 | LBY3 | 0.81 | 1.37E−02 | 1 | 13 |
| LBY3 | 0.81 | 1.44E−02 | 1 | 3 | LBY55 | 0.77 | 1.53E−02 | 2 | 5 |
| LBY55 | 0.77 | 1.53E−02 | 2 | 4 | LBY55 | 0.86 | 6.15E−03 | 11 | 8 |
| LBY55 | 0.87 | 5.42E−03 | 11 | 6 | LBY55 | 0.92 | 1.74E−04 | 1 | 5 |
| LBY55 | 0.85 | 7.39E−03 | 1 | 8 | LBY55 | 0.92 | 1.74E−04 | 1 | 4 |
| LBY55 | 0.83 | 1.08E−02 | 1 | 6 | LBY55 | 0.73 | 2.42E−02 | 12 | 8 |
| LBY56 | 0.80 | 1.04E−02 | 4 | 13 | LBY56 | 0.74 | 3.43E−02 | 3 | 13 |
| LBY56 | 0.83 | 1.13E−02 | 1 | 3 | LBY57 | 0.79 | 1.16E−02 | 4 | 7 |
| LBY57 | 0.79 | 1.99E−02 | 5 | 2 | LBY57 | 0.81 | 1.56E−02 | 1 | 7 |
| LBY58 | 0.79 | 1.85E−02 | 9 | 7 | LBY59 | 0.83 | 5.65E−03 | 4 | 3 |
| LBY59 | 0.85 | 3.59E−03 | 2 | 5 | LBY59 | 0.79 | 3.44E−02 | 2 | 8 |
| LBY59 | 0.85 | 3.59E−03 | 2 | 4 | LBY59 | 0.76 | 4.57E−02 | 2 | 6 |
| LBY59 | 0.86 | 5.64E−03 | 5 | 2 | LBY59 | 0.94 | 4.06E−05 | 11 | 5 |
| LBY59 | 0.72 | 4.31E−02 | 11 | 10 | LBY59 | 0.74 | 3.74E−02 | 11 | 8 |
| LBY59 | 0.94 | 4.06E−05 | 11 | 4 | LBY59 | 0.82 | 1.34E−02 | 11 | 11 |
| LBY59 | 0.73 | 3.78E−02 | 1 | 12 | LBY59 | 0.75 | 3.10E−02 | 1 | 13 |
| LBY59 | 0.92 | 1.11E−03 | 9 | 12 | LBY59 | 0.85 | 6.87E−03 | 9 | 13 |
| LBY59 | 0.79 | 1.14E−02 | 12 | 12 | LBY61 | 0.75 | 2.04E−02 | 4 | 12 |
| LBY61 | 0.87 | 2.43E−03 | 4 | 13 | LBY61 | 0.72 | 4.34E−02 | 3 | 3 |
| LBY61 | 0.86 | 1.33E−02 | 2 | 3 | LBY61 | 0.80 | 1.75E−02 | 5 | 7 |
| LBY61 | 0.77 | 2.62E−02 | 5 | 3 | LBY61 | 0.72 | 4.40E−02 | 1 | 2 |
| LBY61 | 0.85 | 7.86E−03 | 9 | 3 | LBY62 | 0.76 | 4.58E−02 | 2 | 7 |

TABLE 202-continued

Correlation between the expression level of selected genes of some embodiments of the invention in various tissues and the phenotypic performance under normal conditions (set 2 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY62 | 0.72 | 6.99E−02 | 2 | 11 | LBY62 | 0.79 | 1.86E−02 | 5 | 3 |
| LBY62 | 0.80 | 9.39E−03 | 9 | 5 | LBY62 | 0.72 | 4.47E−02 | 9 | 8 |
| LBY62 | 0.80 | 9.39E−03 | 9 | 4 | LBY62 | 0.74 | 3.65E−02 | 9 | 11 |
| LBY62 | 0.71 | 3.18E−02 | 12 | 11 | LBY63 | 0.84 | 8.26E−03 | 3 | 9 |
| LBY63 | 0.77 | 2.70E−02 | 3 | 7 | LBY63 | 0.85 | 1.62E−02 | 2 | 7 |
| LBY63 | 0.76 | 4.58E−02 | 2 | 11 | LBY63 | 0.71 | 3.06E−02 | 12 | 7 |
| LBY64 | 0.79 | 1.20E−02 | 4 | 9 | LBY64 | 0.88 | 4.43E−03 | 11 | 12 |
| LBY64 | 0.87 | 4.55E−03 | 11 | 13 | LBY64 | 0.74 | 3.48E−02 | 1 | 12 |
| LBY64 | 0.76 | 2.71E−02 | 1 | 13 | LBY65 | 0.77 | 1.52E−02 | 4 | 9 |
| LBY65 | 0.83 | 1.03E−02 | 3 | 11 | LBY65 | 0.89 | 7.62E−03 | 2 | 9 |
| LBY65 | 0.71 | 4.68E−02 | 5 | 12 | LBY65 | 0.74 | 1.35E−02 | 11 | 5 |
| LBY65 | 0.80 | 1.77E−02 | 11 | 8 | LBY65 | 0.74 | 1.35E−02 | 11 | 4 |
| LBY65 | 0.78 | 2.26E−02 | 11 | 6 | LBY65 | 0.74 | 3.63E−02 | 1 | 12 |
| LBY65 | 0.79 | 2.09E−02 | 1 | 13 | LBY65 | 0.76 | 3.03E−02 | 9 | 2 |
| LBY65 | 0.84 | 4.26E−03 | 12 | 12 | LBY65 | 0.74 | 2.32E−02 | 12 | 6 |
| LBY66 | 0.81 | 1.51E−02 | 3 | 9 | LBY66 | 0.73 | 2.67E−02 | 12 | 9 |
| LBY67 | 0.73 | 1.01E−01 | 8 | 4 | LBY67 | 0.73 | 1.01E−01 | 8 | 5 |
| LBY67 | 0.83 | 2.01E−02 | 2 | 9 | LBY67 | 0.74 | 5.91E−02 | 2 | 7 |
| LBY67 | 0.90 | 5.37E−03 | 2 | 12 | LBY67 | 0.77 | 4.30E−02 | 2 | 13 |
| LBY67 | 0.72 | 4.43E−02 | 11 | 2 | LBY67 | 0.74 | 1.44E−02 | 11 | 5 |
| LBY67 | 0.92 | 1.22E−03 | 11 | 8 | LBY67 | 0.74 | 1.44E−02 | 11 | 4 |
| LBY67 | 0.87 | 4.63E−03 | 11 | 6 | LBY67 | 0.88 | 3.98E−03 | 11 | 11 |
| LBY67 | 0.73 | 3.88E−02 | 9 | 1 | LBY67 | 0.71 | 3.39E−02 | 12 | 8 |
| LBY67 | 0.77 | 1.57E−02 | 12 | 6 | LBY68 | 0.80 | 1.75E−02 | 3 | 12 |
| LBY68 | 0.81 | 1.50E−02 | 3 | 13 | LBY68 | 0.88 | 3.48E−03 | 1 | 3 |
| LBY68 | 0.80 | 1.76E−02 | 9 | 8 | LBY68 | 0.76 | 2.94E−02 | 9 | 6 |
| LBY68 | 0.80 | 1.02E−02 | 12 | 12 | LBY69 | 0.84 | 4.48E−03 | 4 | 7 |
| LBY69 | 0.73 | 2.48E−02 | 4 | 11 | LBY69 | 0.77 | 2.62E−02 | 3 | 11 |
| LBY69 | 0.93 | 2.29E−04 | 2 | 5 | LBY69 | 0.72 | 6.80E−02 | 2 | 7 |
| LBY69 | 0.78 | 4.03E−02 | 2 | 8 | LBY69 | 0.93 | 2.29E−04 | 2 | 4 |
| LBY69 | 0.78 | 3.78E−02 | 2 | 6 | LBY69 | 0.88 | 9.02E−03 | 2 | 11 |
| LBY69 | 0.73 | 3.91E−02 | 5 | 2 | LBY69 | 0.70 | 5.18E−02 | 5 | 7 |
| LBY69 | 0.77 | 2.47E−02 | 5 | 12 | LBY69 | 0.71 | 4.96E−02 | 5 | 13 |
| LBY69 | 0.87 | 1.16E−03 | 11 | 5 | LBY69 | 0.81 | 1.40E−02 | 11 | 8 |
| LBY69 | 0.87 | 1.16E−03 | 11 | 4 | LBY69 | 0.82 | 1.18E−02 | 11 | 6 |
| LBY69 | 0.71 | 2.27E−02 | 1 | 5 | LBY69 | 0.71 | 2.27E−02 | 1 | 4 |
| LBY69 | 0.74 | 2.24E−02 | 9 | 5 | LBY69 | 0.74 | 2.24E−02 | 9 | 4 |
| LBY69 | 0.73 | 2.67E−02 | 12 | 7 | LBY69 | 0.73 | 2.53E−02 | 12 | 8 |
| LBY69 | 0.76 | 1.74E−02 | 12 | 6 | LBY70 | 0.82 | 7.19E−03 | 4 | 9 |
| LBY70 | 0.80 | 3.22E−02 | 2 | 3 | LBY70 | 0.75 | 3.14E−02 | 5 | 7 |
| LBY70 | 0.75 | 3.09E−02 | 5 | 3 | LBY70 | 0.72 | 4.20E−02 | 11 | 7 |
| LBY70 | 0.84 | 9.05E−03 | 1 | 13 | LBY70 | 0.85 | 7.23E−03 | 9 | 3 |
| LBY70 | 0.71 | 3.19E−02 | 12 | 11 | LBY71 | 0.88 | 1.61E−02 | 4 | 9 |
| LBY71 | 0.76 | 4.59E−02 | 2 | 13 | LBY71 | 0.77 | 2.43E−02 | 5 | 2 |
| LBY71 | 0.74 | 3.64E−02 | 5 | 12 | LBY71 | 0.85 | 8.13E−03 | 11 | 1 |
| LBY71 | 0.84 | 8.57E−03 | 11 | 12 | LBY71 | 0.72 | 4.53E−02 | 11 | 13 |
| LBY71 | 0.82 | 1.30E−02 | 1 | 12 | LBY71 | 0.90 | 2.32E−03 | 1 | 13 |
| LBY71 | 0.86 | 5.68E−03 | 9 | 1 | LBY71 | 0.80 | 1.67E−02 | 9 | 2 |
| LBY71 | 0.94 | 5.81E−04 | 9 | 12 | LBY71 | 0.79 | 2.00E−02 | 9 | 13 |
| LBY72 | 0.74 | 2.22E−02 | 4 | 7 | LBY72 | 0.76 | 4.77E−02 | 2 | 1 |
| LBY72 | 0.93 | 2.07E−03 | 2 | 9 | LBY72 | 0.80 | 1.66E−02 | 11 | 1 |
| LBY72 | 0.75 | 3.04E−02 | 1 | 9 | LBY72 | 0.78 | 2.14E−02 | 1 | 2 |
| LBY72 | 0.84 | 8.33E−03 | 1 | 13 | LBY72 | 0.92 | 5.32E−04 | 12 | 7 |
| LBY73 | 0.74 | 2.31E−02 | 4 | 5 | LBY73 | 0.74 | 2.31E−02 | 4 | 4 |
| LBY73 | 0.82 | 7.07E−03 | 4 | 11 | LBY73 | 0.71 | 4.93E−02 | 11 | 10 |
| LBY74 | 0.72 | 4.56E−02 | 3 | 1 | LBY74 | 0.87 | 1.01E−02 | 2 | 11 |
| LBY74 | 0.88 | 3.57E−03 | 11 | 1 | LBY74 | 0.71 | 4.77E−02 | 11 | 12 |
| LBY74 | 0.71 | 4.88E−02 | 1 | 13 | LBY74 | 0.83 | 6.18E−03 | 12 | 1 |
| LBY75 | 0.77 | 1.61E−02 | 4 | 9 | LBY75 | 0.86 | 6.52E−03 | 3 | 7 |
| LBY75 | 0.78 | 2.37E−02 | 3 | 13 | LBY75 | 0.72 | 7.08E−02 | 2 | 9 |
| LBY75 | 0.89 | 7.22E−03 | 2 | 12 | LBY75 | 0.72 | 7.07E−02 | 2 | 8 |
| LBY75 | 0.95 | 9.63E−04 | 2 | 13 | LBY75 | 0.71 | 7.09E−02 | 2 | 6 |
| LBY75 | 0.76 | 2.72E−02 | 5 | 12 | LBY75 | 0.77 | 2.51E−02 | 5 | 13 |
| LBY75 | 0.80 | 1.60E−02 | 11 | 12 | LBY75 | 0.84 | 9.42E−03 | 11 | 13 |
| LBY75 | 0.85 | 8.21E−03 | 1 | 12 | LBY75 | 0.98 | 2.12E−05 | 1 | 13 |
| LBY75 | 0.70 | 5.27E−02 | 9 | 8 | LBY75 | 0.75 | 3.16E−02 | 9 | 6 |
| LBY75 | 0.81 | 7.91E−03 | 12 | 13 | LBY76 | 0.74 | 2.27E−02 | 4 | 1 |
| LBY76 | 0.74 | 2.19E−02 | 4 | 9 | LBY76 | 0.79 | 1.16E−02 | 4 | 13 |
| LBY76 | 0.71 | 4.85E−02 | 3 | 7 | LBY76 | 0.81 | 8.22E−03 | 2 | 5 |
| LBY76 | 0.76 | 4.71E−02 | 2 | 8 | LBY76 | 0.81 | 8.22E−03 | 2 | 4 |
| LBY76 | 0.78 | 3.90E−02 | 2 | 11 | LBY76 | 0.74 | 1.46E−02 | 11 | 5 |
| LBY76 | 0.88 | 4.28E−03 | 11 | 12 | LBY76 | 0.77 | 2.61E−02 | 11 | 8 |
| LBY76 | 0.74 | 1.46E−02 | 11 | 4 | LBY76 | 0.89 | 3.18E−03 | 11 | 13 |

TABLE 202-continued

Correlation between the expression level of selected genes of some embodiments of the invention in various tissues and the phenotypic performance under normal conditions (set 2 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY76 | 0.74 | 3.42E−02 | 11 | 6 | LBY76 | 0.76 | 2.80E−02 | 1 | 2 |
| LBY76 | 0.87 | 1.14E−03 | 1 | 5 | LBY76 | 0.75 | 3.18E−02 | 1 | 8 |
| LBY76 | 0.87 | 1.14E−03 | 1 | 4 | LBY76 | 0.72 | 4.58E−02 | 1 | 6 |
| LBY76 | 0.83 | 3.29E−03 | 12 | 5 | LBY76 | 0.79 | 1.20E−02 | 12 | 8 |
| LBY76 | 0.83 | 3.29E−03 | 12 | 4 | LBY76 | 0.81 | 8.56E−03 | 12 | 6 |
| LBY76 | 0.76 | 1.73E−02 | 12 | 11 | LBY77 | 0.75 | 2.11E−02 | 2 | 5 |
| LBY77 | 0.75 | 5.07E−02 | 2 | 8 | LBY77 | 0.75 | 2.11E−02 | 2 | 4 |
| LBY77 | 0.71 | 7.38E−02 | 2 | 6 | LBY77 | 0.71 | 4.76E−02 | 5 | 1 |
| LBY77 | 0.88 | 3.89E−03 | 5 | 2 | LBY77 | 0.70 | 5.13E−02 | 11 | 1 |
| LBY77 | 0.90 | 2.22E−03 | 11 | 9 | LBY77 | 0.90 | 2.58E−03 | 11 | 12 |
| LBY77 | 0.94 | 5.05E−04 | 11 | 13 | LBY77 | 0.75 | 3.20E−02 | 1 | 1 |
| LBY77 | 0.85 | 7.58E−03 | 1 | 12 | LBY77 | 0.95 | 2.89E−04 | 1 | 13 |
| LBY77 | 0.93 | 7.90E−04 | 9 | 2 | LBY78 | 0.73 | 2.42E−02 | 4 | 7 |
| LBY78 | 0.75 | 3.29E−02 | 3 | 2 | LBY78 | 0.80 | 1.79E−02 | 5 | 2 |
| LBY78 | 0.71 | 5.06E−02 | 5 | 6 | LBY78 | 0.85 | 8.10E−03 | 1 | 3 |
| LBY78 | 0.88 | 4.01E−03 | 9 | 2 | LBY78 | 0.89 | 4.71E−04 | 12 | 5 |
| LBY78 | 0.89 | 4.71E−04 | 12 | 4 | LBY78 | 0.78 | 1.29E−02 | 12 | 11 |
| LBY79 | 0.77 | 1.60E−02 | 4 | 2 | LBY79 | 0.82 | 1.23E−02 | 5 | 1 |
| LBY79 | 0.85 | 8.24E−03 | 11 | 1 | LBY79 | 0.77 | 2.44E−02 | 9 | 1 |
| LBY79 | 0.74 | 3.62E−02 | 9 | 9 | LBY79 | 0.79 | 1.21E−02 | 12 | 1 |
| LBY80 | 0.85 | 3.88E−03 | 4 | 5 | LBY80 | 0.76 | 1.86E−02 | 4 | 8 |
| LBY80 | 0.85 | 3.88E−03 | 4 | 4 | LBY80 | 0.71 | 3.14E−02 | 4 | 6 |
| LBY80 | 0.87 | 5.07E−03 | 3 | 8 | LBY80 | 0.83 | 1.09E−02 | 3 | 6 |
| LBY80 | 0.78 | 2.17E−02 | 3 | 11 | LBY80 | 0.76 | 4.76E−02 | 2 | 7 |
| LBY80 | 0.92 | 3.07E−03 | 2 | 11 | LBY80 | 0.77 | 1.56E−02 | 5 | 5 |
| LBY80 | 0.79 | 2.01E−02 | 5 | 8 | LBY80 | 0.77 | 1.56E−02 | 5 | 4 |
| LBY80 | 0.76 | 2.91E−02 | 5 | 6 | LBY80 | 0.79 | 7.12E−03 | 11 | 5 |
| LBY80 | 0.84 | 8.54E−03 | 11 | 8 | LBY80 | 0.79 | 7.12E−03 | 11 | 4 |
| LBY80 | 0.81 | 1.42E−02 | 11 | 6 | LBY80 | 0.84 | 2.50E−03 | 1 | 5 |
| LBY80 | 0.88 | 3.87E−03 | 1 | 8 | LBY80 | 0.84 | 2.50E−03 | 1 | 4 |
| LBY80 | 0.82 | 1.28E−02 | 1 | 6 | LBY80 | 0.79 | 1.09E−02 | 9 | 5 |
| LBY80 | 0.92 | 1.14E−03 | 9 | 8 | LBY80 | 0.79 | 1.09E−02 | 9 | 4 |
| LBY80 | 0.92 | 1.06E−03 | 9 | 6 | LBY80 | 0.81 | 4.58E−03 | 12 | 5 |
| LBY80 | 0.87 | 2.44E−03 | 12 | 8 | LBY80 | 0.81 | 4.58E−03 | 12 | 4 |
| LBY80 | 0.81 | 8.59E−03 | 12 | 6 | LBY80 | 0.70 | 3.54E−02 | 12 | 11 |
| LBY81 | 0.86 | 6.60E−03 | 3 | 11 | LBY81 | 0.72 | 7.08E−02 | 2 | 8 |
| LBY81 | 0.76 | 4.75E−02 | 2 | 6 | LBY81 | 0.81 | 1.43E−02 | 5 | 2 |
| LBY81 | 0.81 | 4.56E−03 | 11 | 5 | LBY81 | 0.90 | 2.28E−03 | 11 | 8 |
| LBY81 | 0.81 | 4.56E−03 | 11 | 4 | LBY81 | 0.88 | 3.88E−03 | 11 | 6 |
| LBY81 | 0.80 | 1.64E−02 | 1 | 8 | LBY81 | 0.81 | 1.51E−02 | 1 | 6 |
| LBY81 | 0.88 | 3.92E−03 | 9 | 2 | LBY81 | 0.73 | 2.67E−02 | 12 | 6 |
| LBY82 | 0.87 | 2.27E−02 | 8 | 4 | LBY82 | 0.87 | 2.27E−02 | 8 | 5 |
| LBY82 | 0.82 | 6.80E−03 | 4 | 2 | LBY82 | 0.83 | 1.03E−02 | 3 | 2 |
| LBY82 | 0.73 | 3.97E−02 | 5 | 11 | LBY82 | 0.94 | 5.54E−05 | 12 | 5 |
| LBY82 | 0.71 | 3.24E−02 | 12 | 10 | LBY82 | 0.83 | 5.42E−03 | 12 | 8 |
| LBY82 | 0.94 | 5.54E−05 | 12 | 4 | LBY82 | 0.77 | 1.49E−02 | 12 | 6 |
| LBY82 | 0.72 | 2.86E−02 | 12 | 11 | LBY83 | 0.78 | 3.93E−02 | 2 | 3 |
| LBY83 | 0.82 | 1.21E−02 | 1 | 3 | LBY85 | 0.74 | 2.24E−02 | 4 | 9 |
| LBY85 | 0.84 | 8.66E−03 | 3 | 1 | LBY85 | 0.87 | 5.42E−03 | 5 | 2 |
| LBY85 | 0.72 | 4.26E−02 | 5 | 12 | LBY85 | 0.80 | 1.78E−02 | 11 | 2 |
| LBY85 | 0.85 | 6.82E−03 | 1 | 12 | LBY85 | 0.87 | 5.25E−03 | 1 | 13 |
| LBY85 | 0.74 | 3.68E−02 | 9 | 2 | LBY85 | 0.75 | 3.20E−02 | 9 | 12 |
| LBY85 | 0.82 | 1.36E−02 | 9 | 8 | LBY85 | 0.83 | 9.95E−03 | 9 | 6 |
| LBY85 | 0.89 | 1.43E−03 | 12 | 1 | LBY85 | 0.75 | 1.95E−02 | 12 | 12 |
| LBY85 | 0.71 | 3.32E−02 | 12 | 13 | LBY86 | 0.74 | 3.74E−02 | 3 | 3 |
| LBY86 | 0.74 | 5.58E−02 | 2 | 1 | LBY86 | 0.74 | 3.63E−02 | 5 | 7 |
| LBY86 | 0.87 | 5.51E−03 | 5 | 3 | LBY86 | 0.88 | 3.68E−03 | 1 | 12 |
| LBY86 | 0.90 | 2.30E−03 | 1 | 13 | LBY86 | 0.71 | 5.05E−02 | 9 | 7 |
| LBY87 | 0.71 | 1.10E−01 | 8 | 4 | LBY87 | 0.71 | 1.10E−01 | 8 | 5 |
| LBY87 | 0.72 | 2.90E−02 | 4 | 9 | LBY87 | 0.71 | 4.80E−02 | 3 | 7 |
| LBY87 | 0.91 | 1.53E−03 | 11 | 1 | LBY87 | 0.80 | 1.62E−02 | 11 | 12 |
| LBY87 | 0.81 | 1.42E−02 | 11 | 13 | LBY87 | 0.77 | 2.57E−02 | 1 | 3 |
| LBY87 | 0.74 | 2.29E−02 | 12 | 6 | LBY88 | 0.71 | 7.53E−02 | 2 | 9 |
| LBY88 | 0.70 | 7.75E−02 | 2 | 2 | LBY88 | 0.84 | 8.90E−03 | 5 | 12 |
| LBY88 | 0.73 | 4.04E−02 | 5 | 13 | LBY88 | 0.89 | 3.33E−03 | 1 | 12 |
| LBY88 | 0.98 | 2.40E−05 | 1 | 13 | LBY88 | 0.77 | 2.48E−02 | 9 | 12 |
| LBY88 | 0.74 | 2.14E−02 | 12 | 1 | LBY88 | 0.73 | 2.61E−02 | 12 | 12 |
| LBY88 | 0.80 | 9.13E−03 | 12 | 8 | LBY88 | 0.78 | 1.23E−02 | 12 | 6 |
| LBY89 | 0.84 | 4.69E−03 | 4 | 2 | LBY89 | 0.90 | 6.38E−03 | 2 | 3 |
| LBY89 | 0.71 | 4.85E−02 | 5 | 2 | LBY89 | 0.77 | 2.45E−02 | 5 | 8 |
| LBY89 | 0.74 | 3.67E−02 | 5 | 6 | LBY89 | 0.86 | 5.94E−03 | 11 | 7 |
| LBY89 | 0.74 | 2.37E−02 | 12 | 6 | LBY90 | 0.87 | 1.15E−02 | 2 | 12 |
| LBY90 | 0.80 | 2.95E−02 | 2 | 13 | LBY90 | 0.84 | 8.27E−03 | 11 | 1 |

TABLE 202-continued

Correlation between the expression level of selected genes of some embodiments of the invention in various tissues and the phenotypic performance under normal conditions (set 2 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY90 | 0.82 | 1.17E−02 | 1 | 12 | LBY90 | 0.89 | 2.92E−03 | 1 | 13 |
| LBY90 | 0.87 | 2.12E−03 | 12 | 1 | LBY91 | 0.77 | 1.47E−02 | 4 | 1 |
| LBY91 | 0.71 | 3.12E−02 | 4 | 2 | LBY91 | 0.90 | 2.17E−03 | 3 | 8 |
| LBY91 | 0.87 | 4.73E−03 | 3 | 6 | LBY91 | 0.73 | 4.07E−02 | 3 | 11 |
| LBY91 | 0.77 | 2.41E−02 | 9 | 3 | LBY91 | 0.73 | 2.52E−02 | 12 | 12 |
| LBY91 | 0.79 | 1.08E−02 | 12 | 13 | LBY92 | 0.78 | 1.35E−02 | 4 | 2 |
| LBY92 | 0.93 | 9.85E−04 | 11 | 8 | LBY92 | 0.93 | 7.84E−04 | 11 | 6 |
| LBY92 | 0.84 | 9.48E−03 | 1 | 13 | LBY92 | 0.71 | 3.31E−02 | 12 | 12 |
| LGN52 | 0.84 | 8.85E−03 | 3 | 9 | LGN52 | 0.88 | 8.70E−03 | 2 | 7 |
| LGN52 | 0.80 | 3.09E−02 | 2 | 11 | LGN52 | 0.88 | 3.56E−03 | 11 | 7 |
| LGN52 | 0.74 | 2.34E−02 | 12 | 7 | LGN60 | 0.76 | 1.69E−02 | 4 | 8 |
| LGN60 | 0.72 | 2.93E−02 | 4 | 6 | LGN60 | 0.91 | 4.99E−03 | 2 | 12 |
| LGN60 | 0.95 | 1.17E−03 | 2 | 13 | LGN60 | 0.73 | 3.81E−02 | 5 | 13 |
| LGN60 | 0.71 | 4.72E−02 | 11 | 2 | LGN60 | 0.81 | 8.73E−03 | 12 | 1 |
| LGN60 | 0.75 | 2.08E−02 | 12 | 12 | | | | | |

Table 202. Provided are the correlations (R) between the genes expression levels in various tissues and the phenotypic performance. "Corr. ID"—correlation set ID according to the correlated parameters specified in Table 192. "Exp. Set"—Expression set specified in Table 189. "R" = Pearson correlation coefficient; "P" = p value

TABLE 203

Correlation between the expression level of selected genes of some embodiments of the invention in various tissues and the phenotypic performance under low N conditions (set 1 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY3 | 0.83 | 2.89E−03 | 3 | 51 | LBY3 | 0.73 | 6.38E−02 | 3 | 25 |
| LBY3 | 0.71 | 3.09E−02 | 8 | 6 | LBY3 | 0.91 | 4.57E−03 | 8 | 22 |
| LBY3 | 0.82 | 3.76E−03 | 1 | 48 | LBY3 | 0.81 | 4.89E−03 | 1 | 51 |
| LBY3 | 0.81 | 4.48E−03 | 1 | 50 | LBY3 | 0.87 | 1.17E−03 | 1 | 24 |
| LBY3 | 0.86 | 1.45E−03 | 1 | 49 | LBY3 | 0.77 | 8.76E−03 | 1 | 52 |
| LBY3 | 0.79 | 3.29E−02 | 1 | 25 | LBY3 | 0.74 | 3.44E−02 | 4 | 22 |
| LBY3 | 0.93 | 1.25E−04 | 9 | 32 | LBY55 | 0.81 | 4.93E−03 | 3 | 1 |
| LBY55 | 0.73 | 1.59E−02 | 3 | 14 | LBY55 | 0.77 | 9.93E−03 | 3 | 16 |
| LBY55 | 0.71 | 2.10E−02 | 3 | 5 | LBY55 | 0.74 | 9.49E−02 | 8 | 25 |
| LBY55 | 0.72 | 1.90E−02 | 1 | 9 | LBY55 | 0.77 | 1.58E−02 | 1 | 47 |
| LBY55 | 0.71 | 3.17E−02 | 1 | 45 | LBY55 | 0.85 | 3.67E−03 | 1 | 20 |
| LBY55 | 0.70 | 2.33E−02 | 1 | 5 | LBY55 | 0.78 | 7.20E−03 | 9 | 14 |
| LBY55 | 0.75 | 1.27E−02 | 9 | 16 | LBY55 | 0.84 | 5.01E−03 | 9 | 45 |
| LBY55 | 0.76 | 1.02E−02 | 2 | 9 | LBY55 | 0.75 | 1.94E−02 | 2 | 23 |
| LBY55 | 0.73 | 1.57E−02 | 2 | 13 | LBY55 | 0.73 | 2.71E−02 | 2 | 20 |
| LBY55 | 0.71 | 2.03E−02 | 2 | 12 | LBY55 | 0.71 | 3.26E−02 | 2 | 21 |
| LBY56 | 0.76 | 1.03E−02 | 3 | 43 | LBY56 | 0.79 | 6.68E−03 | 3 | 10 |
| LBY57 | 0.71 | 2.05E−02 | 3 | 16 | LBY57 | 0.75 | 1.24E−02 | 1 | 1 |
| LBY57 | 0.74 | 1.37E−02 | 1 | 3 | LBY57 | 0.70 | 2.30E−02 | 1 | 2 |
| LBY57 | 0.77 | 8.86E−03 | 4 | 43 | LBY57 | 0.71 | 2.02E−02 | 4 | 42 |
| LBY57 | 0.77 | 8.55E−03 | 9 | 16 | LBY57 | 0.70 | 3.45E−02 | 9 | 45 |
| LBY57 | 0.71 | 2.16E−02 | 9 | 32 | LBY58 | 0.72 | 1.06E−01 | 8 | 25 |
| LBY58 | 0.85 | 1.98E−03 | 4 | 48 | LBY58 | 0.87 | 1.22E−03 | 4 | 51 |
| LBY58 | 0.78 | 7.21E−03 | 4 | 50 | LBY58 | 0.73 | 1.61E−02 | 4 | 24 |
| LBY58 | 0.71 | 2.12E−02 | 4 | 49 | LBY58 | 0.72 | 1.94E−02 | 4 | 52 |
| LBY59 | 0.75 | 1.21E−02 | 1 | 24 | LBY59 | 0.77 | 1.46E−02 | 1 | 22 |
| LBY59 | 0.74 | 1.51E−02 | 1 | 49 | LBY59 | 0.74 | 5.74E−02 | 1 | 25 |
| LBY59 | 0.77 | 2.64E−02 | 4 | 22 | LBY59 | 0.70 | 2.34E−02 | 9 | 14 |
| LBY59 | 0.83 | 5.55E−03 | 9 | 47 | LBY59 | 0.71 | 2.13E−02 | 9 | 16 |
| LBY59 | 0.82 | 6.21E−03 | 9 | 45 | LBY59 | 0.73 | 1.61E−02 | 9 | 17 |
| LBY59 | 0.75 | 1.98E−02 | 9 | 20 | LBY59 | 0.77 | 9.82E−03 | 2 | 6 |
| LBY59 | 0.85 | 4.03E−03 | 2 | 22 | LBY59 | 0.78 | 7.99E−03 | 2 | 7 |
| LBY61 | 0.73 | 1.69E−02 | 1 | 11 | LBY61 | 0.73 | 2.71E−02 | 1 | 22 |
| LBY61 | 0.73 | 1.57E−02 | 9 | 10 | LBY61 | 0.73 | 2.69E−02 | 9 | 46 |
| LBY62 | 0.75 | 1.31E−02 | 3 | 28 | LBY62 | 0.74 | 1.46E−02 | 2 | 1 |
| LBY62 | 0.73 | 2.47E−02 | 2 | 44 | LBY62 | 0.81 | 8.53E−03 | 2 | 23 |
| LBY62 | 0.93 | 3.13E−04 | 2 | 47 | LBY62 | 0.82 | 3.58E−03 | 2 | 28 |
| LBY62 | 0.90 | 8.36E−04 | 2 | 45 | LBY62 | 0.89 | 1.45E−03 | 2 | 20 |
| LBY62 | 0.74 | 1.43E−02 | 2 | 7 | LBY62 | 0.71 | 3.26E−02 | 2 | 21 |
| LBY63 | 0.82 | 6.91E−03 | 3 | 22 | LBY63 | 0.72 | 1.81E−02 | 1 | 43 |
| LBY63 | 0.73 | 1.75E−02 | 1 | 10 | LBY63 | 0.74 | 1.47E−02 | 1 | 39 |
| LBY63 | 0.96 | 1.60E−05 | 9 | 43 | LBY63 | 0.94 | 5.89E−05 | 9 | 10 |
| LBY63 | 0.92 | 1.59E−04 | 9 | 42 | LBY63 | 0.87 | 1.19E−03 | 2 | 43 |

TABLE 203-continued

Correlation between the expression level of selected genes of some embodiments of the invention in various tissues and the phenotypic performance under low N conditions (set 1 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY63 | 0.93 | 1.10E−04 | 2 | 10 | LBY63 | 0.81 | 4.29E−03 | 2 | 38 |
| LBY63 | 0.83 | 3.11E−03 | 2 | 42 | LBY64 | 0.72 | 1.83E−02 | 3 | 36 |
| LBY64 | 0.72 | 1.94E−02 | 3 | 35 | LBY64 | 0.78 | 7.63E−03 | 3 | 39 |
| LBY64 | 0.73 | 1.77E−02 | 3 | 5 | LBY64 | 0.71 | 3.16E−02 | 8 | 50 |
| LBY64 | 0.76 | 4.64E−02 | 8 | 22 | LBY64 | 0.94 | 4.72E−03 | 8 | 25 |
| LBY64 | 0.71 | 3.23E−02 | 1 | 44 | LBY64 | 0.73 | 2.60E−02 | 1 | 23 |
| LBY64 | 0.79 | 6.08E−03 | 1 | 48 | LBY64 | 0.76 | 1.02E−02 | 1 | 51 |
| LBY64 | 0.73 | 1.59E−02 | 1 | 50 | LBY64 | 0.89 | 4.87E−04 | 1 | 24 |
| LBY64 | 0.74 | 2.33E−02 | 1 | 21 | LBY64 | 0.85 | 1.46E−02 | 1 | 25 |
| LBY64 | 0.70 | 3.55E−02 | 9 | 47 | LBY64 | 0.71 | 3.04E−02 | 9 | 45 |
| LBY65 | 0.77 | 8.96E−03 | 3 | 1 | LBY65 | 0.81 | 7.46E−03 | 3 | 44 |
| LBY65 | 0.72 | 2.75E−02 | 3 | 23 | LBY65 | 0.80 | 1.00E−02 | 3 | 47 |
| LBY65 | 0.77 | 8.73E−03 | 3 | 16 | LBY65 | 0.77 | 1.62E−02 | 3 | 45 |
| LBY65 | 0.72 | 1.81E−02 | 3 | 5 | LBY65 | 0.73 | 2.59E−02 | 8 | 9 |
| LBY65 | 0.74 | 2.19E−02 | 8 | 6 | LBY65 | 0.79 | 1.17E−02 | 8 | 7 |
| LBY65 | 0.70 | 3.42E−02 | 1 | 44 | LBY65 | 0.70 | 3.42E−02 | 1 | 23 |
| LBY65 | 0.88 | 8.53E−04 | 1 | 48 | LBY65 | 0.77 | 8.48E−03 | 1 | 33 |
| LBY65 | 0.76 | 1.01E−02 | 1 | 51 | LBY65 | 0.78 | 7.15E−03 | 1 | 40 |
| LBY65 | 0.86 | 1.43E−03 | 1 | 50 | LBY65 | 0.90 | 4.28E−04 | 1 | 24 |
| LBY65 | 0.70 | 2.32E−02 | 1 | 17 | LBY65 | 0.78 | 7.94E−03 | 1 | 49 |
| LBY65 | 0.80 | 5.26E−03 | 1 | 52 | LBY65 | 0.73 | 2.69E−02 | 1 | 21 |
| LBY65 | 0.86 | 1.41E−02 | 1 | 25 | LBY65 | 0.72 | 2.72E−02 | 9 | 44 |
| LBY65 | 0.78 | 8.19E−03 | 9 | 14 | LBY65 | 0.78 | 1.39E−02 | 9 | 47 |
| LBY65 | 0.84 | 2.58E−03 | 9 | 16 | LBY65 | 0.85 | 3.36E−03 | 9 | 45 |
| LBY65 | 0.84 | 2.56E−03 | 9 | 17 | LBY66 | 0.74 | 1.52E−02 | 9 | 10 |
| LBY66 | 0.80 | 5.20E−03 | 2 | 43 | LBY66 | 0.91 | 2.26E−04 | 2 | 10 |
| LBY66 | 0.84 | 2.13E−03 | 2 | 42 | LBY67 | 0.77 | 9.53E−03 | 3 | 43 |
| LBY67 | 0.84 | 2.29E−03 | 3 | 33 | LBY67 | 0.78 | 7.68E−03 | 3 | 40 |
| LBY67 | 0.78 | 7.45E−03 | 3 | 4 | LBY67 | 0.75 | 1.27E−02 | 3 | 3 |
| LBY67 | 0.84 | 2.25E−03 | 3 | 39 | LBY67 | 0.88 | 9.86E−03 | 8 | 44 |
| LBY67 | 0.93 | 2.68E−03 | 8 | 23 | LBY67 | 0.89 | 6.49E−03 | 8 | 47 |
| LBY67 | 0.76 | 1.64E−02 | 8 | 8 | LBY67 | 0.95 | 1.11E−03 | 8 | 45 |
| LBY67 | 0.95 | 1.22E−03 | 8 | 20 | LBY67 | 0.71 | 3.19E−02 | 8 | 7 |
| LBY67 | 0.93 | 2.83E−03 | 8 | 21 | LBY67 | 0.71 | 4.76E−02 | 4 | 44 |
| LBY67 | 0.79 | 2.05E−02 | 4 | 47 | LBY67 | 0.72 | 1.94E−02 | 4 | 27 |
| LBY67 | 0.72 | 1.91E−02 | 4 | 31 | LBY67 | 0.77 | 2.62E−02 | 4 | 45 |
| LBY67 | 0.71 | 3.15E−02 | 9 | 44 | LBY67 | 0.83 | 2.93E−03 | 9 | 14 |
| LBY67 | 0.76 | 1.64E−02 | 9 | 47 | LBY67 | 0.73 | 1.64E−02 | 9 | 27 |
| LBY67 | 0.80 | 5.54E−03 | 9 | 16 | LBY67 | 0.73 | 1.56E−02 | 9 | 31 |
| LBY67 | 0.90 | 1.05E−03 | 9 | 45 | LBY67 | 0.75 | 1.24E−02 | 9 | 17 |
| LBY67 | 0.72 | 1.91E−02 | 9 | 30 | LBY67 | 0.73 | 1.56E−02 | 2 | 24 |
| LBY67 | 0.74 | 1.49E−02 | 2 | 52 | LBY68 | 0.73 | 1.58E−02 | 3 | 1 |
| LBY68 | 0.75 | 1.23E−02 | 3 | 48 | LBY68 | 0.82 | 6.71E−03 | 8 | 28 |
| LBY68 | 0.71 | 3.04E−02 | 9 | 23 | LBY68 | 0.72 | 2.75E−02 | 9 | 47 |
| LBY68 | 0.77 | 8.75E−03 | 9 | 48 | LBY68 | 0.77 | 8.78E−03 | 9 | 51 |
| LBY68 | 0.75 | 1.19E−02 | 9 | 50 | LBY68 | 0.82 | 3.60E−03 | 9 | 24 |
| LBY68 | 0.77 | 9.09E−03 | 9 | 49 | LBY68 | 0.72 | 1.85E−02 | 9 | 52 |
| LBY68 | 0.70 | 3.40E−02 | 9 | 21 | LBY69 | 0.74 | 1.38E−02 | 3 | 43 |
| LBY69 | 0.71 | 2.24E−02 | 3 | 10 | LBY69 | 0.70 | 2.40E−02 | 3 | 42 |
| LBY69 | 0.78 | 1.31E−02 | 8 | 43 | LBY69 | 0.75 | 2.04E−02 | 8 | 10 |
| LBY69 | 0.78 | 3.72E−02 | 8 | 22 | LBY69 | 0.86 | 3.10E−02 | 8 | 5 |
| LBY69 | 0.80 | 9.24E−03 | 1 | 45 | LBY69 | 0.75 | 1.22E−02 | 1 | 5 |
| LBY69 | 0.87 | 1.13E−03 | 4 | 36 | LBY69 | 0.87 | 1.14E−03 | 4 | 35 |
| LBY69 | 0.75 | 1.17E−02 | 4 | 17 | LBY69 | 0.82 | 3.67E−03 | 9 | 14 |
| LBY69 | 0.75 | 1.98E−02 | 9 | 47 | LBY69 | 0.83 | 3.16E−03 | 9 | 16 |
| LBY69 | 0.88 | 1.92E−03 | 9 | 45 | LBY69 | 0.85 | 1.93E−03 | 9 | 17 |
| LBY70 | 0.73 | 2.46E−02 | 1 | 22 | LBY70 | 0.73 | 1.60E−02 | 4 | 43 |
| LBY70 | 0.72 | 1.84E−02 | 4 | 10 | LBY70 | 0.72 | 1.99E−02 | 4 | 42 |
| LBY70 | 0.80 | 9.47E−03 | 2 | 23 | LBY70 | 0.77 | 9.35E−03 | 2 | 24 |
| LBY70 | 0.74 | 2.30E−02 | 2 | 20 | LBY70 | 0.75 | 1.26E−02 | 2 | 12 |
| LBY70 | 0.78 | 1.30E−02 | 2 | 21 | LBY71 | 0.93 | 1.02E−04 | 3 | 32 |
| LBY71 | 0.92 | 3.36E−03 | 8 | 22 | LBY71 | 0.80 | 1.02E−02 | 1 | 22 |
| LBY71 | 0.74 | 1.37E−02 | 1 | 49 | LBY71 | 0.72 | 1.91E−02 | 9 | 16 |
| LBY71 | 0.72 | 1.79E−02 | 9 | 17 | LBY71 | 0.75 | 2.01E−02 | 2 | 22 |
| LBY72 | 0.73 | 1.56E−02 | 3 | 28 | LBY72 | 0.73 | 2.57E−02 | 1 | 22 |
| LBY72 | 0.74 | 1.53E−02 | 9 | 43 | LBY72 | 0.84 | 2.37E−03 | 9 | 10 |
| LBY72 | 0.78 | 7.44E−03 | 9 | 42 | LBY72 | 0.74 | 1.35E−02 | 2 | 50 |
| LBY72 | 0.77 | 8.87E−03 | 2 | 24 | LBY72 | 0.79 | 6.39E−03 | 2 | 49 |
| LBY72 | 0.82 | 3.75E−03 | 2 | 52 | LBY72 | 0.71 | 7.31E−02 | 2 | 25 |
| LBY73 | 0.86 | 1.43E−03 | 4 | 27 | LBY73 | 0.86 | 1.50E−03 | 4 | 31 |
| LBY73 | 0.72 | 1.97E−02 | 4 | 38 | LBY73 | 0.83 | 1.09E−02 | 4 | 46 |
| LBY73 | 0.80 | 5.04E−03 | 4 | 30 | LBY73 | 0.74 | 2.38E−02 | 9 | 46 |
| LBY73 | 0.71 | 2.16E−02 | 2 | 52 | LBY74 | 0.70 | 2.34E−02 | 3 | 36 |

TABLE 203-continued

Correlation between the expression level of selected genes of some embodiments of the invention in various tissues and the phenotypic performance under low N conditions (set 1 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY74 | 0.70 | 2.36E−02 | 3 | 35 | LBY74 | 0.77 | 9.50E−03 | 3 | 28 |
| LBY74 | 0.71 | 2.14E−02 | 3 | 30 | LBY74 | 0.74 | 2.39E−02 | 8 | 9 |
| LBY74 | 0.89 | 7.55E−03 | 8 | 44 | LBY74 | 0.92 | 3.56E−03 | 8 | 23 |
| LBY74 | 0.84 | 4.50E−03 | 8 | 14 | LBY74 | 0.88 | 9.49E−03 | 8 | 47 |
| LBY74 | 0.73 | 2.52E−02 | 8 | 11 | LBY74 | 0.77 | 1.63E−02 | 8 | 51 |
| LBY74 | 0.82 | 7.40E−03 | 8 | 8 | LBY74 | 0.93 | 2.10E−03 | 8 | 45 |
| LBY74 | 0.95 | 9.01E−04 | 8 | 20 | LBY74 | 0.95 | 1.19E−03 | 8 | 21 |
| LBY74 | 0.74 | 9.13E−02 | 8 | 25 | LBY74 | 0.75 | 1.95E−02 | 9 | 44 |
| LBY74 | 0.83 | 2.78E−03 | 9 | 48 | LBY74 | 0.85 | 1.70E−03 | 9 | 51 |
| LBY74 | 0.80 | 5.29E−03 | 9 | 50 | LBY74 | 0.73 | 1.63E−02 | 9 | 24 |
| LBY74 | 0.79 | 6.81E−03 | 9 | 49 | LBY74 | 0.87 | 1.14E−03 | 9 | 52 |
| LBY74 | 0.73 | 2.71E−02 | 9 | 21 | LBY75 | 0.73 | 1.68E−02 | 3 | 33 |
| LBY75 | 0.73 | 1.56E−02 | 3 | 40 | LBY75 | 0.71 | 3.35E−02 | 8 | 24 |
| LBY75 | 0.75 | 8.74E−02 | 8 | 25 | LBY75 | 0.78 | 7.55E−02 | 1 | 48 |
| LBY75 | 0.80 | 5.96E−03 | 1 | 50 | LBY75 | 0.80 | 5.46E−03 | 1 | 24 |
| LBY75 | 0.77 | 1.49E−02 | 1 | 22 | LBY75 | 0.86 | 1.36E−03 | 1 | 49 |
| LBY75 | 0.75 | 1.19E−02 | 1 | 52 | LBY75 | 0.73 | 6.26E−02 | 1 | 25 |
| LBY75 | 0.75 | 1.22E−02 | 4 | 1 | LBY75 | 0.74 | 3.56E−02 | 4 | 44 |
| LBY75 | 0.73 | 4.11E−02 | 4 | 23 | LBY75 | 0.81 | 1.57E−02 | 4 | 21 |
| LBY75 | 0.71 | 2.02E−02 | 9 | 14 | LBY75 | 0.72 | 1.91E−02 | 9 | 16 |
| LBY75 | 0.74 | 2.18E−02 | 9 | 45 | LBY75 | 0.74 | 1.50E−02 | 9 | 17 |
| LBY75 | 0.81 | 4.11E−03 | 2 | 43 | LBY75 | 0.84 | 2.30E−02 | 2 | 10 |
| LBY75 | 0.73 | 1.64E−02 | 2 | 42 | LBY76 | 0.85 | 1.42E−02 | 8 | 44 |
| LBY76 | 0.77 | 4.48E−02 | 8 | 23 | LBY76 | 0.86 | 1.37E−02 | 8 | 47 |
| LBY76 | 0.81 | 7.68E−03 | 8 | 48 | LBY76 | 0.75 | 2.02E−02 | 8 | 51 |
| LBY76 | 0.73 | 2.47E−02 | 8 | 28 | LBY76 | 0.80 | 9.70E−03 | 8 | 50 |
| LBY76 | 0.76 | 1.71E−02 | 8 | 24 | LBY76 | 0.81 | 2.81E−02 | 8 | 45 |
| LBY76 | 0.74 | 5.95E−02 | 8 | 20 | LBY76 | 0.85 | 3.81E−03 | 8 | 49 |
| LBY76 | 0.74 | 2.17E−02 | 8 | 32 | LBY76 | 0.86 | 3.16E−03 | 8 | 52 |
| LBY76 | 0.76 | 7.77E−02 | 8 | 25 | LBY76 | 0.78 | 7.80E−03 | 1 | 6 |
| LBY76 | 0.78 | 7.17E−03 | 1 | 11 | LBY76 | 0.71 | 2.13E−02 | 1 | 13 |
| LBY76 | 0.77 | 8.91E−03 | 1 | 24 | LBY76 | 0.86 | 1.37E−03 | 1 | 7 |
| LBY76 | 0.71 | 3.22E−02 | 1 | 21 | LBY76 | 0.76 | 4.55E−02 | 1 | 25 |
| LBY76 | 0.79 | 6.17E−03 | 9 | 27 | LBY76 | 0.79 | 6.74E−03 | 9 | 31 |
| LBY76 | 0.7 | 2.98E−02 | 9 | 46 | LBY76 | 0.71 | 2.07E−02 | 9 | 30 |
| LBY76 | 0.71 | 2.09E−02 | 2 | 9 | LBY76 | 0.71 | 2.28E−02 | 2 | 28 |
| LBY77 | 0.83 | 3.05E−03 | 3 | 3 | LBY77 | 0.77 | 8.99E−03 | 3 | 2 |
| LBY77 | 0.94 | 1.72E−03 | 3 | 25 | LBY77 | 0.78 | 1.29E−02 | 8 | 14 |
| LBY77 | 0.76 | 1.73E−02 | 8 | 48 | LBY77 | 0.81 | 8.72E−03 | 8 | 50 |
| LBY77 | 0.73 | 2.52E−02 | 8 | 49 | LBY77 | 0.79 | 6.21E−02 | 8 | 25 |
| LBY77 | 0.79 | 7.10E−03 | 1 | 49 | LBY77 | 0.76 | 4.58E−02 | 1 | 25 |
| LBY77 | 0.74 | 1.41E−02 | 4 | 48 | LBY77 | 0.79 | 6.96E−03 | 4 | 50 |
| LBY77 | 0.75 | 1.24E−02 | 4 | 49 | LBY77 | 0.79 | 6.28E−02 | 4 | 52 |
| LBY77 | 0.86 | 1.29E−02 | 4 | 25 | LBY77 | 0.73 | 6.10E−02 | 9 | 25 |
| LBY77 | 0.83 | 3.22E−03 | 2 | 43 | LBY77 | 0.88 | 7.92E−04 | 2 | 10 |
| LBY77 | 0.75 | 1.28E−02 | 2 | 42 | LBY78 | 0.75 | 1.96E−02 | 8 | 43 |
| LBY78 | 0.79 | 1.12E−02 | 8 | 10 | LBY78 | 0.80 | 1.02E−02 | 8 | 4 |
| LBY78 | 0.71 | 3.08E−02 | 8 | 3 | LBY78 | 0.70 | 7.93E−02 | 8 | 22 |
| LBY78 | 0.74 | 2.26E−02 | 8 | 2 | LBY78 | 0.78 | 1.41E−02 | 8 | 42 |
| LBY78 | 0.70 | 3.54E−02 | 8 | 39 | LBY78 | 0.71 | 3.30E−02 | 8 | 12 |
| LBY78 | 0.73 | 1.55E−02 | 1 | 51 | LBY78 | 0.76 | 1.10E−02 | 1 | 52 |
| LBY78 | 0.71 | 2.21E−02 | 4 | 14 | LBY78 | 0.72 | 1.90E−02 | 2 | 27 |
| LBY78 | 0.71 | 2.10E−02 | 2 | 31 | LBY78 | 0.75 | 1.33E−02 | 2 | 38 |
| LBY79 | 0.72 | 2.00E−02 | 9 | 48 | LBY79 | 0.82 | 3.53E−03 | 9 | 51 |
| LBY79 | 0.72 | 1.85E−02 | 9 | 24 | LBY80 | 0.70 | 3.57E−02 | 8 | 31 |
| LBY80 | 0.80 | 9.50E−03 | 8 | 4 | LBY80 | 0.88 | 1.77E−02 | 8 | 38 |
| LBY80 | 0.71 | 3.37E−02 | 8 | 30 | LBY80 | 0.76 | 1.84E−02 | 8 | 39 |
| LBY80 | 0.81 | 4.73E−03 | 1 | 28 | LBY80 | 0.73 | 4.17E−02 | 4 | 47 |
| LBY80 | 0.76 | 1.01E−02 | 4 | 36 | LBY80 | 0.76 | 1.06E−02 | 4 | 35 |
| LBY80 | 0.80 | 1.61E−02 | 4 | 45 | LBY80 | 0.79 | 2.07E−02 | 4 | 20 |
| LBY80 | 0.79 | 1.14E−02 | 9 | 47 | LBY80 | 0.73 | 1.72E−02 | 9 | 28 |
| LBY80 | 0.70 | 3.53E−02 | 9 | 45 | LBY80 | 0.74 | 2.32E−02 | 9 | 20 |
| LBY80 | 0.73 | 1.62E−02 | 2 | 27 | LBY80 | 0.74 | 1.41E−02 | 2 | 31 |
| LBY80 | 0.71 | 2.21E−02 | 2 | 38 | LBY81 | 0.74 | 1.44E−02 | 3 | 1 |
| LBY81 | 0.85 | 1.99E−03 | 3 | 3 | LBY81 | 0.79 | 6.20E−03 | 3 | 2 |
| LBY81 | 0.71 | 1.82E−02 | 3 | 5 | LBY81 | 0.85 | 3.95E−03 | 8 | 1 |
| LBY81 | 0.78 | 1.33E−02 | 8 | 3 | LBY81 | 0.71 | 7.11E−02 | 8 | 45 |
| LBY81 | 0.72 | 6.56E−02 | 8 | 20 | LBY81 | 0.73 | 2.51E−02 | 8 | 2 |
| LBY81 | 0.96 | 5.97E−05 | 8 | 5 | LBY81 | 0.71 | 3.07E−02 | 1 | 44 |
| LBY81 | 0.86 | 1.35E−03 | 1 | 48 | LBY81 | 0.75 | 1.22E−02 | 1 | 51 |
| LBY81 | 0.89 | 6.41E−04 | 1 | 50 | LBY81 | 0.85 | 1.71E−03 | 1 | 24 |
| LBY81 | 0.92 | 1.93E−04 | 1 | 49 | LBY81 | 0.86 | 1.27E−03 | 1 | 52 |
| LBY81 | 0.80 | 9.31E−03 | 1 | 21 | LBY81 | 0.92 | 3.00E−03 | 1 | 25 |

TABLE 203-continued

Correlation between the expression level of selected genes of some embodiments of the invention in various tissues and the phenotypic performance under low N conditions (set 1 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY81 | 0.71 | 4.56E−02 | 4 | 22 | LBY81 | 0.71 | 2.17E−02 | 9 | 14 |
| LBY81 | 0.81 | 8.02E−03 | 9 | 47 | LBY81 | 0.76 | 1.13E−02 | 9 | 51 |
| LBY81 | 0.85 | 3.75E−03 | 9 | 45 | LBY81 | 0.71 | 3.24E−02 | 9 | 20 |
| LBY81 | 0.72 | 2.79E−02 | 2 | 22 | LBY82 | 0.73 | 1.61E−02 | 3 | 16 |
| LBY82 | 0.75 | 1.87E−02 | 8 | 33 | LBY82 | 0.71 | 3.12E−02 | 8 | 39 |
| LBY82 | 0.71 | 1.12E−01 | 8 | 25 | LBY82 | 0.86 | 3.05E−03 | 9 | 44 |
| LBY82 | 0.71 | 3.24E−02 | 9 | 23 | LBY82 | 0.78 | 1.36E−02 | 9 | 21 |
| LBY83 | 0.71 | 2.08E−02 | 3 | 1 | LBY83 | 0.75 | 1.17E−02 | 3 | 16 |
| LBY83 | 0.70 | 2.33E−02 | 3 | 17 | LBY83 | 0.73 | 1.61E−02 | 1 | 13 |
| LBY83 | 0.78 | 7.17E−03 | 1 | 12 | LBY83 | 0.72 | 1.86E−02 | 2 | 32 |
| LBY84 | 0.98 | 5.65E−05 | 8 | 44 | LBY84 | 1.00 | 3.12E−06 | 8 | 23 |
| LBY84 | 0.82 | 6.85E−03 | 8 | 14 | LBY84 | 0.99 | 2.72E−05 | 8 | 47 |
| LBY84 | 0.79 | 1.13E−02 | 8 | 48 | LBY84 | 0.86 | 2.92E−03 | 8 | 51 |
| LBY84 | 0.72 | 2.75E−02 | 8 | 8 | LBY84 | 0.75 | 1.92E−02 | 8 | 50 |
| LBY84 | 0.75 | 1.97E−02 | 8 | 24 | LBY84 | 0.97 | 2.07E−04 | 8 | 45 |
| LBY84 | 0.98 | 1.17E−04 | 8 | 20 | LBY84 | 0.76 | 1.66E−02 | 8 | 49 |
| LBY84 | 0.80 | 9.56E−03 | 8 | 52 | LBY84 | 0.98 | 1.15E−04 | 8 | 21 |
| LBY84 | 0.76 | 8.00E−02 | 8 | 25 | LBY84 | 0.73 | 1.70E−02 | 1 | 1 |
| LBY84 | 0.80 | 9.09E−03 | 1 | 44 | LBY84 | 0.81 | 8.51E−03 | 1 | 23 |
| LBY84 | 0.88 | 8.82E−04 | 1 | 14 | LBY84 | 0.84 | 4.89E−03 | 1 | 47 |
| LBY84 | 0.89 | 1.41E−03 | 1 | 45 | LBY84 | 0.87 | 2.52E−03 | 1 | 20 |
| LBY84 | 0.77 | 1.60E−02 | 1 | 21 | LBY84 | 0.89 | 5.76E−04 | 1 | 5 |
| LBY84 | 0.81 | 4.85E−03 | 9 | 36 | LBY84 | 0.75 | 1.23E−02 | 9 | 27 |
| LBY84 | 0.81 | 4.35E−03 | 9 | 35 | LBY84 | 0.75 | 1.30E−02 | 9 | 31 |
| LBY84 | 0.74 | 1.45E−02 | 9 | 30 | LBY84 | 0.77 | 8.62E−03 | 2 | 12 |
| LBY85 | 0.80 | 4.96E−03 | 3 | 48 | LBY85 | 0.79 | 6.11E−03 | 3 | 50 |
| LBY85 | 0.71 | 2.13E−02 | 3 | 49 | LBY85 | 0.80 | 1.01E−02 | 1 | 22 |
| LBY85 | 0.80 | 5.09E−03 | 1 | 49 | LBY85 | 0.71 | 2.10E−02 | 9 | 48 |
| LBY85 | 0.72 | 1.97E−02 | 9 | 51 | LBY85 | 0.85 | 2.05E−03 | 2 | 43 |
| LBY85 | 0.81 | 4.66E−03 | 2 | 10 | LBY85 | 0.80 | 5.98E−03 | 2 | 42 |
| LBY86 | 0.78 | 1.29E−02 | 8 | 12 | LBY86 | 0.82 | 3.94E−03 | 1 | 48 |
| LBY86 | 0.76 | 1.06E−02 | 1 | 51 | LBY86 | 0.77 | 9.06E−03 | 1 | 50 |
| LBY86 | 0.77 | 8.69E−03 | 1 | 24 | LBY86 | 0.76 | 1.79E−02 | 1 | 22 |
| LBY86 | 0.74 | 1.43E−02 | 1 | 52 | LBY86 | 0.79 | 6.62E−03 | 4 | 14 |
| LBY86 | 0.71 | 3.24E−02 | 2 | 44 | LBY86 | 0.73 | 2.66E−02 | 2 | 23 |
| LBY86 | 0.75 | 1.33E−02 | 2 | 48 | LBY86 | 0.70 | 2.36E−02 | 2 | 51 |
| LBY86 | 0.74 | 1.41E−02 | 2 | 50 | LBY86 | 0.88 | 8.94E−04 | 2 | 24 |
| LBY86 | 0.76 | 1.01E−02 | 2 | 49 | LBY86 | 0.78 | 1.28E−02 | 2 | 21 |
| LBY86 | 0.83 | 2.09E−02 | 2 | 25 | LBY87 | 0.75 | 1.88E−02 | 8 | 9 |
| LBY87 | 0.72 | 2.99E−02 | 8 | 13 | LBY87 | 0.74 | 2.33E−02 | 8 | 12 |
| LBY87 | 0.92 | 9.52E−03 | 8 | 25 | LBY87 | 0.75 | 1.23E−02 | 9 | 48 |
| LBY87 | 0.81 | 4.17E−03 | 9 | 51 | LBY87 | 0.81 | 4.34E−03 | 2 | 48 |
| LBY87 | 0.72 | 1.88E−02 | 2 | 51 | LBY87 | 0.84 | 2.20E−03 | 2 | 50 |
| LBY87 | 0.80 | 5.95E−03 | 2 | 24 | LBY87 | 0.91 | 2.35E−04 | 2 | 49 |
| LBY87 | 0.75 | 1.27E−02 | 2 | 12 | LBY87 | 0.91 | 2.28E−04 | 2 | 52 |
| LBY87 | 0.73 | 6.04E−02 | 2 | 25 | LBY88 | 0.80 | 2.97E−02 | 8 | 22 |
| LBY88 | 0.81 | 4.53E−03 | 1 | 48 | LBY88 | 0.73 | 1.65E−02 | 1 | 51 |
| LBY88 | 0.79 | 6.62E−03 | 1 | 50 | LBY88 | 0.88 | 8.79E−04 | 1 | 24 |
| LBY88 | 0.78 | 1.39E−02 | 1 | 22 | LBY88 | 0.78 | 7.49E−03 | 1 | 49 |
| LBY88 | 0.77 | 4.12E−02 | 1 | 25 | LBY88 | 0.81 | 1.55E−02 | 4 | 22 |
| LBY88 | 0.71 | 2.24E−02 | 9 | 14 | LBY88 | 0.76 | 1.86E−02 | 9 | 47 |
| LBY88 | 0.79 | 6.47E−03 | 9 | 16 | LBY88 | 0.80 | 1.01E−02 | 9 | 45 |
| LBY88 | 0.79 | 6.43E−03 | 9 | 17 | LBY88 | 0.80 | 9.21E−03 | 2 | 22 |
| LBY89 | 0.93 | 8.71E−05 | 3 | 16 | LBY89 | 0.71 | 2.14E−02 | 3 | 35 |
| LBY89 | 0.76 | 1.77E−02 | 3 | 45 | LBY89 | 0.87 | 1.11E−03 | 3 | 17 |
| LBY89 | 0.85 | 4.08E−03 | 8 | 43 | LBY89 | 0.73 | 2.69E−02 | 8 | 10 |
| LBY89 | 0.76 | 1.66E−02 | 8 | 42 | LBY89 | 0.78 | 1.39E−02 | 8 | 39 |
| LBY89 | 0.75 | 1.25E−02 | 4 | 11 | LBY89 | 0.72 | 1.87E−02 | 4 | 51 |
| LBY89 | 0.71 | 2.08E−02 | 4 | 8 | LBY89 | 0.70 | 2.34E−02 | 9 | 51 |
| LBY90 | 0.88 | 9.52E−03 | 8 | 44 | LBY90 | 0.91 | 1.85E−03 | 8 | 23 |
| LBY90 | 0.88 | 8.72E−03 | 8 | 47 | LBY90 | 0.89 | 1.44E−03 | 8 | 48 |
| LBY90 | 0.88 | 1.69E−03 | 8 | 51 | LBY90 | 0.89 | 1.14E−03 | 8 | 50 |
| LBY90 | 0.81 | 8.21E−03 | 8 | 24 | LBY90 | 0.92 | 3.33E−03 | 8 | 45 |
| LBY90 | 0.95 | 9.06E−04 | 8 | 20 | LBY90 | 0.93 | 3.19E−04 | 8 | 49 |
| LBY90 | 0.94 | 1.54E−04 | 8 | 52 | LBY90 | 0.96 | 4.86E−04 | 8 | 21 |
| LBY90 | 0.76 | 8.17E−02 | 8 | 25 | LBY90 | 0.72 | 1.80E−02 | 1 | 48 |
| LBY90 | 0.76 | 1.14E−02 | 1 | 50 | LBY90 | 0.77 | 9.07E−03 | 1 | 24 |
| LBY90 | 0.83 | 5.22E−03 | 1 | 22 | LBY90 | 0.83 | 3.12E−03 | 1 | 49 |
| LBY90 | 0.71 | 2.19E−02 | 1 | 52 | LBY90 | 0.74 | 5.78E−02 | 1 | 25 |
| LBY90 | 0.74 | 2.37E−02 | 9 | 23 | LBY90 | 0.93 | 3.04E−04 | 9 | 47 |
| LBY90 | 0.78 | 8.23E−03 | 9 | 48 | LBY90 | 0.79 | 6.01E−03 | 9 | 51 |
| LBY90 | 0.73 | 1.55E−02 | 9 | 50 | LBY90 | 0.70 | 2.39E−02 | 9 | 24 |
| LBY90 | 0.93 | 2.64E−04 | 9 | 45 | LBY90 | 0.92 | 3.93E−04 | 9 | 20 |

TABLE 203-continued

Correlation between the expression level of selected genes of some embodiments of the invention in various tissues and the phenotypic performance under low N conditions (set 1 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY90 | 0.78 | 7.96E−03 | 9 | 52 | LBY90 | 0.75 | 1.20E−02 | 2 | 24 |
| LBY91 | 0.81 | 8.47E−03 | 8 | 49 | LBY91 | 0.82 | 6.37E−03 | 8 | 52 |
| LBY91 | 0.81 | 4.45E−03 | 4 | 14 | LBY91 | 0.71 | 2.08E−02 | 4 | 51 |
| LBY91 | 0.80 | 1.77E−02 | 4 | 20 | LBY91 | 0.76 | 1.10E−02 | 4 | 52 |
| LBY92 | 0.79 | 3.43E−02 | 8 | 44 | LBY92 | 0.73 | 6.23E−02 | 8 | 47 |
| LBY92 | 0.75 | 1.89E−02 | 8 | 17 | LBY92 | 0.72 | 7.07E−02 | 8 | 20 |
| LBY92 | 0.71 | 6.98E−02 | 8 | 21 | LBY92 | 0.74 | 1.46E−02 | 1 | 9 |
| LBY92 | 0.75 | 2.06E−02 | 1 | 44 | LBY92 | 0.77 | 1.51E−02 | 1 | 23 |
| LBY92 | 0.85 | 1.94E−03 | 1 | 14 | LBY92 | 0.74 | 2.17E−02 | 1 | 47 |
| LBY92 | 0.71 | 2.17E−02 | 1 | 11 | LBY92 | 0.71 | 2.24E−02 | 1 | 13 |
| LBY92 | 0.77 | 8.82E−03 | 1 | 8 | LBY92 | 0.84 | 4.31E−03 | 1 | 45 |
| LBY92 | 0.79 | 1.05E−02 | 1 | 20 | LBY92 | 0.77 | 1.59E−02 | 1 | 21 |
| LGN52 | 0.71 | 3.36E−02 | 3 | 22 | LGN52 | 0.74 | 2.37E−02 | 8 | 42 |
| LGN52 | 0.82 | 3.30E−03 | 4 | 4 | LGN52 | 0.71 | 2.14E−02 | 4 | 2 |
| LGN52 | 0.93 | 8.45E−05 | 9 | 43 | LGN52 | 0.95 | 1.88E−05 | 9 | 10 |
| LGN52 | 0.92 | 1.41E−04 | 9 | 42 | LGN52 | 0.78 | 8.25E−03 | 2 | 43 |
| LGN52 | 0.88 | 8.36E−04 | 2 | 10 | LGN52 | 0.89 | 6.05E−04 | 2 | 38 |
| LGN52 | 0.80 | 5.49E−03 | 2 | 42 | LGN52 | 0.78 | 7.42E−03 | 2 | 39 |
| LGN60 | 0.79 | 1.22E−02 | 3 | 23 | LGN60 | 0.71 | 3.28E−02 | 3 | 20 |
| LGN60 | 0.74 | 2.20E−02 | 3 | 21 | LGN60 | 0.76 | 1.73E−02 | 8 | 51 |
| LGN60 | 0.77 | 1.62E−02 | 9 | 23 | LGN60 | 0.86 | 3.30E−03 | 9 | 47 |
| LGN60 | 0.81 | 4.48E−03 | 9 | 48 | LGN60 | 0.82 | 3.84E−03 | 9 | 51 |
| LGN60 | 0.78 | 7.99E−03 | 9 | 50 | LGN60 | 0.76 | 1.03E−02 | 9 | 24 |
| LGN60 | 0.70 | 3.50E−02 | 9 | 45 | LGN60 | 0.83 | 5.71E−03 | 9 | 20 |
| LGN60 | 0.75 | 1.19E−02 | 9 | 49 | LGN60 | 0.82 | 3.71E−03 | 9 | 52 |
| LGN60 | 0.76 | 9.98E−03 | 2 | 14 | LGN60 | 0.82 | 7.09E−03 | 2 | 47 |
| LGN60 | 0.74 | 1.43E−02 | 2 | 48 | LGN60 | 0.80 | 5.04E−03 | 2 | 51 |
| LGN60 | 0.76 | 1.11E−02 | 2 | 8 | LGN60 | 0.80 | 5.05E−03 | 2 | 50 |
| LGN60 | 0.79 | 1.10E−02 | 2 | 45 | LGN60 | 0.71 | 3.13E−02 | 2 | 20 |
| LGN60 | 0.82 | 3.78E−03 | 2 | 49 | LGN60 | 0.82 | 3.70E−03 | 2 | 52 |

Table 203. Provided are the correlations (R) between the genes expression levels in various tissues and the phenotypic performance. "Corr. ID"—correlation set ID according to the correlated parameters specified in Table 191. "Exp. Set"—Expression set specified in Table 190. "R" = Pearson correlation coefficient; "P" = p value

TABLE 204

Correlation between the expression level of selected genes of some embodiments of the invention in various tissues and the phenotypic performance under low N conditions (set 2 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY3 | 0.71 | 3.09E−02 | 8 | 5 | LBY3 | 0.82 | 1.21E−02 | 8 | 8 |
| LBY3 | 0.81 | 1.41E−02 | 8 | 6 | LBY3 | 0.95 | 1.07E−04 | 1 | 12 |
| LBY3 | 0.84 | 5.04E−02 | 1 | 10 | LBY3 | 0.72 | 2.84E−02 | 1 | 13 |
| LBY56 | 0.84 | 4.77E−03 | 1 | 10 | LBY56 | 0.72 | 1.81E−02 | 4 | 9 |
| LBY58 | 0.75 | 3.04E−02 | 8 | 12 | LBY58 | 0.71 | 4.96E−02 | 8 | 8 |
| LBY58 | 0.74 | 3.48E−02 | 8 | 6 | LBY58 | 0.71 | 3.21E−02 | 9 | 2 |
| LBY58 | 0.74 | 1.50E−02 | 4 | 9 | LBY58 | 0.75 | 1.23E−02 | 4 | 13 |
| LBY59 | 0.71 | 4.99E−02 | 8 | 8 | LBY59 | 0.72 | 4.43E−02 | 8 | 6 |
| LBY59 | 0.93 | 2.52E−04 | 1 | 12 | LBY59 | 0.71 | 3.26E−02 | 1 | 8 |
| LBY59 | 0.72 | 2.81E−02 | 1 | 6 | LBY59 | 0.77 | 9.82E−03 | 2 | 5 |
| LBY59 | 0.83 | 6.17E−03 | 2 | 8 | LBY59 | 0.76 | 1.81E−02 | 2 | 6 |
| LBY61 | 0.70 | 3.52E−02 | 3 | 4 | LBY61 | 0.79 | 1.15E−02 | 3 | 11 |
| LBY61 | 0.71 | 3.27E−02 | 9 | 2 | LBY61 | 0.80 | 9.43E−03 | 1 | 8 |
| LBY61 | 0.82 | 7.19E−03 | 1 | 6 | LBY62 | 0.82 | 1.29E−02 | 8 | 11 |
| LBY62 | 0.80 | 8.90E−03 | 1 | 7 | LBY62 | 0.72 | 2.87E−02 | 2 | 10 |
| LBY62 | 0.89 | 1.49E−03 | 2 | 11 | LBY63 | 0.84 | 4.15E−03 | 3 | 9 |
| LBY63 | 0.85 | 3.85E−03 | 2 | 7 | LBY64 | 0.82 | 1.29E−02 | 8 | 9 |
| LBY64 | 0.85 | 3.53E−03 | 1 | 12 | LBY65 | 0.86 | 3.02E−03 | 3 | 4 |
| LBY65 | 0.86 | 2.93E−03 | 3 | 11 | LBY65 | 0.74 | 2.19E−02 | 8 | 5 |
| LBY65 | 0.75 | 3.24E−02 | 8 | 10 | LBY65 | 0.82 | 1.36E−02 | 8 | 8 |
| LBY65 | 0.78 | 2.35E−02 | 8 | 6 | LBY65 | 0.70 | 3.42E−02 | 1 | 9 |
| LBY65 | 0.79 | 1.13E−02 | 1 | 12 | LBY65 | 0.73 | 2.43E−02 | 1 | 13 |
| LBY65 | 0.70 | 3.55E−02 | 2 | 3 | LBY66 | 0.74 | 2.34E−02 | 9 | 2 |
| LBY66 | 0.74 | 2.16E−02 | 1 | 1 | LBY66 | 0.81 | 7.64E−03 | 2 | 7 |
| LBY67 | 0.72 | 4.48E−02 | 8 | 12 | LBY67 | 0.87 | 2.07E−03 | 9 | 13 |
| LBY67 | 0.90 | 8.08E−04 | 2 | 2 | LBY67 | 0.81 | 8.28E−03 | 2 | 13 |
| LBY68 | 0.72 | 2.93E−02 | 3 | 9 | LBY68 | 0.78 | 1.23E−02 | 9 | 12 |
| LBY68 | 0.80 | 1.02E−02 | 9 | 13 | LBY68 | 0.70 | 3.57E−02 | 1 | 10 |

TABLE 204-continued

Correlation between the expression level of selected genes of some embodiments of the invention in various tissues and the phenotypic performance under low N conditions (set 2 parameters) across Foxtail millet varieties

| Gene Name | R | P value | Exp. set | Corr. Set ID | Gene Name | R | P value | Exp. set | Corr. Set ID |
|---|---|---|---|---|---|---|---|---|---|
| LBY68 | 0.90 | 4.40E−04 | 4 | 2 | LBY69 | 0.73 | 2.57E−02 | 3 | 7 |
| LBY69 | 0.76 | 2.86E−02 | 8 | 7 | LBY69 | 0.83 | 1.16E−02 | 8 | 8 |
| LBY69 | 0.73 | 3.88E−02 | 8 | 6 | LBY69 | 0.73 | 1.69E−02 | 4 | 7 |
| LBY69 | 0.72 | 2.91E−02 | 2 | 7 | LBY70 | 0.77 | 1.61E−02 | 3 | 4 |
| LBY70 | 0.75 | 1.87E−02 | 3 | 11 | LBY70 | 0.76 | 1.73E−02 | 9 | 9 |
| LBY70 | 0.71 | 3.19E−02 | 2 | 12 | LBY70 | 0.73 | 2.45E−02 | 2 | 10 |
| LBY70 | 0.79 | 1.05E−02 | 2 | 13 | LBY71 | 0.97 | 6.55E−05 | 8 | 8 |
| LBY71 | 0.97 | 7.48E−05 | 8 | 6 | LBY71 | 0.90 | 1.10E−03 | 1 | 12 |
| LBY71 | 0.76 | 1.68E−02 | 1 | 8 | LBY71 | 0.78 | 1.28E−02 | 1 | 6 |
| LBY71 | 0.76 | 1.15E−02 | 4 | 2 | LBY71 | 0.84 | 4.55E−03 | 2 | 8 |
| LBY71 | 0.81 | 8.40E−03 | 2 | 6 | LBY72 | 0.75 | 1.17E−02 | 4 | 7 |
| LBY72 | 0.71 | 3.07E−02 | 2 | 12 | LBY72 | 0.84 | 4.96E−03 | 2 | 13 |
| LBY73 | 0.85 | 3.91E−03 | 3 | 11 | LBY73 | 0.74 | 2.33E−02 | 9 | 2 |
| LBY73 | 0.72 | 2.92E−02 | 2 | 13 | LBY74 | 0.85 | 3.61E−03 | 3 | 11 |
| LBY74 | 0.80 | 1.61E−02 | 8 | 9 | LBY74 | 0.75 | 3.38E−02 | 8 | 12 |
| LBY74 | 0.87 | 5.33E−03 | 8 | 13 | LBY74 | 0.72 | 2.93E−02 | 9 | 9 |
| LBY74 | 0.87 | 2.23E−03 | 9 | 13 | LBY74 | 0.76 | 1.07E−02 | 4 | 10 |
| LBY74 | 0.71 | 3.21E−02 | 2 | 2 | LBY75 | 0.81 | 1.45E−02 | 8 | 12 |
| LBY75 | 0.70 | 3.55E−02 | 1 | 1 | LBY75 | 0.97 | 1.22E−05 | 1 | 12 |
| LBY75 | 0.73 | 2.60E−02 | 1 | 8 | LBY75 | 0.75 | 2.08E−02 | 1 | 6 |
| LBY76 | 0.75 | 1.88E−02 | 3 | 11 | LBY76 | 0.77 | 2.52E−02 | 8 | 4 |
| LBY76 | 0.81 | 1.58E−02 | 8 | 13 | LBY76 | 0.78 | 7.80E−03 | 1 | 5 |
| LBY76 | 0.73 | 2.69E−02 | 1 | 12 | LBY76 | 0.75 | 2.00E−02 | 1 | 8 |
| LBY76 | 0.78 | 1.24E−02 | 1 | 6 | LBY77 | 0.85 | 3.56E−03 | 3 | 9 |
| LBY77 | 0.88 | 3.55E−03 | 8 | 9 | LBY77 | 0.81 | 1.57E−02 | 8 | 13 |
| LBY77 | 0.87 | 2.01E−03 | 9 | 9 | LBY77 | 0.86 | 2.64E−03 | 1 | 12 |
| LBY77 | 0.86 | 1.23E−03 | 4 | 9 | LBY77 | 0.71 | 2.12E−02 | 4 | 13 |
| LBY78 | 0.72 | 4.21E−02 | 8 | 7 | LBY78 | 0.77 | 1.47E−02 | 1 | 7 |
| LBY78 | 0.80 | 1.02E−02 | 1 | 13 | LBY78 | 0.80 | 9.29E−03 | 2 | 7 |
| LBY79 | 0.70 | 3.53E−02 | 3 | 1 | LBY79 | 0.71 | 4.80E−02 | 8 | 9 |
| LBY79 | 0.85 | 3.47E−03 | 9 | 13 | LBY80 | 0.70 | 5.21E−02 | 8 | 7 |
| LBY80 | 0.95 | 3.98E−04 | 8 | 4 | LBY80 | 0.88 | 4.33E−03 | 8 | 11 |
| LBY80 | 0.77 | 1.59E−02 | 1 | 11 | LBY80 | 0.74 | 2.21E−02 | 2 | 4 |
| LBY81 | 0.80 | 8.89E−03 | 9 | 13 | LBY81 | 0.93 | 2.26E−04 | 1 | 12 |
| LBY81 | 0.72 | 2.91E−02 | 1 | 13 | LBY81 | 0.79 | 1.05E−02 | 2 | 8 |
| LBY81 | 0.73 | 2.68E−02 | 2 | 6 | LBY82 | 0.78 | 1.23E−02 | 3 | 4 |
| LBY83 | 0.78 | 1.22E−02 | 1 | 10 | LBY84 | 0.70 | 3.41E−02 | 3 | 11 |
| LBY84 | 0.80 | 1.77E−02 | 8 | 12 | LBY84 | 0.85 | 7.91E−03 | 8 | 13 |
| LBY85 | 0.78 | 1.23E−02 | 3 | 9 | LBY85 | 0.79 | 1.17E−02 | 3 | 2 |
| LBY85 | 0.86 | 6.72E−03 | 8 | 2 | LBY85 | 0.84 | 4.30E−03 | 9 | 9 |
| LBY85 | 0.74 | 2.17E−02 | 9 | 13 | LBY85 | 0.92 | 4.75E−04 | 1 | 12 |
| LBY85 | 0.71 | 3.32E−02 | 1 | 8 | LBY85 | 0.73 | 2.57E−02 | 1 | 6 |
| LBY85 | 0.82 | 3.74E−03 | 4 | 2 | LBY85 | 0.72 | 2.95E−02 | 2 | 8 |
| LBY86 | 0.77 | 1.47E−02 | 9 | 9 | LBY86 | 0.81 | 8.12E−03 | 9 | 13 |
| LBY86 | 0.74 | 2.17E−02 | 1 | 9 | LBY86 | 0.79 | 1.21E−02 | 1 | 13 |
| LBY86 | 0.95 | 7.11E−05 | 2 | 12 | LBY87 | 0.70 | 3.48E−02 | 3 | 11 |
| LBY87 | 0.74 | 2.17E−02 | 2 | 12 | LBY87 | 0.86 | 3.03E−03 | 2 | 13 |
| LBY88 | 0.77 | 2.66E−02 | 8 | 12 | LBY88 | 0.92 | 3.90E−04 | 1 | 12 |
| LBY88 | 0.74 | 2.19E−02 | 1 | 8 | LBY88 | 0.76 | 1.64E−02 | 1 | 6 |
| LBY88 | 0.78 | 1.23E−02 | 2 | 8 | LBY88 | 0.77 | 1.56E−02 | 2 | 6 |
| LBY90 | 0.77 | 2.41E−02 | 8 | 9 | LBY90 | 0.74 | 3.65E−02 | 8 | 12 |
| LBY90 | 0.93 | 8.11E−04 | 8 | 13 | LBY90 | 0.70 | 3.40E−02 | 9 | 9 |
| LBY90 | 0.86 | 3.25E−03 | 9 | 13 | LBY90 | 0.96 | 3.50E−05 | 1 | 12 |
| LBY90 | 0.72 | 2.93E−02 | 1 | 8 | LBY90 | 0.75 | 1.99E−02 | 1 | 6 |
| LBY90 | 0.75 | 2.08E−02 | 2 | 13 | LBY91 | 0.71 | 2.19E−02 | 4 | 9 |
| LBY91 | 0.79 | 6.64E−03 | 4 | 13 | LBY92 | 0.73 | 2.43E−02 | 1 | 9 |
| LBY92 | 0.83 | 6.13E−03 | 1 | 13 | LGN52 | 0.79 | 1.21E−02 | 3 | 9 |
| LGN52 | 0.79 | 1.92E−02 | 8 | 7 | LGN52 | 0.74 | 2.21E−02 | 9 | 7 |
| LGN52 | 0.91 | 5.97E−04 | 2 | 7 | LGN60 | 0.71 | 3.22E−02 | 3 | 13 |
| LGN60 | 0.88 | 1.87E−03 | 9 | 13 | LGN60 | 0.83 | 5.65E−03 | 2 | 9 |
| LGN60 | 0.76 | 1.81E−02 | 2 | 13 | | | | | |

Table 204. Provided are the correlations (R) between the genes expression levels in various tissues and the phenotypic performance. "Corr. ID"—correlation set ID according to the correlated parameters specified in Table 192. "Exp. Set"—Expression set specified in Table 190. "R" = Pearson correlation coefficient; "P" = p value.

Example 22

Production of Foxtail Millet Transcriptome and High Throughput Correlation Analysis with Yield Related Parameters Measured in Fields Using 65K Foxtail Millet Oligonucleotide Micro-Arrays In order to produce a high throughput correlation analysis between plant phenotype and gene expression level, the present inventors utilized a Foxtail millet oligonucleotide micro-array, produced by Agilent Technologies [chem. (dot) agilent (dot) com/Scripts/PDS (dot) asp?1Page=50879]. The array oligonucleotide represents about 65,000 Foxtail millet genes and transcripts. In order to define correlations between the levels of RNA expression with yield components or vigor related parameters, various plant characteristics of 51 different Foxtail millet inbreds were analyzed. Among them, 49 inbreds encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

51 Foxtail millet varieties were grown in 4 repetitive plots, in field. Briefly, the growing protocol was as follows:

Regular growth conditions: foxtail millet plants were grown in the field using commercial fertilization and irrigation protocols, which include 202 m$^3$ water per dunam (1000 square meters) per entire growth period and fertilization of 12 units of URAN® 32% (Nitrogen Fertilizer Solution; PCS Sales, Northbrook, Ill., USA) (normal growth conditions).

Analyzed Foxtail millet tissues—49 selected Foxtail millet inbreds were sampled. Tissues [leaf, panicle and peduncle] representing different plant characteristics, from plants growing under normal conditions were sampled and RNA was extracted as described above. Each micro-array expression information tissue type has received a Set ID as summarized in Table 205 below.

TABLE 205

| Foxtail millet transcriptome expression sets in field experiment | |
|---|---|
| Expression Set | Set ID |
| Panicle grown under normal conditions, flowering stage | 1 |
| Leaf grown under normal conditions, seedling stage | 2 |
| Peduncle grown under normal conditions, flowering stage | 3 |

Table 205: Provided are the foxtail transcriptome expression sets. Peduncle = stem below the panicle.

Foxtail millet yield components and vigor related parameters assessment—Plants were phenotyped as shown in Table 206 below. Some of the following parameters were collected using digital imaging system:

1000 grain (seed) weight (gr)—was calculated using Formula XIV above.

1000 grain weight filling rate (gr./day)—was calculated based on Formula XXXVI above.

Average heads dry weight per plant at heading (gr.)—At the process of the growing period heads of 3 plants per plot were collected (heading stage). Heads were weighted after oven dry (dry weight), and the weight was divided by the number of plants.

Average internode length (cm)—Plant heights of 4 plants per plot were measured at harvest and divided by plant number. The average plant height was divided by the average number of nodes.

Average main tiller leaves dry weight per plant at heading (gr.)—At heading stage, main tiller leaves were collected from 3 plants per plot and dried in an oven to obtain the leaves dry weight. The obtained leaves dry weight was divided by the number of plants.

Average seedling dry weight (gr)—At seedling stage, shoot material of 4 plants per plot (without roots) was collected and dried in an oven to obtain the dry weight. The obtained values were divided by the number of plants.

Average shoot dry weight (gr)—During the vegetative growing period, shoot material of 3 plants per plot (without roots) was collected and dried in an oven to obtain the dry weight. The obtained values were divided by the number of plants.

Average total dry matter per plant at harvest (kg)—Average total dry matter per plant was calculated as follows: average head weight per plant at harvest+average vegetative dry weight per plant at harvest.

Average total dry matter per plant at heading (gr)—Average total dry matter per plant was calculated as follows: average head weight per plant at heading+average vegetative dry weight per plant at heading.

Average vegetative dry weight per plant at harvest (kg)—At the end of the growing period all vegetative material (excluding roots and heads) were collected and weighted after oven dry (dry weight). The biomass was then divided by the total number of square meters. To obtain the biomass per plant the biomass per square meter was divided by the number of plants per square meter.

Average vegetative dry weight per plant at heading (gr)—At the heading stage, all vegetative material (excluding roots) were collected and weighted after (dry weight) oven dry. The biomass per plant was calculated by dividing total biomass by the number of plants.

Calculated grains per dunam (number)—Calculated by dividing grains yield per dunam by average grain weight.

Dry matter partitioning (ratio)—Dry matter partitioning was calculated based on Formula XXXV.

Grain area (cm$^2$)—At the end of the growing period the grains were separated from the head. A sample of ~200 grains were weighted, photographed and images were processed using the below described image processing system. The grain area was measured from those images and was divided by the number of grains.

Grain fill duration (num)—Duration of grain filling period was calculated by subtracting the number of days to flowering from the number of days to maturity.

Grain length (cm)—At the end of the growing period the grains were separated from the ear. A sample of ~200 grains were weighted, photographed and images were processed using the below described image processing system. The sum of grain lengths (longest axis) was measured from those images and was divided by the number of grains.

Grain width (cm)—At the end of the growing period the grains were separated from the ear. A sample of ~200 grains were weighted, photographed and images were processed using the below described image processing system. The sum of grain width (longest axis) was measured from those images and was divided by the number of grains.

Grains yield per dunam (kg)—At the end of the growing period heads were collected (harvest stage). Heads were separately threshed and grains were weighted (grain yield).

Grains yield per dunam was calculated by multiplying grain yield per m$^2$ by 1000 (dunam is 1000 m$^2$).

Grains yield per head (gr.)—At the end of the experiment all heads were collected. 6 main heads from 6 plants per plot were separately threshed and grains were weighted. The average grain weight per head was calculated by dividing the total grain weight of the 6 heads by the number of heads.

Grains yield per plant (gr.)—At the end of the experiment all plants were collected. All heads from 6 plants per plot were separately threshed and grains were weighted. The average grain weight per plant was calculated by dividing the total grain weight of the 6 plants by the number of plants.

Harvest index (number)—was calculated based on Formula XV above.

Head area (cm$^2$)—At the end of the growing period 6 main heads from 6 plants per plot were photographed and images were processed using the below described image processing system. The head area was measured from those images and was divided by the number of heads.

Head length (cm)—At the end of the growing period 6 heads from 6 plants per plot were photographed and images were processed using the below described image processing system. The head length (longest axis) was measured from those images and was divided by the number of heads.

Head width (cm)—At the end of the growing period 6 main heads of 6 plants per plot were photographed and images were processed using the below described image processing system. The head width (longest axis) was measured from those images and was divided by the number of heads.

Heads per plant (number)—At the end of the growing period total number of 6 plants heads per plot was counted and divided by the number of plants.

Leaves area per plant at heading (cm$^2$)—Total green leaves area per plant at heading. Leaf area of 3 plants was measured separately using a leaf area-meter. The obtained leaf area was divided by 3 to obtain leaf area per plant.

Leaves dry weight at heading (gr.)—Leaves dry weight was measured at heading stage by collecting all leaves material of 3 plants per plot and weighting it after oven dry (dry weight).

Leaves num at heading (number)—Plants were characterized for leaf number during the heading stage. Plants were measured for their leaf number by separately counting all green leaves of 3 plants per plot.

Leaves temperature_1 (° Celsius)—Leaf temperature was measured using Fluke IR thermometer 568 device. Measurements were done on opened flag leaf.

Lower stem width at heading (mm)—At heading stage lower stem internodes from 3 plants were separated from the plant and their diameter was measured using a caliber.

Main heads dry weight at harvest (gr.)—At the end of the growing period (harvest stage) main heads of 6 plants per plot were collected and weighted after oven dry (dry weight).

Main heads grains number (number)—At the end of the growing period (harvest stage) all plants were collected. Main heads from 6 plants per plot were threshed and grains were counted.

Main heads grains yield (gr.)—At the end of the growing period (harvest stage) all plants were collected. Main heads from 6 plants per plot were threshed and grains were weighted.

Main stem dry weight at harvest (gr.)—At the end of the experiment all plants were collected. Main stems from 6 plants per plot were separated from the rest of the plants, oven dried and weighted to obtain their dry weight.

Nodes number (number)—Nodes number was counted in main culm in 6 plants at heading stage.

Number days to flag leaf senescence (number)—the number of days from sowing till 50% of the plot arrives to flag leaf senescence (above half of the leaves are yellow).

Number days to heading (number)—the number of days from sowing till 50% of the plot arrives to heading.

Number days to tan (number)—the number of days from sowing till 50% of the plot arrives to tan.

Peduncle thickness per plant at heading (mm)—Peduncle thickness was obtained at heading stage by measuring the diameter of main culm just above auricles of flag leaf.

Plant height (cm)—Plants were measured for their height at harvest stage using a measuring tape. Height was measured from ground level to the point below the head.

Plant weight growth (gr./day)—Plant weight growth was calculated based on Formula VII above.

SPAD at grain filling (SPAD unit)—Chlorophyll content was determined using a Minolta SPAD 502 chlorophyll meter and measurement was performed at grain filling stage. SPAD meter readings were done on fully developed leaves of 4 plants per plot by performing three measurements per leaf per plant.

SPAD at vegetative stage (SPAD unit)—Chlorophyll content was determined using a Minolta SPAD 502 chlorophyll meter and measurement was performed at vegetative stage. SPAD meter readings were done on fully developed leaves of 4 plants per plot by performing three measurements per leaf per plant.

Specific leaf area at heading (cm$^2$/gr.)—was calculated according to Formula XXXVII above.

Tillering per plant at heading (number)—Tillers of 3 plants per plot were counted at heading stage and divided by the number of plants.

Vegetative dry weight at flowering/water until flowering (gr./lit)—was calculated according to Formula XXXVIII above.

Vegetative dry weight (kg)—At the end of the growing period all vegetative material (excluding roots and heads) were collected and weighted after oven dry. The weight of plants is per one meter.

Yield filling rate (gr./day)—was calculated according to Formula XXXIX above.

Yield per dunam/water until tan (kg/ml)—was calculated according to Formula XXXX above.

Yield per plant/water until tan (gr/ml)—was calculated according to Formula XXXXI above.

Data parameters collected are summarized in Table 206, herein below.

TABLE 206

Foxtail millet correlated parameters under normal conditions (vectors)

| Correlated parameter with | Correlation ID |
| --- | --- |
| 1000 grain weight [gr.] | 1 |
| 1000 grain weight filling rate [gr./day] | 2 |
| Average Heads DW per plant (HD) [gr.] | 3 |
| Average Seedling DW [gr.] | 4 |
| Average Shoot DW_[gr.] | 5 |
| Average Total dry matter per plant (H) [kg] | 6 |
| Average r Total dry matter per plant (HD) [gr.] | 7 |
| Average Vegetative DW per plant (H) [kg] | 8 |
| Average Vegetative DW per plant (HD) [gr.] | 9 |
| Average internode length [cm] | 10 |
| Average main Stem DW (H) [gr.] | 11 |
| Average main tiller Leaves DW per plant (HD) [gr.] | 12 |
| CV (Grain area) [%] | 13 |

TABLE 206-continued

Foxtail millet correlated parameters under normal conditions (vectors)

| Correlated parameter with | Correlation ID |
|---|---|
| CV (Grain length) [%] | 14 |
| CV (Grain width) [%] | 15 |
| Calculated Grains per dunam [number] | 16 |
| Dry matter partitioning [ratio] | 17 |
| Field Head Width [cm] | 18 |
| Grain area [cm²] | 19 |
| Grain fill duration [days] | 20 |
| Grain length [cm] | 21 |
| Grain width [cm] | 22 |
| Grains Yield per dunam [kg] | 23 |
| Grains Yield per plant [gr.] | 24 |
| Grains yield per Head [gr.] | 25 |
| Harvest index [number] | 26 |
| Head Area [cm²] | 27 |
| Head Width [cm] | 28 |
| Heads per plant [number] | 29 |
| Leaves DW (HD) [gr.] | 30 |
| Leaves area per plant (HD) [cm²] | 31 |
| Leaves num (HD) [number] | 32 |
| Leaves temperature [Celsius] | 33 |
| Lower Stem width (HD) [mm] | 34 |
| Main Heads DW (H) [gr,] | 35 |
| Main heads Grains num [number] | 36 |
| Main heads Grains yield [gr.] | 37 |
| Nodes num [number] | 38 |
| Num days Flag leaf senescence [number] | 39 |
| Num days to Heading [number] | 40 |
| Num days to Tan [number] | 41 |
| Peduncle thickness per plant (HD) [mm] | 42 |
| Plant height [cm] | 43 |
| Plant weight growth [gr./day] | 44 |
| SPAD (GF) [SPAD unit] | 45 |
| SPAD_(veg) [SPAD unit] | 46 |
| Specific leaf area (HD) [cm²/gr.] | 47 |
| Tillering per plant (HD) [num] | 48 |
| VDW (F)/water until heading [gr./lit] | 49 |
| Vegetative DW [kg] | 50 |
| Yield filling rate [gr./day] | 51 |
| Yield per dunam/water until tan [kg/ml] | 52 |
| Yield per plant/water until tan [gr./ml] | 53 |
| Main Stem DW (H) [gr.] | 54 |

Table 206. Provided are the Foxtail millet correlated parameters (vectors). "gr." = grams; "kg" = kilograms; "SPAD" = chlorophyll levels; "DW" = Plant Dry weight; "GF" = grain filling growth stage; "F" = flowering stage; "H" = harvest stage; "hd" = heading growth stage; "Avr"—average; "num"—number; "cm"—centimeter; "veg" = vegetative stage. VDW" = vegetative dry weight; "TDM" = Total dry matter; "lit"—liter; "CV" = coefficient of variation (%).

Experimental Results 51 different Foxtail millet inbreds were grown and characterized for different parameters (Table 206). 49 lines were selected for expression analysis. The average for each of the measured parameter was calculated using the JMP software (Tables 207-211) and a subsequent correlation analysis was performed (Table 212). Results were then integrated to the database.

TABLE 207

Measured parameters in Foxtail millet accessions under normal conditions

| L/Corr. ID | 1 | 2 | 3 | 4 | 5 | 6 | 7 | 8 | 9 |
|---|---|---|---|---|---|---|---|---|---|
| L-1 | 3.208 | 0.134 | 10.147 | 0.511 | 7.660 | 0.130 | 51.761 | 0.064 | 41.614 |
| L-2 | 2.154 | 0.061 | 33.467 | 0.252 | 6.325 | 0.095 | 99.808 | 0.044 | 66.342 |
| L-3 | 2.677 | 0.096 | 7.593 | 0.553 | 7.712 | 0.147 | 56.331 | 0.065 | 48.738 |
| L-4 | 3.932 | 0.109 | 5.847 | 0.730 | 6.713 | 0.140 | 49.564 | 0.068 | 43.718 |
| L-5 | 3.584 | 0.112 | 4.278 | 0.487 | 5.842 | 0.069 | 37.041 | 0.034 | 32.762 |
| L-6 | 3.087 | 0.094 | 10.188 | 0.456 | 7.750 | 0.132 | 56.967 | 0.057 | 46.779 |
| L-7 | 3.103 | 0.069 | 7.784 | 0.478 | 9.359 | 0.117 | 69.368 | 0.066 | 61.584 |
| L-8 | 3.297 | 0.094 | 2.448 | 0.548 | 5.723 | 0.088 | 55.047 | 0.056 | 52.598 |
| L-9 | 2.738 | 0.098 | 6.027 | 0.463 | 6.472 | 0.090 | 41.753 | 0.045 | 35.727 |
| L-10 | 2.775 | 0.099 | 6.747 | 0.361 | 8.378 | 0.083 | 50.306 | 0.043 | 43.559 |
| L-11 | 3.116 | 0.068 | 8.867 | 0.553 | 10.585 | 0.114 | 47.990 | 0.046 | 39.123 |
| L-12 | 3.444 | 0.073 | 6.311 | 0.465 | 5.718 | 0.159 | 52.453 | 0.076 | 46.142 |
| L-13 | 2.914 | 0.050 | 2.819 | 0.559 | 11.420 | 0.075 | 22.454 | 0.038 | 19.635 |
| L-14 | 3.103 | 0.108 | 8.452 | 0.344 | 6.838 | 0.091 | 94.874 | 0.061 | 86.423 |
| L-15 | 3.530 | 0.091 | 3.936 | 0.534 | 7.591 | 0.078 | 35.256 | 0.037 | 31.321 |
| L-16 | 3.576 | 0.069 | 3.200 | 0.597 | 12.147 | 0.093 | 26.559 | 0.050 | 23.359 |
| L-17 | 2.837 | 0.092 | 7.730 | 0.670 | 8.237 | 0.070 | 39.558 | 0.026 | 31.829 |
| L-18 | 3.139 | 0.059 | 2.683 | 0.521 | 7.299 | 0.119 | 25.120 | 0.059 | 22.437 |
| L-19 | 3.255 | 0.128 | 6.551 | 0.347 | 6.683 | 0.095 | 33.126 | 0.046 | 26.575 |
| L-20 | 2.751 | 0.098 | 4.975 | 0.346 | 8.865 | 0.118 | 34.057 | 0.067 | 29.082 |
| L-21 | 2.753 | 0.089 | 6.103 | 0.558 | 9.557 | 0.097 | 29.286 | 0.050 | 23.183 |
| L-22 | 2.909 | 0.107 | 4.842 | 0.434 | 8.093 | 0.094 | 31.300 | 0.045 | 26.458 |
| L-23 | 2.358 | 0.076 | 1.658 | 0.269 | 5.851 | 0.054 | 9.614 | 0.026 | 11.161 |
| L-24 | 2.715 | 0.097 | 4.715 | 0.448 | 6.207 | 0.079 | 25.785 | 0.033 | 21.070 |
| L-25 | 4.374 | 0.169 | 7.418 | 0.364 | 5.400 | 0.080 | 30.032 | 0.031 | 22.614 |
| L-26 | 3.464 | 0.123 | 9.505 | 0.442 | 3.918 | 0.080 | 37.617 | 0.029 | 28.113 |
| L-27 | 2.190 | 0.084 | 3.478 | 0.470 | 6.974 | 0.105 | 50.380 | 0.065 | 46.903 |
| L-28 | 3.081 | 0.135 | 6.490 | 0.460 | 4.592 | 0.099 | 53.233 | 0.046 | 46.743 |
| L-29 | 2.250 | 0.091 | 6.998 | 0.317 | 4.893 | 0.107 | 63.263 | 0.056 | 56.265 |
| L-30 | 2.205 | 0.114 | 4.700 | 0.245 | 3.628 | 0.070 | 31.946 | 0.045 | 27.246 |
| L-31 | 4.027 | 0.130 | 2.821 | 0.371 | 5.728 | 0.053 | 15.271 | 0.019 | 12.450 |
| L-32 | 3.141 | 0.081 | 6.290 | 0.589 | 6.377 | 0.093 | 59.825 | 0.048 | 53.535 |
| L-33 | 3.008 | 0.120 | 5.783 | 0.497 | 7.686 | 0.092 | 72.317 | 0.060 | 66.535 |
| L-34 | 3.633 | 0.137 | 6.710 | 0.499 | 6.853 | 0.117 | 50.777 | 0.070 | 44.067 |
| L-35 | NA | NA | 4.130 | 0.307 | 4.770 | 0.097 | 58.229 | 0.071 | 54.099 |
| L-36 | 3.400 | 0.138 | 6.720 | 0.588 | 7.298 | 0.094 | 83.265 | 0.055 | 76.545 |

TABLE 207-continued

Measured parameters in Foxtail millet accessions under normal conditions

| L/Corr. ID | 1 | 2 | 3 | 4 | 5 | 6 | 7 | 8 | 9 |
|---|---|---|---|---|---|---|---|---|---|
| L-37 | 2.582 | 0.098 | 4.713 | 0.516 | 6.683 | 0.068 | 70.256 | 0.044 | 65.543 |
| L-38 | 2.758 | 0.086 | 6.511 | 0.520 | 9.272 | 0.079 | 101.692 | 0.056 | 95.181 |
| L-39 | 3.662 | 0.115 | 8.973 | 0.400 | 8.886 | 0.098 | 73.627 | 0.051 | 64.654 |
| L-40 | 2.869 | 0.098 | 7.036 | 0.440 | 8.166 | 0.065 | 66.610 | 0.044 | 59.574 |
| L-41 | 3.202 | 0.121 | 10.416 | 0.513 | 7.105 | 0.068 | 104.128 | 0.044 | 93.712 |
| L-42 | 2.773 | 0.087 | 6.421 | 0.469 | 7.333 | 0.125 | 90.612 | 0.077 | 84.191 |
| L-43 | 3.644 | 0.074 | 3.959 | 0.516 | 9.263 | 0.176 | 50.238 | 0.093 | 46.279 |
| L-44 | 3.179 | 0.064 | 4.466 | 0.573 | 6.958 | 0.080 | 74.387 | 0.047 | 69.921 |
| L-45 | 2.809 | 0.104 | 1.668 | 0.441 | 5.720 | 0.082 | 22.522 | 0.035 | 20.854 |
| L-46 | 2.729 | 0.097 | 3.372 | 0.521 | 9.980 | 0.069 | 20.338 | 0.035 | 16.967 |
| L-47 | 3.070 | 0.088 | 1.187 | 0.553 | 7.092 | 0.086 | 16.061 | 0.045 | 14.873 |
| L-48 | 2.937 | 0.109 | 7.150 | 0.450 | 5.181 | 0.059 | 33.797 | 0.033 | 26.647 |
| L-49 | 3.180 | 0.091 | 1.593 | 0.443 | 7.718 | 0.104 | 34.323 | 0.056 | 32.730 |

Table 207: Provided are the values of each of the parameters (as described above)measured in Foxtail millet accessions ("L" = Line) under normal conditions. Growth conditions are specified in the experimental procedure section.

TABLE 208

Additional measured parameters in Foxtail millet accessions under normal growth conditions

| L/Corr. ID | 10 | 11 | 12 | 13 | 14 | 15 | 16 | 17 | 18 | 19 | 20 |
|---|---|---|---|---|---|---|---|---|---|---|---|
| L-1 | 12.686 | 10.313 | 2.612 | 6.099 | 5.497 | 3.996 | 1676.9 | 60.631 | 19.032 | 0.0375 | 24.0 |
| L-2 | 10.142 | 6.468 | 1.459 | 7.378 | 5.309 | 5.237 | 944.0 | 64.283 | 19.270 | 0.0219 | 35.3 |
| L-3 | 14.277 | 12.260 | 2.910 | 7.292 | 6.030 | 5.838 | 1495.9 | 102.784 | 20.593 | 0.0252 | 28.0 |
| L-4 | 11.986 | 22.069 | 4.932 | 11.818 | 7.687 | 7.170 | 1952.9 | 79.206 | 29.108 | 0.0310 | 36.0 |
| L-5 | 10.970 | 26.449 | 6.151 | 12.920 | 8.473 | 8.127 | 1051.3 | 52.837 | 29.004 | 0.0296 | 32.0 |
| L-6 | 12.081 | 11.044 | 2.928 | 8.158 | 5.198 | 6.360 | 1471.2 | 97.580 | 26.820 | 0.0281 | 32.8 |
| L-7 | 12.542 | 1.960 | 0.500 | 10.456 | 7.250 | 7.683 | 1132.8 | 41.680 | 12.018 | 0.0271 | 45.0 |
| L-8 | 12.779 | 7.057 | 2.227 | 7.155 | 4.667 | 5.252 | 1232.5 | 29.373 | 11.824 | 0.0273 | 35.5 |
| L-9 | 11.794 | 4.539 | 1.179 | 7.347 | 5.689 | 5.327 | 1097.0 | 60.904 | 10.365 | 0.0266 | 28.0 |
| L-10 | 12.770 | 5.456 | 1.493 | 6.250 | 4.725 | 5.464 | 1224.3 | 54.117 | 12.463 | 0.0271 | 28.0 |
| L-11 | 14.431 | 3.253 | 0.719 | 11.091 | 6.955 | 6.691 | 1342.0 | 113.742 | 17.098 | 0.0257 | 46.0 |
| L-12 | 15.967 | 2.693 | 0.491 | 8.547 | 7.227 | 6.783 | 1095.1 | 129.888 | 11.823 | 0.0303 | 47.0 |
| L-13 | 14.503 | 2.828 | 0.600 | 8.529 | 7.111 | 5.815 | 963.1 | 70.391 | 10.306 | 0.0267 | 58.0 |
| L-14 | 10.829 | 7.429 | 2.678 | 6.738 | 4.610 | 5.097 | 954.9 | 24.402 | 11.778 | 0.0261 | 29.0 |
| L-15 | 11.397 | 2.635 | 0.879 | 7.872 | 6.023 | 5.222 | 1459.9 | 55.647 | 11.313 | 0.0319 | 39.0 |
| L-16 | 12.088 | 2.557 | 0.681 | 10.377 | 8.299 | 6.394 | 1586.6 | 58.556 | 11.380 | 0.0288 | 52.0 |
| L-17 | 11.851 | 2.519 | 0.730 | 11.656 | 8.375 | 7.661 | 1501.1 | 120.670 | 14.759 | 0.0266 | 31.0 |
| L-18 | 17.928 | 2.130 | 0.560 | 10.740 | 6.469 | 7.048 | 1220.2 | 63.720 | 11.093 | 0.0273 | 53.0 |
| L-19 | 12.491 | 29.343 | 5.763 | 12.832 | 7.121 | 7.363 | 928.7 | 95.491 | 36.429 | 0.0263 | 25.5 |
| L-20 | 18.281 | 9.465 | 1.446 | 6.630 | 4.511 | 5.548 | 1363.7 | 53.204 | 14.307 | 0.0260 | 28.0 |
| L-21 | 16.102 | 2.888 | 0.708 | 9.456 | 7.235 | 6.494 | 1013.7 | 69.628 | 10.331 | 0.0271 | 31.0 |
| L-22 | 14.445 | 5.864 | 1.264 | 8.847 | 6.039 | 6.308 | 1308.4 | 71.324 | 13.965 | 0.0309 | 28.0 |
| L-23 | 12.405 | 8.522 | 1.943 | 10.122 | 6.608 | 6.866 | 427.6 | 84.873 | 23.511 | 0.0185 | 31.0 |
| L-24 | 16.231 | 3.538 | 1.139 | 10.357 | 8.790 | 6.070 | 1178.7 | 82.008 | 12.619 | 0.0307 | 28.0 |
| L-25 | 13.090 | 13.257 | 3.074 | 11.382 | 10.248 | 6.698 | 1557.6 | 139.907 | 18.695 | 0.0308 | 25.5 |
| L-26 | 11.367 | 23.084 | 3.792 | 11.089 | 7.902 | 6.239 | 1437.5 | 107.836 | 29.608 | 0.0278 | 28.0 |
| L-27 | 10.137 | 53.191 | 10.500 | 8.302 | 5.860 | 5.570 | 829.7 | 32.839 | 35.452 | 0.0213 | 26.8 |
| L-28 | 10.028 | 35.971 | 11.395 | 9.475 | 7.126 | 6.094 | 1738.0 | 70.807 | 41.648 | 0.0311 | 23.5 |
| L-29 | 11.946 | 24.312 | 6.001 | 9.794 | 8.685 | 6.039 | 1031.5 | 55.269 | 33.265 | 0.0259 | 25.0 |
| L-30 | 13.794 | 27.705 | 4.963 | 10.768 | 10.660 | 6.234 | 512.5 | 26.243 | 24.077 | 0.0219 | 19.5 |
| L-31 | 11.515 | 19.933 | 3.584 | 10.860 | 6.947 | 7.328 | 1152.6 | 131.172 | 37.533 | 0.0316 | 31.0 |
| L-32 | 10.170 | 2.835 | 0.334 | 9.703 | 6.649 | 7.077 | 869.5 | 47.609 | 9.805 | 0.0274 | 39.0 |
| L-33 | 12.299 | 9.160 | 2.562 | 6.851 | 4.151 | 5.376 | 1056.1 | 28.044 | 10.692 | 0.0249 | 25.0 |
| L-34 | 13.188 | 18.293 | 4.159 | 6.499 | 4.080 | 5.029 | 1446.5 | 45.362 | 21.174 | 0.0289 | 26.5 |
| L-35 | 13.397 | 12.865 | 3.533 | 11.012 | 7.230 | 7.830 | NA | 23.629 | 18.504 | 0.0268 | 25.0 |
| L-36 | 12.106 | 7.624 | 2.618 | 5.630 | 3.872 | 5.478 | 1388.6 | 36.807 | 12.702 | 0.0284 | 25.0 |
| L-37 | 11.304 | 11.766 | 3.044 | 8.134 | 5.961 | 5.237 | 728.2 | 26.055 | 14.503 | 0.0252 | 26.5 |
| L-38 | 12.956 | 9.730 | 2.748 | 6.636 | 4.359 | 5.278 | 606.9 | 22.285 | 13.497 | 0.0245 | 32.0 |
| L-39 | 14.395 | 11.080 | 3.336 | 6.835 | 4.235 | 5.355 | 1634.5 | 60.632 | 15.688 | 0.0309 | 32.0 |
| L-40 | 13.946 | 7.363 | 2.500 | 7.240 | 4.473 | 5.792 | 800.2 | 21.278 | 11.303 | 0.0249 | 30.0 |
| L-41 | 16.451 | 8.469 | 2.743 | 6.352 | 4.335 | 5.221 | 821.0 | 29.561 | 15.190 | 0.0272 | 26.5 |
| L-42 | 12.541 | 13.742 | 2.530 | 8.685 | 6.595 | 6.130 | 1207.6 | 40.569 | 16.800 | 0.0265 | 32.0 |
| L-43 | 13.992 | 1.373 | 0.299 | 10.376 | 8.012 | 6.776 | 1487.7 | 92.060 | 9.488 | 0.0304 | 49.0 |
| L-44 | 13.289 | 2.455 | 0.782 | 9.823 | 7.672 | 6.309 | 1281.2 | 42.087 | 11.558 | 0.0318 | 50.0 |
| L-45 | 12.215 | 14.230 | 2.470 | 10.054 | 6.377 | 6.540 | 863.5 | 116.960 | 28.215 | 0.0220 | 27.0 |
| L-46 | 13.746 | 4.615 | 1.008 | 6.990 | 6.278 | 5.642 | 981.7 | 53.445 | 13.281 | 0.0358 | 28.0 |
| L-47 | 12.590 | 2.400 | 0.633 | 11.093 | 8.332 | 6.284 | 1059.8 | 61.182 | 11.226 | 0.0303 | 35.0 |

TABLE 208-continued

Additional measured parameters in Foxtail millet accessions under normal growth conditions

| L/ Corr. ID | 10 | 11 | 12 | 13 | 14 | 15 | 16 | 17 | 18 | 19 | 20 |
|---|---|---|---|---|---|---|---|---|---|---|---|
| L-48 | 16.000 | 21.536 | 3.817 | 7.312 | 5.589 | 4.878 | 655.0 | 55.139 | 22.766 | 0.0242 | 27.0 |
| L-49 | 13.929 | 1.940 | 0.693 | 11.206 | 8.514 | 6.269 | 1229.0 | 66.595 | 10.489 | 0.0271 | 35.0 |

Table 208: Provided are the values of each of the parameters (as described above) measured in Foxtail millet accessions ("L" = Line) under normal conditions. Growth conditions are specified in the experimental procedure section.

TABLE 209

Additional measured parameters in Foxtail millet accessions under normal growth conditions

| L/ Corr. ID | 21 | 22 | 23 | 24 | 25 | 26 | 27 | 28 | 29 | 30 | 31 |
|---|---|---|---|---|---|---|---|---|---|---|---|
| L-1 | 0.2470 | 0.1936 | 523.448 | 52.326 | 6.423 | 0.406 | 45.904 | 1.902 | 7.935 | 7.835 | 465.7 |
| L-2 | 0.2109 | 0.1486 | 436.940 | 35.126 | 3.468 | 0.372 | 40.258 | 2.166 | 10.327 | 4.378 | 193.4 |
| L-3 | 0.2288 | 0.1585 | 560.843 | 61.498 | 7.077 | 0.419 | 35.816 | 2.618 | 8.655 | 8.730 | 543.0 |
| L-4 | 0.2404 | 0.1838 | 491.668 | 51.859 | 10.845 | 0.363 | 55.857 | 2.730 | 4.821 | 14.796 | 726.2 |
| L-5 | 0.2418 | 0.1799 | 296.573 | 23.980 | 15.033 | 0.319 | 39.621 | 2.886 | 1.734 | 18.454 | 742.8 |
| L-6 | 0.2338 | 0.1719 | 478.080 | 59.256 | 8.795 | 0.442 | 57.119 | 2.730 | 6.929 | 8.785 | 522.8 |
| L-7 | 0.2437 | 0.1617 | 357.615 | 31.052 | 0.710 | 0.268 | 11.506 | 1.265 | 45.779 | 1.501 | 82.8 |
| L-8 | 0.2446 | 0.1608 | 373.488 | 24.845 | 2.316 | 0.278 | 23.955 | 1.292 | 11.107 | 6.680 | 321.5 |
| L-9 | 0.2494 | 0.1540 | 403.167 | 35.211 | 1.801 | 0.391 | 19.008 | 1.298 | 19.469 | 3.538 | 221.6 |
| L-10 | 0.2514 | 0.1550 | 440.728 | 31.820 | 2.091 | 0.385 | 22.942 | 1.374 | 15.442 | 4.479 | 301.9 |
| L-11 | 0.2248 | 0.1637 | 423.047 | 50.574 | 1.548 | 0.436 | 14.462 | 1.948 | 44.151 | 2.157 | 177.5 |
| L-12 | 0.2716 | 0.1650 | 318.777 | 57.406 | 0.558 | 0.352 | 12.210 | 1.321 | 100.117 | 1.474 | 105.0 |
| L-13 | 0.2439 | 0.1597 | 330.000 | 28.963 | 1.262 | 0.389 | 13.395 | 1.193 | 33.200 | 1.799 | 163.2 |
| L-14 | 0.2368 | 0.1596 | 306.945 | 21.188 | 2.029 | 0.235 | 24.485 | 1.427 | 10.610 | 8.035 | 431.6 |
| L-15 | 0.2665 | 0.1743 | 412.848 | 29.392 | 0.907 | 0.369 | 15.126 | 1.359 | 32.856 | 2.637 | 177.7 |
| L-16 | 0.2499 | 0.1691 | 444.183 | 35.353 | 0.868 | 0.378 | 15.290 | 1.281 | 40.880 | 2.044 | 190.0 |
| L-17 | 0.2425 | 0.1587 | 510.250 | 37.182 | 1.327 | 0.534 | 14.334 | 1.500 | 27.810 | 2.191 | 202.3 |
| L-18 | 0.2499 | 0.1583 | 389.653 | 41.484 | 0.713 | 0.343 | 13.613 | 1.335 | 46.577 | 1.681 | 136.7 |
| L-19 | 0.2185 | 0.1711 | 286.170 | 35.081 | 13.319 | 0.371 | 65.767 | 3.107 | 3.317 | 17.289 | 648.0 |
| L-20 | 0.2331 | 0.1609 | 494.023 | 42.095 | 2.721 | 0.355 | 25.215 | 1.642 | 15.483 | 4.339 | 240.5 |
| L-21 | 0.2604 | 0.1508 | 369.768 | 36.300 | 0.591 | 0.370 | 10.086 | 1.307 | 71.952 | 2.123 | 147.9 |
| L-22 | 0.2442 | 0.1674 | 449.293 | 37.191 | 1.281 | 0.398 | 18.308 | 1.630 | 30.340 | 3.791 | 286.9 |
| L-23 | 0.1829 | 0.1436 | 181.893 | 17.860 | 1.239 | 0.369 | 42.599 | 2.116 | 17.236 | 5.830 | 357.0 |
| L-24 | 0.2518 | 0.1643 | 433.943 | 33.982 | 0.931 | 0.430 | 15.019 | 1.440 | 36.918 | 3.416 | 287.1 |
| L-25 | 0.2569 | 0.1790 | 324.913 | 36.954 | 11.493 | 0.461 | 49.775 | 2.064 | 3.233 | 9.222 | 396.5 |
| L-26 | 0.2226 | 0.1780 | 421.437 | 38.561 | 17.576 | 0.484 | 60.201 | 2.541 | 2.232 | 11.375 | 459.2 |
| L-27 | 0.1948 | 0.1499 | 381.280 | 30.666 | 13.922 | 0.251 | 80.493 | 2.628 | 2.347 | 31.500 | 1184.3 |
| L-28 | 0.2291 | 0.1826 | 516.873 | 40.226 | 21.574 | 0.405 | 91.859 | 4.606 | 2.064 | 34.185 | 1417.5 |
| L-29 | 0.2167 | 0.1657 | 458.375 | 40.534 | 9.844 | 0.321 | 56.953 | 2.893 | 4.071 | 18.000 | 771.6 |
| L-30 | 0.2209 | 0.1598 | 229.610 | 16.337 | 7.564 | 0.228 | 54.685 | 2.479 | 2.120 | 14.888 | 505.8 |
| L-31 | 0.2387 | 0.1877 | 286.395 | 26.549 | 19.153 | 0.503 | 84.473 | 3.176 | 1.439 | 8.073 | 593.5 |
| L-32 | 0.2413 | 0.1642 | 277.078 | 24.807 | 0.274 | 0.268 | 6.454 | 1.372 | 90.586 | 1.002 | 68.4 |
| L-33 | 0.2238 | 0.1587 | 351.175 | 24.234 | 2.841 | 0.263 | 20.919 | 1.305 | 8.580 | 7.685 | 434.5 |
| L-34 | 0.2459 | 0.1680 | 399.380 | 35.310 | 6.138 | 0.303 | 46.721 | 2.212 | 5.775 | 12.478 | 589.5 |
| L-35 | 0.2482 | 0.1581 | 217.370 | 19.085 | 3.016 | 0.196 | 34.087 | 1.717 | 6.456 | 10.600 | 463.4 |
| L-36 | 0.2475 | 0.1651 | 408.020 | 28.705 | 2.276 | 0.305 | 23.952 | 1.320 | 12.720 | 7.855 | 415.1 |
| L-37 | 0.2294 | 0.1585 | 275.790 | 17.510 | 2.132 | 0.265 | 36.224 | 1.853 | 8.146 | 9.133 | 442.1 |
| L-38 | 0.2254 | 0.1573 | 219.835 | 15.830 | 1.535 | 0.206 | 31.321 | 1.676 | 10.755 | 8.243 | 460.7 |
| L-39 | 0.2565 | 0.1715 | 442.417 | 37.021 | 5.071 | 0.372 | 37.722 | 1.690 | 7.337 | 10.008 | 529.8 |
| L-40 | 0.2363 | 0.1527 | 279.125 | 16.235 | 2.136 | 0.247 | 29.251 | 1.524 | 7.727 | 7.500 | 320.8 |
| L-41 | 0.2431 | 0.1619 | 254.648 | 18.083 | 1.925 | 0.266 | 29.508 | 1.560 | 9.393 | 8.228 | 349.8 |
| L-42 | 0.2319 | 0.1649 | 432.950 | 36.965 | 2.230 | 0.294 | 29.121 | 1.873 | 15.957 | 7.590 | 366.1 |
| L-43 | 0.2535 | 0.1735 | 407.965 | 58.985 | 0.364 | 0.332 | 7.714 | 1.141 | 123.564 | 0.896 | 73.7 |
| L-44 | 0.2631 | 0.1691 | 407.297 | 27.890 | 0.712 | 0.315 | 14.875 | 1.406 | 41.222 | 2.084 | 160.9 |
| L-45 | 0.1989 | 0.1563 | 308.283 | 35.358 | 8.497 | 0.431 | 51.224 | 2.990 | 4.233 | 7.410 | 470.8 |
| L-46 | 0.2578 | 0.1771 | 359.710 | 25.460 | 0.723 | 0.373 | 12.674 | 1.492 | 38.671 | 3.023 | 255.1 |
| L-47 | 0.2512 | 0.1621 | 345.240 | 30.750 | 0.476 | 0.357 | 10.189 | 1.344 | 64.453 | 1.900 | 169.8 |
| L-48 | 0.2157 | 0.1609 | 223.693 | 20.025 | 4.673 | 0.326 | 46.936 | 2.144 | 4.279 | 11.450 | 525.3 |
| L-49 | 0.2416 | 0.1634 | 386.343 | 35.518 | 0.669 | 0.361 | 15.213 | 1.284 | 54.655 | 2.080 | 204.6 |

Table 209: Provided are the values of each of the parameters (as described above) measured in Foxtail millet accessions ("L" = Line) under normal conditions. Growth conditions are specified in the experimental procedure section.

TABLE 210

Additional measured parameter in Foxtail millet accessions under normal growth conditions

| L/Corr. ID | 32 | 33 | 34 | 35 | 36 | 37 | 38 | 39 | 40 | 41 | 42 |
|---|---|---|---|---|---|---|---|---|---|---|---|
| L-1 | 10.167 | 35.346 | 6.212 | 89.800 | 21808 | 69.938 | 10.208 | 87.000 | 37.8 | 61.0 | 2.970 |
| L-2 | 8.333 | 34.194 | 5.268 | 60.278 | 23393 | 50.248 | 11.278 | 87.750 | 43.8 | 79.0 | 2.078 |
| L-3 | 9.500 | 34.783 | 6.399 | 97.153 | 31815 | 83.283 | 8.917 | 83.667 | 40.0 | 68.0 | 2.589 |
| L-4 | 11.417 | 34.140 | 7.169 | 142.260 | 27993 | 108.443 | 12.375 | 86.667 | 47.0 | 83.0 | 3.971 |
| L-5 | 10.083 | 34.019 | 7.164 | 132.088 | 31003 | 111.863 | 11.500 | 81.333 | 47.0 | 79.0 | 4.913 |
| L-6 | 11.500 | 35.904 | 5.592 | 100.283 | 25379 | 80.673 | 10.667 | 89.333 | 46.3 | 79.0 | 3.916 |
| L-7 | 6.917 | 33.910 | 2.338 | 15.723 | 3051 | 10.450 | 7.000 | 87.000 | 41.0 | 86.0 | 1.525 |
| L-8 | 11.000 | 33.469 | 5.303 | 28.830 | 7161 | 23.435 | 10.875 | 83.500 | 50.5 | 86.0 | 2.313 |
| L-9 | 9.083 | 33.577 | 3.978 | 29.715 | 9195 | 25.053 | 9.625 | 76.000 | 40.0 | 68.0 | 2.226 |
| L-10 | 8.667 | 34.346 | 4.298 | 33.580 | 10390 | 28.743 | 9.167 | 70.000 | 40.0 | 68.0 | 2.944 |
| L-11 | 5.667 | 33.310 | 3.834 | 29.700 | 6830 | 21.315 | 6.250 | 85.000 | 33.0 | 79.0 | 3.059 |
| L-12 | 5.111 | 34.939 | 2.419 | 12.540 | 2858 | 9.567 | 5.000 | 94.333 | 39.0 | 86.0 | 1.701 |
| L-13 | 5.083 | 33.229 | 3.491 | 16.488 | 4767 | 13.643 | 5.750 | 91.000 | 33.0 | 91.0 | 2.690 |
| L-14 | 11.417 | 33.375 | 5.554 | 27.015 | 6622 | 20.438 | 12.375 | 79.000 | 54.8 | 83.0 | 1.861 |
| L-15 | 8.500 | 34.779 | 3.556 | 21.528 | 4829 | 16.873 | 8.083 | 79.250 | 40.0 | 79.0 | 1.906 |
| L-16 | 6.750 | 33.577 | 3.465 | 17.920 | 4062 | 14.260 | 6.913 | 88.333 | 33.0 | 86.0 | 2.865 |
| L-17 | 6.000 | 34.521 | 3.798 | 29.255 | 7386 | 20.890 | 7.478 | 81.667 | 33.0 | 64.0 | 2.984 |
| L-18 | 5.583 | 33.352 | 3.108 | 17.700 | 4644 | 14.143 | 5.208 | 91.000 | 33.0 | 86.0 | 2.526 |
| L-19 | 10.889 | 35.702 | 8.488 | 164.405 | 39491 | 126.260 | 10.542 | 70.000 | 38.5 | 64.0 | 4.219 |
| L-20 | 8.917 | 36.081 | 5.109 | 36.920 | 11175 | 30.363 | 8.833 | 74.667 | 40.0 | 68.0 | 2.264 |
| L-21 | 6.500 | 36.331 | 3.382 | 15.525 | 4550 | 12.288 | 6.667 | 85.333 | 33.0 | 64.0 | 2.252 |
| L-22 | 7.000 | 34.096 | 4.139 | 43.960 | 11884 | 35.613 | 7.542 | 70.000 | 33.0 | 61.0 | 2.510 |
| L-23 | 9.333 | 37.794 | 5.143 | 74.270 | 25745 | 61.475 | 8.083 | 78.000 | 33.0 | 64.0 | 2.289 |
| L-24 | 7.417 | 33.710 | 4.044 | 32.258 | 10116 | 26.915 | 6.500 | 82.333 | 33.0 | 61.0 | 2.910 |
| L-25 | 8.417 | 35.383 | 6.398 | 118.615 | 22554 | 96.977 | 8.083 | 70.000 | 38.5 | 64.0 | 3.405 |
| L-26 | 10.333 | 33.544 | 6.353 | 183.995 | 45768 | 153.405 | 10.917 | 78.333 | 39.3 | 68.0 | 4.377 |
| L-27 | 13.333 | 34.252 | 9.559 | 205.330 | 72881 | 148.725 | 16.250 | 86.667 | 52.3 | 79.0 | 4.740 |
| L-28 | 13.583 | 35.631 | 9.078 | 297.645 | 79336 | 240.727 | 12.125 | 96.000 | 55.5 | 79.0 | 3.959 |
| L-29 | 12.417 | 34.608 | 7.847 | 111.153 | 39953 | 89.588 | 12.833 | 80.000 | 53.3 | 79.0 | 3.215 |
| L-30 | 9.250 | 37.969 | 7.537 | 84.168 | 30461 | 64.960 | 11.167 | 81.333 | 52.5 | 72.0 | 2.460 |
| L-31 | 10.667 | 35.627 | 5.907 | 212.663 | 42852 | 172.618 | 10.458 | 78.000 | 37.0 | 68.0 | 5.002 |
| L-32 | 6.500 | 35.527 | 2.685 | 7.305 | 1916 | 5.963 | 7.208 | 96.000 | 47.0 | 86.0 | 1.530 |
| L-33 | 10.667 | 32.798 | 5.477 | 27.695 | 7487 | 22.548 | 11.833 | 81.333 | 53.3 | 79.0 | 2.278 |
| L-34 | 11.167 | 35.050 | 6.534 | 67.398 | 15024 | 54.450 | 12.000 | 81.333 | 52.5 | 79.0 | 2.883 |
| L-35 | 12.917 | 33.967 | 5.899 | 37.395 | 15482 | 28.640 | 12.000 | 83.667 | 53.3 | 79.0 | 2.219 |
| L-36 | 11.083 | 33.675 | 5.436 | 30.835 | 7112 | 24.018 | 11.500 | 79.000 | 53.3 | 79.0 | 1.995 |
| L-37 | 12.833 | 35.694 | 4.868 | 36.010 | 11390 | 29.410 | 12.250 | 75.750 | 52.5 | 79.0 | 2.519 |
| L-38 | 10.667 | 34.590 | 5.763 | 30.610 | 8318 | 22.915 | 10.875 | 85.750 | 54.0 | 86.0 | 2.693 |
| L-39 | 9.833 | 34.421 | 6.426 | 59.638 | 13586 | 49.848 | 10.333 | 79.000 | 47.0 | 79.0 | 2.719 |
| L-40 | 10.333 | 33.773 | 5.662 | 25.743 | 6967 | 19.830 | 10.667 | 83.500 | 49.0 | 79.0 | 2.089 |
| L-41 | 10.250 | 34.317 | 6.289 | 28.155 | 6920 | 22.085 | 9.625 | 82.667 | 52.5 | 79.0 | 2.383 |
| L-42 | 9.833 | 34.573 | 5.321 | 67.483 | 20024 | 50.003 | 12.333 | 81.333 | 47.0 | 79.0 | 1.879 |
| L-43 | 5.250 | 34.356 | 2.686 | 7.388 | 1589 | 5.618 | 6.667 | 92.667 | 37.0 | 86.0 | 1.114 |
| L-44 | 5.667 | 33.465 | 3.166 | 17.748 | 4360 | 13.555 | 6.875 | 91.000 | 41.0 | 91.0 | 2.841 |
| L-45 | 8.750 | 37.452 | 6.546 | 99.460 | 28950 | 81.203 | 9.250 | 75.750 | 37.0 | 64.0 | 2.644 |
| L-46 | 7.500 | 35.338 | 4.528 | 29.748 | 8930 | 24.443 | 7.792 | 73.500 | 33.0 | 61.0 | 1.944 |
| L-47 | 6.750 | 34.892 | 3.188 | 11.615 | 2977 | 8.810 | 7.375 | 92.667 | 33.0 | 68.0 | 1.508 |
| L-48 | 10.167 | 35.425 | 7.607 | 96.310 | 28133 | 82.633 | 9.875 | 70.000 | 37.0 | 64.0 | 3.365 |
| L-49 | 6.000 | 32.788 | 3.748 | 17.885 | 4690 | 14.583 | 6.292 | 82.333 | 33.0 | 68.0 | 1.535 |

Table 210: Provided are the values of each of the parameters (as described above) measured in Foxtail millet accessions ("L" = Line) under normal conditions. Growth conditions are specified in the experimental procedure section.

TABLE 211

Additional measured parameters in Foxtail millet accessions under normal growth conditions

| L/Corr. ID | 43 | 44 | 45 | 46 | 46 | 47 | 48 | 49 | 50 | 51 | 52 | 53 | 54 |
|---|---|---|---|---|---|---|---|---|---|---|---|---|---|
| L-1 | 128.958 | 1.573 | 61.935 | 48.331 | 48.331 | 178.139 | 7.583 | 0.491 | 0.622 | 21.437 | 2.412 | 0.241 | 61.875 |
| L-2 | 109.277 | 1.677 | 53.240 | 43.752 | 43.752 | 132.587 | 10.333 | 0.567 | 0.544 | 12.445 | 1.844 | 0.148 | 38.808 |
| L-3 | 125.646 | 1.852 | 59.635 | 45.810 | 45.810 | 186.288 | 9.250 | 0.487 | 0.595 | 20.030 | 2.366 | 0.259 | 73.563 |
| L-4 | 147.621 | 1.317 | 62.080 | 51.204 | 51.204 | 147.933 | 3.750 | 0.319 | 0.652 | 13.657 | 2.075 | 0.219 | 132.413 |
| L-5 | 126.171 | 0.981 | 60.254 | 51.054 | 51.054 | 121.133 | 2.250 | 0.239 | 0.453 | 9.268 | 1.251 | 0.101 | 158.695 |
| L-6 | 127.190 | 1.397 | 65.681 | 48.802 | 48.802 | 179.088 | 6.583 | 0.357 | 0.474 | 14.578 | 2.017 | 0.250 | 66.263 |
| L-7 | 86.450 | 1.845 | 57.424 | 47.806 | 47.806 | 167.304 | 20.667 | 0.588 | 0.762 | 8.015 | 1.509 | 0.131 | 11.760 |
| L-8 | 138.625 | 1.608 | 46.640 | 49.923 | 49.923 | 144.454 | 13.667 | 0.335 | 0.845 | 10.653 | 1.576 | 0.105 | 42.343 |
| L-9 | 112.875 | 1.350 | 46.440 | 41.715 | 41.715 | 189.283 | 15.833 | 0.357 | 0.584 | 14.399 | 1.701 | 0.149 | 27.233 |
| L-10 | 116.771 | 1.650 | 42.698 | 42.912 | 42.912 | 225.039 | 16.250 | 0.436 | 0.601 | 15.740 | 1.860 | 0.134 | 32.738 |
| L-11 | 88.729 | 1.928 | 57.308 | 48.588 | 48.588 | 246.888 | 21.750 | 0.543 | 0.465 | 9.197 | 1.785 | 0.213 | 19.515 |
| L-12 | 78.717 | 1.765 | 61.122 | 45.067 | 45.067 | 215.861 | 35.222 | 0.510 | 0.428 | 6.817 | 1.345 | 0.242 | 16.160 |

TABLE 211-continued

Additional measured parameters in Foxtail millet accessions under normal growth conditions

| L/ Corr. ID | 43 | 44 | 45 | 46 | 46 | 47 | 48 | 49 | 50 | 51 | 52 | 53 | 54 |
|---|---|---|---|---|---|---|---|---|---|---|---|---|---|
| L-13 | 81.875 | 0.954 | 54.270 | 44.900 | 44.900 | 270.627 | 16.500 | 0.273 | 0.435 | 5.690 | 1.392 | 0.122 | 16.970 |
| L-14 | 134.546 | 1.739 | 45.058 | 46.185 | 46.185 | 162.870 | 13.750 | 0.476 | 0.869 | 10.673 | 1.295 | 0.089 | 44.573 |
| L-15 | 91.300 | 1.163 | 53.465 | 49.672 | 49.672 | 204.193 | 16.667 | 0.313 | 0.529 | 10.586 | 1.742 | 0.124 | 15.813 |
| L-16 | 82.761 | 1.138 | 56.990 | 47.027 | 47.027 | 279.201 | 15.000 | 0.297 | 0.633 | 8.540 | 1.874 | 0.149 | 14.768 |
| L-17 | 82.835 | 1.558 | 48.423 | 44.356 | 44.356 | 277.408 | 18.250 | 0.442 | 0.360 | 16.460 | 2.153 | 0.157 | 14.250 |
| L-18 | 90.954 | 1.096 | 61.010 | 48.983 | 48.983 | 246.853 | 16.583 | 0.312 | 0.655 | 7.352 | 1.644 | 0.175 | 12.780 |
| L-19 | 129.383 | 0.978 | 63.658 | 49.510 | 49.510 | 125.254 | 1.167 | 0.296 | 0.373 | 11.352 | 1.207 | 0.148 | 176.060 |
| L-20 | 159.542 | 1.078 | 64.058 | 48.517 | 48.517 | 166.770 | 9.000 | 0.291 | 0.782 | 17.644 | 2.084 | 0.178 | 56.788 |
| L-21 | 105.783 | 1.131 | 57.615 | 49.127 | 49.127 | 211.221 | 15.083 | 0.322 | 0.510 | 11.928 | 1.560 | 0.153 | 17.325 |
| L-22 | 107.063 | 1.301 | 53.504 | 45.627 | 45.627 | 227.911 | 13.917 | 0.384 | 0.532 | 16.777 | 2.070 | 0.171 | 35.183 |
| L-23 | 97.808 | 0.635 | 58.092 | 50.992 | 50.992 | 203.990 | 5.250 | 0.129 | 0.245 | 4.514 | 0.767 | 0.075 | 51.133 |
| L-24 | 102.479 | 1.031 | 53.400 | 45.177 | 45.177 | 251.631 | 11.000 | 0.293 | 0.434 | 15.498 | 2.000 | 0.157 | 21.228 |
| L-25 | 104.246 | 0.844 | 64.658 | 51.258 | 51.258 | 130.619 | 2.000 | 0.257 | 0.268 | 12.684 | 1.371 | 0.156 | 79.543 |
| L-26 | 123.167 | 1.067 | 61.858 | 50.104 | 50.104 | 119.749 | 3.167 | 0.291 | 0.352 | 15.209 | 1.778 | 0.163 | 138.503 |
| L-27 | 164.167 | 1.169 | 51.271 | 50.649 | 50.649 | 111.567 | 1.417 | 0.282 | 0.933 | 14.478 | 1.609 | 0.129 | 319.148 |
| L-28 | 120.870 | 1.168 | 59.071 | 47.508 | 47.508 | 124.662 | 1.583 | 0.252 | 0.579 | 22.470 | 2.181 | 0.170 | 215.828 |
| L-29 | 152.421 | 1.434 | 45.519 | 47.983 | 47.983 | 128.734 | 3.667 | 0.334 | 0.758 | 18.513 | 1.934 | 0.171 | 145.873 |
| L-30 | 153.063 | 0.683 | 45.221 | 49.431 | 49.431 | 102.055 | 1.417 | 0.166 | 0.637 | 12.112 | 0.969 | 0.069 | 166.228 |
| L-31 | 118.438 | 0.604 | 67.892 | 51.856 | 51.856 | 165.763 | 1.333 | 0.152 | 0.204 | 9.239 | 1.208 | 0.112 | 119.595 |
| L-32 | 72.504 | 1.632 | 60.747 | 43.388 | 43.388 | 207.114 | 26.667 | 0.391 | 0.536 | 7.105 | 1.169 | 0.105 | 17.010 |
| L-33 | 144.917 | 1.679 | 44.081 | 47.810 | 47.810 | 152.324 | 9.833 | 0.384 | 0.874 | 14.082 | 1.482 | 0.102 | 54.960 |
| L-34 | 157.854 | 1.095 | 55.485 | 45.529 | 45.529 | 141.685 | 4.083 | 0.269 | 0.797 | 15.179 | 1.685 | 0.149 | 109.758 |
| L-35 | 160.021 | 1.378 | 46.251 | 45.260 | 45.260 | 131.123 | 6.417 | 0.313 | 0.824 | 8.860 | 0.917 | 0.081 | 77.188 |
| L-36 | 138.813 | 1.943 | 46.836 | 46.131 | 46.131 | 158.832 | 11.583 | 0.447 | 0.787 | 16.885 | 1.722 | 0.121 | 45.743 |
| L-37 | 137.308 | 2.012 | 40.937 | 45.190 | 45.190 | 143.926 | 11.417 | 0.393 | 0.654 | 10.592 | 1.164 | 0.074 | 70.598 |
| L-38 | 136.265 | 2.065 | 43.448 | 44.017 | 44.017 | 169.880 | 14.583 | 0.538 | 0.751 | 6.870 | 0.928 | 0.067 | 58.378 |
| L-39 | 148.475 | 1.969 | 37.781 | 44.381 | 44.381 | 161.392 | 8.167 | 0.489 | 0.626 | 14.667 | 1.867 | 0.156 | 66.483 |
| L-40 | 147.958 | 1.494 | 42.473 | 44.954 | 44.954 | 127.309 | 9.250 | 0.437 | 0.763 | 9.530 | 1.178 | 0.069 | 44.175 |
| L-41 | 157.513 | 2.397 | 46.823 | 47.042 | 47.042 | 125.253 | 13.750 | 0.567 | 0.611 | 9.726 | 1.074 | 0.076 | 50.813 |
| L-42 | 154.208 | 2.146 | 44.696 | 44.742 | 44.742 | 144.574 | 13.500 | 0.615 | 0.901 | 13.530 | 1.827 | 0.156 | 82.453 |
| L-43 | 90.950 | 1.742 | 57.319 | 44.931 | 44.931 | 246.502 | 31.667 | 0.564 | 0.662 | 8.326 | 1.721 | 0.249 | 8.235 |
| L-44 | 88.750 | 2.476 | 60.113 | 50.192 | 50.192 | 212.864 | 36.167 | 0.668 | 0.725 | 7.986 | 1.719 | 0.118 | 14.728 |
| L-45 | 110.617 | 1.165 | 65.658 | 52.279 | 52.279 | 191.657 | 5.250 | 0.254 | 0.307 | 11.418 | 1.301 | 0.149 | 85.383 |
| L-46 | 106.083 | 0.758 | 56.935 | 43.960 | 43.960 | 254.498 | 6.917 | 0.236 | 0.483 | 12.847 | 1.658 | 0.117 | 27.690 |
| L-47 | 90.854 | 0.830 | 55.525 | 47.365 | 47.365 | 292.024 | 11.417 | 0.207 | 0.507 | 9.864 | 1.457 | 0.130 | 14.400 |
| L-48 | 157.133 | 1.001 | 61.688 | 48.563 | 48.563 | 138.388 | 2.250 | 0.325 | 0.396 | 8.285 | 0.944 | 0.084 | 129.215 |
| L-49 | 85.788 | 1.819 | 54.054 | 47.442 | 47.442 | 295.635 | 23.417 | 0.457 | 0.580 | 10.577 | 1.630 | 0.150 | 11.638 |

Table 211: Provided are the values of each of the parameters (as described above) measured in Foxtail millet accessions ("L" = Line) under normal conditions. Growth conditions are specified in the experimental procedure section.

TABLE 212

Correlation between the expression level of selected genes of some embodiments of the invention in various tissues and the phenotypic performance under normal conditions across Foxtail millet accessions

| Gene Name | R | P value | Exp. set | Corr. Set ID | Gene Name | R | P value | Exp. set | Corr. Set ID |
|---|---|---|---|---|---|---|---|---|---|
| LBY69 | 0.72 | 1.07E−08 | 3 | 25 | LBY69 | 0.74 | 2.07E−09 | 3 | 28 |
| LBY69 | 0.76 | 5.41E−10 | 3 | 37 | LBY69 | 0.72 | 6.18E−09 | 3 | 36 |
| LBY69 | 0.73 | 4.40E−09 | 3 | 18 | LBY69 | 0.75 | 1.07E−09 | 3 | 35 |
| LBY80 | 0.73 | 5.10E−09 | 3 | 25 | LBY80 | 0.76 | 4.12E−10 | 3 | 37 |
| LBY80 | 0.75 | 1.01E−09 | 3 | 35 | LGN52 | 0.71 | 1.56E−08 | 3 | 29 |

Table 212. Provided are the correlations (R) between the genes expression levels in various tissues and the phenotypic performance. "Corr. ID"—correlation set ID according to the correlated parameters specified in Table 206. "Exp. Set"—Expression set specified in Table 205. "R" = Pearson correlation coefficient; "P" = p value.

Example 23

Production of Wheat Transcriptome and High Throughput Correlation Analysis with Yield Related Parameters Using 62K Wheat Oligonucleotide Micro-Arrays In order to produce a high throughput correlation analysis between plant phenotype and gene expression level, the present inventors utilized a wheat oligonucleotide microarray, produced by Agilent Technologies [chem. (dot) agilent (dot) com/Scripts/PDS (dot) asp?1Page=50879]. The array oligonucleotide represents about 50,000 wheat genes and transcripts.

Correlation of Wheat Lines Grown Under Regular Growth Conditions

Experimental Procedures 185 spring wheat lines were grown in 5 replicate plots in the field. Wheat seeds were sown and plants were grown under commercial fertilization and irrigation protocols (normal growth conditions) which include 150 m³ applied water and 400 m³ by rainfall per dunam (1000 square meters) per entire growth period and fertilization of 15 units of URAN® 21% (Nitrogen Fertilizer Solution; PCS Sales, Northbrook, Ill., USA).

In order to define correlations between the levels of RNA expression with yield components or vigor related parameters, phenotypic performance of the 185 different wheat lines was characterized and analyzed at various developmental stages. Twenty six selected lines, encompassing a wide range of the observed variation were sampled for RNA expression analysis. The correlation between the RNA levels and the characterized parameters was analyzed using Pearson correlation test [davidmlane (dot) com/hyperstat/A34739 (dot) html].

Analyzed Wheat tissues—Three types of plant tissues [flag leaf, inflorescence and peduncle] from plants grown under Normal conditions were sampled and RNA was extracted as described above. Micro-array expression information from each tissue type has received a Set ID as summarized in Table 213 below.

TABLE 213

Wheat transcriptome expression sets under normal growth conditions

| Expression Set | Set ID |
|---|---|
| Flag leaf at heading stage under normal growth conditions | 1 |
| Inflorescence at heading stage under normal growth conditions | 2 |
| peduncle at heading stage under normal growth conditions | 3 |

Table 213: Provided are the wheat transcriptome expression sets. Flag leaf = Full expanded upper leaf at heading; inflorescence = spike before flowering at full head emergence; peduncle = upper stem internode between the flag leaf and spike.

Wheat yield components and vigor related parameters assessment

The collected data parameters were as follows:

% Canopy coverage (F)—percent Canopy coverage at flowering stage. The % Canopy coverage is calculated using Formula XXXII (above).

1000 seed weight [gr.]—was calculated based on Formula XIV (above).

Average spike weight (H) [gr.]—The biomass and spikes of each plot was separated. Spikes dry weight at harvest was divided by the number of spikes or by the number of plants.

Dry weight=total weight of the vegetative portion above ground (excluding roots) after drying at 70° C. in oven for 48 hours.

Average tiller DW (H) [gr.]—Average Stem Dry Matter at harvest.

Average vegetative DW per plant (H) [gr.]—Vegetative dry weight per plant at harvest.

Fertile spikelets [number]—Number of fertile spikelets per spike. Count the bottom sterile spikelets in a sample from harvested spikes and deduce from number of spikelets per spike (with the unfertile spikes).

Fertile spikelets ratio [value]—Measure by imaging, the number of fertile and sterile spikelets per spike in 20 spikes randomly selected from the plot. Calculate the ratio between fertile spikelets to total number of spikelets×100 (sum of fertile and sterile spikelets).

Field Spike length (H) [cm]—Measure spike length per plant excluding the awns, at harvest.

Grain fill duration [number]—Defined by view. Calculate the number of days from anthesis in 50% of the plot to physiological maturity in 50% of the plot.

Grains per spike [number]—The total number of grains from 20 spikes per plot that were manually threshed was counted. The average grains per spike was calculated by dividing the total grain number by the number of spikes.

Grains per spikelet [number]—Number of grains per spike divided by the number of fertile spikelets per spike. Measure by imaging the number of fertile spikelets in 20 randomly selected spikes and calculate an average per spike.

Grains yield per micro plots [Kg]—Grain weight per micro plots.

Grains yield per spike [gr.]—Total grain weight per spike from 20 spikes per plot. The total grain weight per spike was calculated by dividing the grain weight of 20 spikes by the number of spikes.

Harvest index [ratio]—was calculated based on Formula XVIII (above).

Number days to anthesis [number]—Calculated as the number of days from sowing till 50% of the plots reach anthesis.

Number days to maturity [number]—Calculated as the number of days from sowing till 50% of the plots reach maturity.

Number days to tan [number]—Calculated as the number of days from sowing till 50% of the plot arrive to grain maturation.

PAR LAI (F)—Photosynthetically Active Radiation (PAR) at flowering.

Peduncle length (F) [cm]—Length of upper internode from the last node to the spike base at flowering. Calculate the average peduncle length per 10-15 plants randomly distributed within a pre-defined 0.5 m² of a plot.

Peduncle width (F) [mm]—Upper node width at flowering. Calculate the average upper nodes width, measured just above the flag leaf auricles per 10-15 plants randomly distributed within a pre-defined 0.5 m² of a plot.

Peduncle volume (F) [Float value]=
Peduncle length* (peduncle thickness/2)²*π

Spikelets per spike [number]—Number of spikelets per spike (with the unfertile spikes). Measured by imaging, the number of spikelets per spike in 20 spikes randomly selected from the plot.

Spikes per plant (H) [number]—Number of spikes per plant at harvest. Calculate Number of spikes per unit area/Number of plants per plot.

Spikes weight per plant (FC) [gr.]—Spikes weight per plant at flowering complete. Spikes weight from 10 plants/number of plants.

Stem length (F) [cm]—Main Stem length at flowering. Measures the length of Main Stem from ground to end of elongation (without the spike).

Stem width (F) [mm]—Stem width at flowering. Measures on the stem beneath the peduncle.

Test weight (mechanical harvest) [Kg/hectoliter]—Volume weight of seeds.

Tillering (F) [number]—Count the number of tillers per plant from 6-10 plants randomly distributed in a plot, at flowering stage.

Tillering (H) [number]—Number of tillers at harvest.

Total dry matter (FC) [gr.]—was calculated based on Formula XXI.

Total Plant Biomass (H) [gr.]—Vegetative dry weight+Spikes dry weight.

Vegetative DW per plant (F) [gr.]—Plant weight after drying (excluding the spikes) at flowering stage.

Total N content of grain per plant [gr.]—N content of grain*Grains yield per plant.

NDRE 1 [Float value]—Normalized difference Red-Edge TP-1 (time point). Calculated as (NIR−Red edge)/(NIR+Red edge). ("NIR"—Near InfraRed)

NDRE 2 [Float value]—Normalized difference Red-Edge TP-2. Calculated as (Nir−Red edge)/(Nir+Red edge).

NDVI 1 [Float value]—Normalized Difference Vegetation Index TP-1. Calculated as (Nir−Red edge)/(Nir+Red edge).

NDVI 2 [Float value]—Normalized Difference Vegetation Index TP-2. Calculated as (Nir−Red edge)/(Nir+Red edge).

RUE [ratio]—total dry matter produced per intercepted PAR. Spikes weight per plant+Vegetative DW per plant at flowering/% Canopy coverage.

The following parameters were collected using digital imaging system: Grain Area [cm$^2$]—A sample of ~200 grains were weight, photographed and images were processed using the below described image processing system. The grain area was measured from those images and was divided by the number of grains.

Grain Length and Grain width [cm]—A sample of ~200 grains was weighted, photographed and images were processed using the below described image processing system. The sum of grain lengths and width (longest axis) was measured from those images and was divided by the number of grains.

Grain Perimeter [cm]—A sample of ~200 grains were weight, photographed and images were processed using the below described image processing system. The sum of grain perimeter was measured from those images and was divided by the number of grains.

Spike area [cm$^2$]—At the end of the growing period 5 'spikes' were photographed and images were processed using the below described image processing system. The 'spike' area was measured from those images and was divided by the number of 'spikes'.

Spike length [cm]—Measure by imaging spikes length excluding awns, per 30 randomly selected spikes within a pre-defined 0.5 m$^2$ of a plot.

Spike max width [cm]—Measure by imaging the max width of 10-15 spikes randomly distributed within a pre-defined 0.5 m$^2$ of a plot. Measurements were carried out at the middle of the spike.

Spike width [cm]—Measure by imaging the width of 10-15 spikes randomly distributed within a pre-defined 0.5 m$^2$ of a plot. Measurements were carried out at the middle of the spike.

N use efficiency [ratio]—was calculated based on Formula LI (above).

Yield per spike filling rate [gr/day]—was calculated based on Formula LX (above).

Yield per micro plots filling rate [gr/day]—was calculated based on Formula LXI (above).

Grains yield per hectare [ton/ha]—was calculated based on Formula LXII (above).

Total NUtE [ratio]—was calculated based on Formula LIII (above).

The image processing system consisted of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Data parameters collected are summarized in Table 214, herein below

TABLE 214

| Wheat correlated parameters (vectors) | |
| --- | --- |
| Correlated parameter with | Correlation ID |
| % Canopy coverage (F) [%] | 1 |
| 1000 grain weight [gr.] | 2 |
| Avr Spikes DW per plant (H) [gr.] | 3 |
| Avr Vegetative DW per plant (H) [gr.] | 4 |
| Avr spike weight (H) [gr.] | 5 |
| Avr tiller DW (H) [gr.] | 6 |
| Fertile spikelets [number] | 7 |
| Fertile spikelets ratio [value] | 8 |
| Field Spike length (H) [cm] | 9 |
| Grain Perimeter [cm] | 10 |
| Grain area [cm$^2$] | 11 |
| Grain fill duration [number] | 12 |
| Grain length [cm] | 13 |
| Grain width [cm] | 14 |
| Grains per spike [number] | 15 |
| Grains per spikelet [number] | 16 |
| Grains yield per hectare [ton/ha] | 17 |
| Grains yield per micro plots [kg] | 18 |
| Grains yield per spike [gr.] | 19 |
| Harvest index [ratio] | 20 |
| N content of grain (harvest) [gr.] | 21 |
| N use efficiency [ratio] | 22 |
| NDRE_1 [Float value] | 23 |
| NDRE_2 [Float value] | 24 |
| NDVI_1 [Float value] | 25 |
| NDVI_2 [Float value] | 26 |
| Num days to anthesis [number] | 27 |
| Num days to maturity [number] | 28 |
| Num days to tan [number] | 29 |
| PAR_LAI (F) [μmol$^{-2}$ S$^{-1}$] | 30 |
| Peduncle length (F) [cm] | 31 |
| Peduncle width (F) [mm] | 32 |
| RUE [ratio] | 33 |

TABLE 214-continued

Wheat correlated parameters (vectors)

| Correlated parameter with | Correlation ID |
|---|---|
| Spike Area [cm²] | 34 |
| Spike length [cm] | 35 |
| Spike max width [cm] | 36 |
| Spike width [cm] | 37 |
| Spikelets per spike [number] | 38 |
| Spikes dry weight per plant (F) [gr] | 39 |
| Spikes per plant (H) [number] | 40 |
| Stem length (F) [cm] | 41 |
| Stem width (F) [mm] | 42 |
| Test weight (mechanical harvest) [kg/hectoliter] | 43 |
| Tillering (F) [number] | 44 |
| Tillering (H) [number] | 45 |
| Total N content of grain per plant [gr.] | 46 |
| Total N utilization efficiency [ratio] | 47 |
| Total Plant Biomass (H) [gr.] | 48 |
| Total dry matter (F) [gr.] | 49 |
| Vegetative DW per plant (F) [gr.] | 50 |
| Yield per micro plots filling rate [ratio] | 51 |
| Yield per spike filling rate [gr./day] | 52 |
| Peduncle volume (F) [Float value] | 53 |

Table 214. Provided are the wheat correlated parameters "TP" = time point; "DW" = dry weight; "FW" = fresh weight; "Low N" = Low Nitrogen; "Relative water content [percent]; "num" = number. "gr." = grams; "cm" = centimeter; "Avr" = average; "RGR' = relative growth rate; "BPE" = biomass production efficiency; "NHI" = Nitrogen harvest index; "NupE" = nitrogen uptake efficiency; "NutE" = nitrogen utilization efficiency; "SPAD" = chlorophyll levels; "F" = flowering stage; "H" = harvest stage; "N" = nitrogen; "gr" = gram; "cm" = centimeter; "kg" = kilogram; "FC" = flowering completed; "RUE = radiation use efficiency; "NDVI" = normalized Difference Vegetation Index; "NDRE" = normalized Difference Red-Edge index.

Experimental Results 185 different wheat lines were grown and characterized for different parameters. Tissues for expression analysis were sampled from a subset of 26 lines. The correlated parameters are described in Table 214 above. The average for each of the measured parameter was calculated using the JMP software (Tables 215-217) and a subsequent correlation analysis was performed (Table 218). Results were then integrated to the database.

TABLE 215

Measured parameters in Wheat accessions under normal conditions

| Line/Corr. ID | Line-4 | Line-8 | Line-23 | Line-27 | Line-31 | Line-36 | Line-40 | Line-60 | Line-63 |
|---|---|---|---|---|---|---|---|---|---|
| 1 | 92.15 | 67.65 | 64.37 | 73.02 | 96.17 | 59.83 | 87.75 | 92.76 | 92.93 |
| 2 | 39.771 | 38.337 | 42.139 | 41.724 | 48.413 | 39.471 | 41.237 | 41.290 | 44.576 |
| 3 | 3.476 | 2.069 | 4.998 | 6.599 | 5.636 | 3.925 | 4.471 | 4.684 | 5.777 |
| 4 | 5.872 | 3.010 | 4.063 | 4.548 | 3.516 | 7.846 | 6.721 | 3.866 | 3.609 |
| 5 | 1.606 | 1.118 | 1.802 | 2.142 | 2.645 | 1.296 | 2.082 | 2.229 | 2.766 |
| 6 | 1.986 | 1.346 | 1.235 | 1.355 | 1.472 | 2.315 | 2.281 | 1.375 | 1.636 |
| 7 | 16.05 | 14.92 | 15.58 | 15.95 | 16.64 | 15.87 | 17.25 | 17.98 | 17.16 |
| 8 | 88.46 | 88.07 | 86.26 | 88.96 | 86.97 | 90.10 | 88.22 | 89.52 | 87.05 |
| 9 | 8.904 | 6.704 | 8.551 | 7.925 | 10.461 | 8.830 | 10.122 | 9.492 | 9.700 |
| 10 | 1.703 | 1.678 | 1.740 | 1.733 | 1.837 | 1.677 | 1.676 | 1.756 | 1.789 |
| 11 | 0.183 | 0.178 | 0.186 | 0.189 | 0.211 | 0.173 | 0.178 | 0.190 | 0.202 |
| 12 | 365.63 | 388.60 | 304.75 | 337.75 | 437.30 | 432.70 | 383.67 | 426.10 | 304.75 |
| 13 | 0.6602 | 0.6526 | 0.6888 | 0.6713 | 0.7084 | 0.6621 | 0.6502 | 0.6961 | 0.7020 |
| 14 | 0.3682 | 0.3586 | 0.3601 | 0.3712 | 0.3855 | 0.3482 | 0.3643 | 0.3679 | 0.3825 |
| 15 | 29.10 | 24.76 | 32.16 | 37.42 | 43.25 | 24.12 | 32.46 | 42.80 | 46.27 |
| 16 | 1.814 | 1.649 | 2.066 | 2.356 | 2.610 | 1.529 | 1.883 | 2.383 | 2.695 |
| 17 | 6.585 | 4.538 | 8.242 | 9.747 | 11.851 | 5.633 | 5.943 | 7.969 | 12.367 |
| 18 | 5.663 | 3.903 | 7.088 | 8.383 | 10.192 | 4.844 | 5.111 | 6.853 | 10.636 |
| 19 | 1.124 | 0.887 | 1.322 | 1.516 | 1.951 | 0.933 | 1.311 | 1.689 | 2.029 |
| 20 | 0.2767 | 0.3339 | 0.4755 | 0.4356 | 0.4874 | 0.2530 | 0.2893 | 0.4480 | 0.4769 |
| 21 | 2.490 | 1.865 | 1.890 | 1.990 | 1.755 | 2.240 | 2.120 | 1.810 | 1.535 |
| 22 | 38.74 | 21.35 | 48.48 | 57.34 | 69.71 | 33.13 | 34.96 | 28.13 | 72.75 |
| 23 | 0.1337 | 0.1393 | 0.1280 | 0.1190 | 0.1212 | 0.1440 | 0.1471 | 0.1248 | 0.1290 |
| 24 | 0.2303 | 0.2285 | 0.2040 | 0.2330 | 0.1845 | 0.2358 | 0.2028 | 0.2115 | 0.1938 |
| 25 | 0.3278 | 0.3290 | 0.2976 | 0.3033 | 0.2890 | 0.3625 | 0.3562 | 0.2961 | 0.3040 |
| 26 | 0.609 | 0.601 | 0.540 | 0.616 | 0.455 | 0.645 | 0.525 | 0.558 | 0.507 |
| 27 | 128.0 | 120.8 | 128.0 | 127.8 | 116.6 | 137.6 | 129.3 | 117.2 | 128.0 |
| 28 | 176.0 | 163.0 | 167.3 | 168.3 | 163.0 | 177.8 | 175.7 | 164.6 | 169.0 |
| 29 | 160.8 | 153.2 | 157.8 | 158.3 | 153.6 | 172.0 | 163.7 | 153.2 | 157.0 |
| 30 | 4.578 | 2.445 | 2.256 | 2.494 | 5.783 | 1.881 | 2.866 | 5.262 | 3.732 |
| 31 | 38.87 | 36.37 | 38.03 | 39.54 | 34.51 | 38.34 | 49.04 | 38.29 | 35.90 |
| 32 | 2.438 | 3.123 | 2.677 | 2.684 | 3.046 | 2.204 | 2.662 | 3.094 | 2.728 |
| 33 | 0.0867 | 0.1030 | 0.1010 | 0.1381 | 0.0678 | 0.1876 | 0.1473 | 0.0791 | 0.0895 |
| 34 | 8.468 | 5.672 | 7.719 | 9.832 | 11.667 | 6.813 | 7.304 | 9.525 | NA |
| 35 | 9.503 | 6.564 | 8.222 | 8.203 | 11.055 | 8.094 | 9.407 | 9.927 | NA |
| 36 | 1.262 | 1.227 | 1.319 | 1.714 | 1.572 | 1.183 | 1.079 | 1.454 | NA |
| 37 | 1.030 | 1.006 | 1.086 | 1.417 | 1.259 | 0.965 | 0.899 | 1.159 | NA |
| 38 | 18.14 | 16.92 | 18.07 | 17.90 | 19.11 | 17.67 | 19.56 | 20.10 | 19.71 |
| 39 | 1.094 | 1.021 | 0.960 | 3.740 | 1.270 | 1.178 | 1.599 | 1.285 | 2.131 |
| 40 | 2.277 | 1.911 | 3.256 | 3.183 | 2.293 | 3.187 | 2.632 | 2.270 | 2.200 |
| 41 | 122.17 | 98.02 | 92.50 | 94.13 | 74.77 | 126.10 | 135.63 | 96.97 | 85.68 |
| 42 | 3.667 | 4.483 | 3.714 | 4.033 | 4.886 | 3.423 | 3.639 | 4.214 | 4.059 |
| 43 | 68.97 | 84.59 | 80.96 | 85.61 | 84.28 | 75.23 | 81.60 | 85.27 | 79.70 |
| 44 | 3.268 | 2.507 | 3.018 | 2.622 | 2.988 | 3.083 | 4.029 | 2.997 | 2.707 |

TABLE 215-continued

Measured parameters in Wheat accessions under normal conditions

| Line/Corr. ID | Line-4 | Line-8 | Line-23 | Line-27 | Line-31 | Line-36 | Line-40 | Line-60 | Line-63 |
|---|---|---|---|---|---|---|---|---|---|
| 45 | 3.113 | 2.587 | 3.633 | 3.383 | 2.467 | 3.983 | 3.840 | 2.980 | 2.333 |
| 46 | 63.4 | 42.5 | 79.3 | 78.9 | 73.2 | 58.5 | 70.1 | 76.4 | 57.7 |
| 47 | 130.7 | 116.3 | 106.1 | 107.2 | 102.6 | 131.8 | 127.6 | 113.1 | 123.1 |
| 48 | 9.348 | 4.938 | 9.060 | 11.148 | 9.153 | 11.771 | 10.778 | 8.550 | 9.386 |
| 49 | 7.993 | 6.791 | 5.907 | 9.199 | 6.525 | 10.775 | 12.870 | 7.317 | 8.329 |
| 50 | 6.899 | 5.770 | 4.947 | 5.459 | 5.255 | 9.495 | 11.271 | 6.033 | 6.199 |
| 51 | 0.188 | 0.141 | 0.291 | 0.355 | 0.321 | 0.169 | 0.173 | 0.225 | 0.424 |
| 52 | 0.0333 | 0.0273 | 0.0450 | 0.0594 | 0.0528 | 0.0281 | 0.0387 | 0.0469 | 0.0681 |
| 53 | 18.92 | 28.23 | 21.62 | 22.47 | 25.26 | 14.66 | 27.86 | 28.93 | 21.01 |

Table 215. Provided are the values of each of the parameters (as described above) measured in wheat accessions ("L" = Line). Growth conditions are specified in the experimental procedure section. "NA" = not available."Corr."—correlation.

TABLE 216

Measured parameters in additional Wheat accessions under normal growth conditions

| Line/Corr. ID | Line-68 | Line-74 | Line-75 | Line-87 | Line-100 | Line-107 | Line-118 | Line-129 | Line-134 |
|---|---|---|---|---|---|---|---|---|---|
| 1 | 75.68 | 92.96 | 61.62 | 64.40 | 72.70 | 84.76 | 63.27 | 55.16 | 83.90 |
| 2 | 43.695 | 39.709 | 40.901 | 38.616 | 40.864 | 31.194 | 40.414 | 39.068 | 42.290 |
| 3 | 5.031 | 5.355 | 3.845 | 2.995 | 5.111 | 3.821 | 6.104 | 3.987 | 6.352 |
| 4 | 5.649 | 3.329 | 5.380 | 6.082 | 9.563 | 8.829 | 5.997 | 6.744 | 4.466 |
| 5 | 2.857 | 3.171 | 1.695 | 1.708 | 2.424 | 1.551 | 2.650 | 1.935 | 3.494 |
| 6 | 2.749 | 1.671 | 1.830 | 2.397 | 3.048 | 2.271 | 2.091 | 2.305 | 1.940 |
| 7 | 19.01 | 20.09 | 16.13 | 17.64 | 17.45 | 18.73 | 18.41 | 17.08 | 17.96 |
| 8 | 90.50 | 93.37 | 85.94 | 94.89 | 88.16 | 94.68 | 91.23 | 88.62 | 87.16 |
| 9 | 9.988 | 9.644 | 7.432 | 9.172 | 9.408 | 10.700 | 10.892 | 9.541 | 10.586 |
| 10 | 1.704 | 1.762 | 1.684 | 1.691 | 1.712 | 1.619 | 1.651 | 1.657 | 1.816 |
| 11 | 0.185 | 0.189 | 0.179 | 0.172 | 0.173 | 0.149 | 0.174 | 0.165 | 0.194 |
| 12 | 336.75 | 377.75 | 358.92 | 344.25 | 366.85 | 371.83 | 358.45 | 432.70 | 282.88 |
| 13 | 0.6603 | 0.7007 | 0.6577 | 0.6766 | 0.6847 | 0.6636 | 0.6405 | 0.6580 | 0.7336 |
| 14 | 0.3765 | 0.3584 | 0.3610 | 0.3383 | 0.3370 | 0.2990 | 0.3697 | 0.3390 | 0.3556 |
| 15 | 45.48 | 62.53 | 32.83 | 33.96 | 33.97 | 25.57 | 41.96 | 26.68 | 51.20 |
| 16 | 2.397 | 3.139 | 2.051 | 1.925 | 1.945 | 1.532 | 2.286 | 1.559 | 2.843 |
| 17 | 9.560 | 11.600 | 6.977 | 5.830 | 5.707 | 5.474 | 8.463 | 6.100 | 9.665 |
| 18 | 8.222 | 9.976 | 6.000 | 5.014 | 4.908 | 4.708 | 7.278 | 5.246 | 8.312 |
| 19 | 1.970 | 2.391 | 1.293 | 1.278 | 1.358 | 0.795 | 1.628 | 1.028 | 2.127 |
| 20 | 0.3769 | 0.4967 | 0.3767 | 0.2567 | 0.2390 | 0.1958 | 0.3424 | 0.2352 | 0.4410 |
| 21 | 2.215 | 1.310 | 2.040 | 2.135 | 2.440 | 2.210 | 1.885 | 2.430 | 1.840 |
| 22 | 56.24 | 68.24 | 32.83 | 34.30 | 33.57 | 31.60 | 49.78 | 35.88 | 56.85 |
| 23 | 0.1353 | 0.1190 | 0.1270 | 0.1307 | 0.1490 | 0.1378 | 0.0935 | 0.1290 | 0.1350 |
| 24 | 0.2166 | 0.2036 | 0.2165 | 0.2475 | 0.2540 | 0.2825 | 0.2476 | 0.2400 | 0.2597 |
| 25 | 0.3233 | 0.2670 | 0.2850 | 0.3103 | 0.3930 | 0.3490 | 0.2140 | 0.3045 | 0.3290 |
| 26 | 0.570 | 0.533 | 0.568 | 0.664 | 0.674 | 0.737 | 0.647 | 0.602 | 0.685 |
| 27 | 140.0 | 128.0 | 124.0 | 137.0 | 139.4 | 148.5 | 137.4 | 137.6 | 131.0 |
| 28 | 177.0 | 170.5 | 166.8 | 175.8 | 182.8 | 182.3 | 179.4 | 183.4 | 173.0 |
| 29 | 168.0 | 162.5 | 154.6 | 167.0 | 169.4 | 175.3 | 167.8 | 172.0 | 158.8 |
| 30 | 2.944 | 4.297 | 2.149 | 1.823 | 3.274 | 2.910 | 2.425 | 1.771 | 4.201 |
| 31 | 41.05 | 30.85 | 38.67 | 41.78 | 42.23 | 39.78 | 31.46 | 36.07 | 32.98 |
| 32 | 2.931 | 3.054 | 2.459 | 2.615 | 2.740 | 2.586 | 2.590 | 2.597 | 2.455 |
| 33 | 0.1566 | 0.0629 | 0.1843 | 0.1326 | 0.1810 | 0.1536 | 0.1131 | 0.1521 | 0.0821 |
| 34 | 8.406 | 11.662 | 7.542 | 7.321 | 7.937 | 8.695 | 11.244 | 6.241 | 12.124 |
| 35 | 9.114 | 12.104 | 8.485 | 9.126 | 8.853 | 9.911 | 9.883 | 7.662 | 10.187 |
| 36 | 1.342 | 1.446 | 1.292 | 1.123 | 1.204 | 1.193 | 1.612 | 1.123 | 1.707 |
| 37 | 1.092 | 1.128 | 1.078 | 0.910 | 1.044 | 0.995 | 1.329 | 0.941 | 1.446 |
| 38 | 21.00 | 21.49 | 18.80 | 18.59 | 19.91 | 19.87 | 20.25 | 19.58 | 20.62 |
| 39 | 3.530 | 1.520 | 1.175 | 1.177 | 2.271 | 1.975 | 1.906 | 1.085 | 1.480 |
| 40 | 2.053 | 1.827 | 2.707 | 1.693 | 2.573 | 3.183 | 2.572 | 2.463 | 2.300 |
| 41 | 104.53 | 77.26 | 119.44 | 133.29 | 136.31 | 124.29 | 106.89 | 123.76 | 83.26 |
| 42 | 4.375 | 4.878 | 3.689 | 4.135 | 4.017 | 3.696 | 4.130 | 3.981 | 3.220 |
| 43 | 76.16 | 77.76 | 84.07 | 75.85 | 75.44 | 78.44 | 75.38 | 77.36 | 77.09 |
| 44 | 2.600 | 1.933 | 3.333 | 2.500 | 3.031 | 4.150 | 2.450 | 2.433 | 1.867 |
| 45 | 2.233 | 2.133 | 3.160 | 2.717 | 3.667 | 4.250 | 3.296 | 3.697 | 3.367 |
| 46 | 98.5 | 52.6 | 63.0 | 42.7 | 70.5 | 61.5 | 82.4 | 57.6 | 65.4 |
| 47 | 98.3 | 147.7 | 116.0 | 164.8 | 155.0 | 163.8 | 399.1 | 138.2 | 127.3 |
| 48 | 10.681 | 8.683 | 9.225 | 9.077 | 14.673 | 12.650 | 12.101 | 10.731 | 10.818 |
| 49 | 11.396 | 5.760 | 8.000 | 7.719 | 12.699 | 12.645 | 6.994 | 7.724 | 5.553 |
| 50 | 7.866 | 4.240 | 6.825 | 6.542 | 10.428 | 10.670 | 5.088 | 6.639 | 4.073 |

TABLE 216-continued

Measured parameters in additional Wheat accessions under normal growth conditions

| Line/Corr. ID | Line-68 | Line-74 | Line-75 | Line-87 | Line-100 | Line-107 | Line-118 | Line-129 | Line-134 |
|---|---|---|---|---|---|---|---|---|---|
| 51 | 0.353 | 0.336 | 0.219 | 0.196 | 0.196 | 0.208 | 0.280 | 0.183 | 0.379 |
| 52 | 0.0703 | 0.0712 | 0.0432 | 0.0430 | 0.0477 | 0.0355 | 0.0536 | 0.0312 | 0.0643 |
| 53 | 27.89 | 22.60 | 18.83 | 22.35 | 24.96 | 21.18 | 16.82 | 19.28 | 17.89 |

Table 216. Provided are the values of each of the parameters (as described above) measured in wheat accessions ("L" = Line). Growth conditions are specified in the experimental procedure section. "NA" = not available. "Corr."—correlation.

TABLE 217

Measured parameters in additional Wheat accessions under normal growth conditions

| Line/Corr. ID | Line-142 | Line-146 | Line-159 | Line-161 | Line-171 | Line-173 | Line-175 | Line-178 | Line-179 | Line-183 |
|---|---|---|---|---|---|---|---|---|---|---|
| 1 | 70.33 | 63.51 | 67.99 | 75.95 | 96.46 | 71.12 | 96.07 | 95.73 | 74.63 | 80.19 |
| 2 | 46.396 | 42.314 | 44.476 | 38.053 | 48.044 | 40.010 | 47.328 | 43.489 | 48.337 | 47.431 |
| 3 | 3.146 | 2.415 | 6.405 | 3.645 | 5.909 | 2.868 | 7.029 | 6.195 | 5.470 | 5.555 |
| 4 | 6.269 | 5.358 | 7.858 | 6.615 | 3.719 | 5.067 | 4.978 | 4.934 | 5.262 | 4.407 |
| 5 | 1.642 | 1.409 | 1.903 | 2.028 | 2.711 | 1.610 | 2.717 | 2.618 | 3.048 | 2.920 |
| 6 | 2.088 | 1.928 | 2.053 | 2.684 | 1.597 | 2.120 | 1.802 | 1.842 | 2.313 | 2.088 |
| 7 | 16.47 | 17.19 | 16.36 | 18.22 | 17.62 | 19.14 | 18.24 | 17.72 | 19.36 | 19.12 |
| 8 | 91.88 | 91.74 | 90.74 | 81.02 | 87.83 | 92.35 | 88.92 | 90.62 | 92.28 | 87.19 |
| 9 | 8.424 | 9.980 | 8.948 | 9.723 | 9.692 | 10.215 | 9.076 | 9.020 | 10.747 | 10.952 |
| 10 | 1.759 | 1.720 | 1.831 | 1.695 | 1.807 | 1.725 | 1.795 | 1.708 | 1.892 | 1.808 |
| 11 | 0.188 | 0.176 | 0.197 | 0.174 | 0.207 | 0.176 | 0.201 | 0.187 | 0.212 | 0.203 |
| 12 | 343.44 | 372.65 | 302.20 | 405.05 | 448.50 | 300.35 | 363.42 | 343.75 | 197.70 | 356.45 |
| 13 | 0.6980 | 0.6916 | 0.7357 | 0.6742 | 0.7052 | 0.6941 | 0.7000 | 0.6593 | 0.7570 | 0.7098 |
| 14 | 0.3641 | 0.3440 | 0.3544 | 0.3408 | 0.3885 | 0.3362 | 0.3769 | 0.3751 | 0.3700 | 0.3786 |
| 15 | 27.08 | 25.35 | 31.68 | 30.54 | 44.63 | 25.54 | 44.88 | 47.67 | 49.18 | 45.87 |
| 16 | 1.661 | 1.475 | 1.936 | 1.671 | 2.552 | 1.288 | 2.460 | 2.687 | 2.543 | 2.397 |
| 17 | 6.142 | 5.479 | 5.979 | 6.777 | 11.488 | 5.758 | 12.033 | 11.226 | 10.802 | 11.160 |
| 18 | 5.282 | 4.712 | 5.142 | 5.828 | 9.880 | 4.952 | 10.348 | 9.654 | 9.290 | 9.598 |
| 19 | 1.223 | 1.057 | 1.381 | 1.160 | 2.033 | 0.933 | 2.045 | 1.985 | 2.328 | 2.129 |
| 20 | 0.2601 | 0.2741 | 0.3992 | 0.2621 | 0.5019 | 0.2647 | 0.4684 | 0.4472 | 0.4419 | 0.4382 |
| 21 | 1.805 | 2.115 | 1.925 | 2.215 | 1.635 | 2.305 | 1.510 | 1.715 | 2.010 | 1.725 |
| 22 | 36.13 | 32.23 | 35.17 | 39.87 | 67.58 | 33.87 | 70.78 | 66.03 | 63.54 | 65.65 |
| 23 | 0.1370 | 0.1468 | 0.1250 | 0.1357 | 0.1246 | 0.1388 | 0.1260 | 0.1203 | 0.1268 | 0.1278 |
| 24 | 0.2593 | 0.2080 | 0.2068 | 0.2422 | 0.1990 | 0.2590 | 0.2328 | 0.2133 | 0.2056 | 0.2010 |
| 25 | 0.3190 | 0.3710 | 0.3007 | 0.3333 | 0.2940 | 0.3490 | 0.3037 | 0.2845 | 0.3033 | 0.3068 |
| 26 | 0.691 | 0.623 | 0.544 | 0.641 | 0.507 | 0.665 | 0.620 | 0.553 | 0.516 | 0.520 |
| 27 | 141.8 | 137.0 | 127.8 | 140.0 | 116.0 | 140.6 | 127.8 | 128.0 | 140.0 | 131.0 |
| 28 | 179.8 | 178.6 | 170.2 | 177.0 | 163.0 | 178.6 | 168.3 | 170.0 | 171.7 | 174.6 |
| 29 | 169.3 | 168.6 | 154.2 | 171.6 | 154.0 | 166.6 | 161.3 | 160.2 | 159.7 | 163.4 |
| 30 | 2.868 | 2.049 | 2.733 | 2.805 | 5.937 | 3.020 | 3.390 | 5.554 | 2.884 | 2.583 |
| 31 | 37.36 | 42.74 | 39.01 | 45.06 | 39.34 | 40.03 | 40.06 | NA | 42.71 | 38.47 |
| 32 | 2.573 | 2.660 | 2.511 | 2.943 | 2.888 | 2.213 | 2.754 | NA | 3.265 | 3.067 |
| 33 | 0.1448 | 0.1287 | 0.1513 | 0.1309 | 0.0486 | 0.2053 | 0.1241 | NA | 0.1666 | 0.0777 |
| 34 | 6.766 | 7.258 | 8.234 | 6.678 | 10.681 | 8.093 | 12.476 | 11.403 | 11.778 | 12.753 |
| 35 | 7.829 | 9.208 | 9.678 | 8.045 | 9.827 | 10.472 | 9.948 | 8.604 | 10.918 | 11.104 |
| 36 | 1.199 | 1.116 | 1.208 | 1.166 | 1.638 | 1.056 | 1.794 | 1.869 | 1.595 | 1.714 |
| 37 | 1.001 | 0.908 | 1.024 | 0.965 | 1.310 | 0.879 | 1.476 | 1.579 | 1.280 | 1.365 |
| 38 | 18.01 | 18.74 | 18.04 | 22.43 | 20.04 | 20.66 | 20.53 | 19.55 | 21.01 | 21.96 |
| 39 | 2.661 | 1.506 | 1.733 | 1.309 | 1.393 | 2.584 | 2.477 | NA | 4.889 | 2.085 |
| 40 | 1.960 | 2.007 | 4.116 | 2.273 | 2.373 | 2.319 | 2.733 | 2.490 | 2.167 | 2.040 |
| 41 | 128.30 | 129.54 | 113.05 | 139.09 | 90.72 | 125.02 | 104.32 | NA | 110.38 | 99.82 |
| 42 | 3.895 | 4.048 | 3.815 | 4.269 | 4.503 | 3.397 | 4.140 | NA | 4.561 | 4.313 |
| 43 | 76.60 | 78.30 | 79.30 | 81.19 | 86.38 | 80.25 | 86.04 | 86.76 | 85.32 | 86.96 |
| 44 | 2.760 | 2.833 | 4.225 | 2.533 | 2.650 | 4.595 | 3.295 | NA | 2.322 | 2.117 |
| 45 | 3.133 | 3.332 | 4.673 | 2.678 | 2.520 | 3.344 | 2.867 | 2.723 | 2.507 | 2.413 |
| 46 | 40.3 | 37.0 | 120.9 | 46.0 | 84.4 | 77.5 | 68.6 | 84.2 | 101.5 | 74.2 |
| 47 | 145.8 | 147.9 | 113.7 | 179.3 | 116.7 | 123.5 | 131.4 | 118.0 | 96.1 | 116.9 |
| 48 | 9.415 | 7.773 | 14.263 | 10.260 | 9.628 | 7.935 | 12.007 | 11.129 | 10.277 | 9.961 |
| 49 | 10.805 | 7.806 | 9.949 | 9.531 | 6.707 | 14.149 | 11.903 | NA | 11.791 | 5.647 |
| 50 | 8.144 | 6.300 | 8.216 | 8.222 | 5.450 | 11.565 | 9.426 | NA | 6.902 | 3.562 |
| 51 | 0.231 | 0.173 | 0.226 | 0.222 | 0.302 | 0.226 | 0.355 | 0.349 | 0.573 | 0.348 |
| 52 | 0.0438 | 0.0334 | 0.0530 | 0.0387 | 0.0535 | 0.0360 | 0.0591 | 0.0616 | 0.1226 | 0.0664 |
| 53 | 19.45 | 23.79 | 19.30 | 30.97 | 26.02 | 15.83 | 23.90 | NA | 35.87 | 28.40 |

Table 217. Provided are the values of each of the parameters (as described above) measured in wheat accessions ("L" = Line). Growth conditions are specified in the experimental procedure section. "NA" = not available. "Corr."—correlation.

TABLE 218

Correlation between the expression level of selected genes of some embodiments of the invention in various tissues and the phenotypic performance under normal across wheat accessions

| Gene Name | R | P value | Exp. set | Corr. Set ID | Gene Name | R | P value | Exp. set | Corr. Set ID |
|---|---|---|---|---|---|---|---|---|---|
| LBY214 | 0.78 | 1.24E−04 | 3 | 47 | LBY215 | 0.77 | 2.07E−04 | 3 | 47 |
| LBY222 | 0.71 | 1.14E−04 | 2 | 2 | LBY222 | 0.77 | 1.14E−05 | 2 | 18 |
| LBY222 | 0.75 | 2.42E−05 | 2 | 22 | LBY222 | 0.77 | 1.14E−05 | 2 | 17 |
| LBY222 | 0.70 | 1.78E−04 | 2 | 34 | LBY222 | 0.72 | 7.19E−05 | 2 | 11 |
| LBY225 | 0.74 | 4.90E−04 | 3 | 20 | LBY228 | 0.72 | 7.17E−04 | 3 | 2 |
| LBY228 | 0.83 | 2.45E−05 | 3 | 52 | LBY228 | 0.74 | 4.20E−04 | 3 | 19 |
| LBY228 | 0.76 | 2.38E−04 | 3 | 11 | LBY228 | 0.71 | 1.04E−03 | 3 | 10 |
| LBY228 | 0.74 | 4.64E−04 | 3 | 51 | LBY231 | 0.71 | 8.99E−04 | 3 | 26 |
| LBY231 | 0.73 | 6.60E−04 | 3 | 24 | | | | | |

Table 218. Provided are the correlations (R) between the genes expression levels in various tissues and the phenotypic performance. "Corr. ID"—correlation set ID according to the correlated parameters specified in Table 214. "Exp. Set"—Expression set specified in Table 213. "R" = Pearson correlation coefficient; "P" = p value.

Example 24

Production of Wheat Transcriptome and High Throughput Correlation Analysis Using 60K Wheat Oligonucleotide Micro-Array In order to produce a high throughput correlation analysis comparing between plant phenotype and gene expression level, the present inventors utilized a Wheat oligonucleotide micro-array, produced by Agilent Technologies [chem. (dot) agilent (dot) com/Scripts/PDS (dot) asp?1Page=50879]. The array oligonucleotide represents about 60K Wheat genes and transcripts. In order to define correlations between the levels of RNA expression and yield or vigor related parameters, various plant characteristics of 14 different Wheat accessions were analyzed. Among them, 10 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

14 Wheat accessions in 5 repetitive blocks, each containing 8 plants per pot were grown at net house. Three different treatments were applied: plants were regularly fertilized and watered during plant growth until harvesting under normal conditions [as recommended for commercial growth, plants were irrigated 2-3 times a week, and fertilization was given in the first 1.5 months of the growth period], under low Nitrogen (70% percent less Nitrogen) or under drought stress (cycles of drought and re-irrigating were conducted throughout the whole experiment, overall 40% less water were given in the drought treatment).

Analyzed Wheat tissues—Five tissues at different developmental stages [leaf, stem, root tip and adventitious root, flower], representing different plant characteristics, were sampled and RNA was extracted as described above. Each micro-array expression information tissue type has received a Set ID as summarized in Table 219 below.

TABLE 219

Wheat transcriptome expression sets under normal conditions

| Expression Set | Set ID |
|---|---|
| Adv root, grown under Normal conditions, first tillering stage | 1 |
| Basal lemma, grown under Normal conditions, grain filling stage | 2 |
| Basal spike, grown under Normal conditions, flowering stage | 3 |
| Basal spike, grown under Normal conditions, grain filling stage | 4 |
| Leaf, grown under Normal conditions, flowering stage | 5 |
| Leaf, grown under Normal conditions, grain filling stage | 6 |
| Root tip, grown under Normal conditions, first tillering stage | 7 |
| Stem grown under Normal conditions, flowering stage | 8 |
| Stem, grown under Normal conditions, grain filling stage | 9 |

Table 219. Provided are the wheat transcriptome expression sets under normal conditions.

TABLE 220

Wheat transcriptome expression sets under low N conditions

| Expression Set | Set ID |
|---|---|
| Adv root, grown under Low N conditions, first tillering stage | 1 |
| Basal spike, grown under Low N conditions, flowering stage | 2 |
| Basal spike, grown under Low N conditions, grain filling stage | 3 |
| Leaf, grown under Low N conditions, flowering stage | 4 |
| Leaf, grown under Low N conditions, grain filling stage | 5 |
| Root tip, grown under Low N conditions, first tillering stage | 6 |
| Stem, grown under Low N conditions, flowering stage | 7 |
| Stem grown under Low N conditions, grain filling stage | 8 |

Table 220. Provided are the wheat transcriptome expression sets under low N conditions.

TABLE 221

Wheat transcriptome expression sets low N vs. normal conditions

| Expression Set | Set ID |
|---|---|
| Adv root; grown under Low N vs. normal conditions, first tillering stage | 1 |
| Basal spike; grown under Low N vs. normal conditions, flowering stage | 2 |
| Basal spike; grown under Low N vs. normal conditions, grain filling stage | 3 |
| Leaf; grown under Low N vs. normal conditions, flowering stage | 4 |

TABLE 221-continued

Wheat transcriptome expression sets low N vs. normal conditions

| Expression Set | Set ID |
|---|---|
| Leaf; grown under Low N vs. normal conditions, grain filling stage | 5 |
| Root tip; grown under Low N vs. normal conditions, first tillering stage | 6 |
| Stem; grown under Low N vs. normal conditions, flowering stage | 7 |
| Stem; grown under Low N vs. normal conditions, grain filling stage | 8 |

Table 221. Provided are the wheat transcriptome expression sets at low N versus (vs.) normal conditions.

Wheat yield components and vigor related parameters assessment—Plants were phenotyped on a daily basis following the parameters listed in Tables 222-223 below. Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

Grain yield (gr.)—At the end of the experiment all spikes of the pots were collected. The total grains from all spikes that were manually threshed were weighted. The grain yield was calculated by per plot or per plant.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using measuring tape. Height was measured from ground level to top of the longest spike excluding awns at two time points at the Vegetative growth (30 days after sowing) and at harvest.

Spike weight—The biomass and spikes weight of each plot was separated, measured and divided by the number of plants.

Dry weight—total weight of the vegetative portion above ground (excluding roots) after drying at 70° C. in oven for 48 hours at two time points at the Vegetative growth (30 days after sowing) and at harvest.

Spikelet per spike—number of spikelets per spike was counted.

Root/Shoot Ratio—The Root/Shoot Ratio is calculated using Formula XXII described above.

Total No. of tillers—all tillers were counted per plot at two time points at the Vegetative growth (30 days after sowing) and at harvest.

Node number—number of nodes in the main stem.

Percent of reproductive tillers—was calculated based on Formula XXVI (above).

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—3 plants per plot were selected for measurement of root weight, root length and for counting the number of lateral roots formed.

Shoot FW (fresh weight)—weight of 3 plants per plot were recorded at different time-points.

Average Grain Area ($cm^2$)—At the end of the growing period the grains were separated from the spike. A sample of ~200 grains was weighted, photographed and images were processed using the below described image processing system. The grain area was measured from those images and was divided by the number of grains.

Average Grain Length and width (cm)—At the end of the growing period the grains were separated from the spike. A sample of ~200 grains was weighted, photographed and images were processed using the below described image processing system. The sum of grain lengths or width (longest axis) was measured from those images and was divided by the number of grains.

Average Grain perimeter (cm)—At the end of the growing period the grains were separated from the spike. A sample of ~200 grains was weighted, photographed and images were processed using the below described image processing system. The sum of grain perimeter was measured from those images and was divided by the number of grains.

Heading date—the day in which booting stage was observed was recorded and number of days from sowing to heading was calculated.

Relative water content—Relative water content (RWC) is calculated according to Formula I.

Tiller abortion rate (hd to F)—difference between tiller number at heading and tiller number at flowering divided by tiller number at heading.

Tiller abortion rate—difference between tiller number at harvest and tiller number at flowering divided by tiller number at flowering.

Grain N (H)—% N content of dry matter in the grain at harvest.

Head N (GF)—% N content of dry matter in the head at grain filling.

Total shoot N—calculated as the % N content multiplied by the weight of plant shoot.

Total grain N—calculated as the % N content multiplied by the weight of plant grain yield.

NUE [kg/kg] (N use efficiency)—was calculated based on Formula LI.

NUpE [kg/kg] (N uptake efficiency)—was calculated based on Formula LII.

Grain NUtE (N utilization efficiency)—was calculated based on Formula LV.

Total NUtE—was calculated based on Formula LIII.

Stem Volume—was calculated based on Formula L.

Stem density—was calculated based on Formula LIV.

NHI (N harvest index)—was calculated based on Formula LVI.

BPE (Biomass production efficiency)—was calculated based on Formula LVII.

Grain fill duration—the difference between number of days to maturity and number of days to flowering.

Harvest Index (for Wheat)—The harvest index was calculated using Formula XVIII described above.

Growth rate: the growth rate (GR) of Plant Height (Formula III described above), SPAD (Formula IV described above) and number of tillers (Formula V described above) were calculated with the indicated Formulas.

Specific N absorption—N absorbed per root biomass.

Specific root length—root biomass per root length.

Ratio low N/Normal: Represents ratio for the specified parameter of LowN condition results divided by Normal conditions results (maintenance of phenotype under LowN in comparison to normal conditions).

Data parameters collected are summarized in Tables 222-223, herein below.

TABLE 222

Wheat correlated parameters under normal and low N conditions (vectors)

| Correlation set | Correlation ID |
|---|---|
| 1000 grain weight [gr.] | 1 |
| Avr spike DW (SS) [gr.] | 2 |
| Avr spike DW (flowering) [gr.] | 3 |
| Avr spike weight (harvest) [gr.] | 4 |
| BPE [ratio] | 5 |
| Fertile spikelets ratio [ratio] | 6 |
| Grain area [mm$^2$] | 7 |
| Grain fill duration [days] | 8 |
| Grains per plant [number] | 9 |
| Grains per spike [number] | 10 |
| Grains per spikelet [number] | 11 |
| Grains weight per plant [gr.] | 12 |
| Grains weight per spike [gr.] | 13 |
| Harvest index | 14 |
| Leaf Area [cm$^2$] | 15 |
| Leaf Average Width [cm] | 16 |
| Leaf Length [cm] | 17 |
| Leaf Perimeter [cm] | 18 |
| Leaves num at tillering [number] | 19 |
| Leaves num flowering [number] | 20 |
| N use efficiency [ratio] | 21 |
| NHI [ratio] | 22 |
| Node Num [number] | 23 |
| Num days Heading [days] | 24 |
| Num days to anthesis [days] | 25 |
| NupE [ratio] | 26 |
| Peduncle length [cm] | 27 |
| Peduncle thickness [mm] | 28 |
| Plant height [cm] | 29 |
| RWC [%] | 30 |
| Root length [cm] | 31 |
| Roots DW [gr.] | 32 |
| SPAD early-mid grain filling [SPAD units] | 33 |
| SPAD flowering [SPAD units] | 34 |
| SPAD mid-late grain filling [SPAD] | 35 |
| Seminal roots [number] | 36 |
| Shoot C/N [ratio] | 37 |
| Shoot DW [gr.] | 38 |
| Shoot/Root [ratio] | 39 |
| Spike Area [cm$^2$] | 40 |
| Spike Perimeter [cm] | 41 |
| Spike length [cm] | 42 |
| Spike width [cm] | 43 |
| Spikelets per spike [number] | 44 |
| Tiller abortion rate [ratio] | 45 |
| Tillering (Flowering) [number] | 46 |
| Tillering (Heading) [number] | 47 |
| Tillering (Tillering) [number] | 48 |
| Total dry matter [gr] | 49 |
| Total Leaf Area [cm$^2$] | 50 |
| Vegetative DW (Harvest) [gr.] | 51 |
| field awns length [cm] | 52 |
| Grain C/N [ratio] | 53 |
| grain NUtE [ratio] | 54 |
| grain protein [%] | 55 |
| peduncle volume [cm$^3$] | 56 |
| specific N absorption [mg/gr.] | 57 |
| specific root length [gr./cm] | 58 |
| tiller abortion rate (hd to F) | 59 |

TABLE 222-continued

Wheat correlated parameters under normal and low N conditions (vectors)

| Correlation set | Correlation ID |
|---|---|
| total NUtE [ratio] | 60 |
| total grain N [mg] | 61 |
| total shoot N [mg] | 62 |

Table 222. Provided are the wheat correlated parameters. "TP" = time point; "DW" = dry weight; "FW" = fresh weight; "Low N" = Low Nitrogen; "Relative water content [percent]; "num" = number. "gr." = grams; "cm" = centimeter; "Avr" = average; "RGR' = relative growth rate; "BPE" = biomass production efficiency; "NHI" = Nitrogen harvest index; "NupE" = nitrogen uptake efficiency; "NutE" = nitrogen utilization efficiency; "SPAD" = chlorophyll levels; "F" = flowering stage; "h" = heading stage; "N" = nitrogen.

TABLE 223

Wheat correlated parameters under low N conditions vs. normal (vectors)

| Correlated parameter with | Correlation ID |
|---|---|
| 1000 grain weight [gr.] | 1 |
| BPE [ratio] | 2 |
| Fertile spikelets ratio [ratio] | 3 |
| Grain area [mm$^2$] | 4 |
| Grain fill duration [days] | 5 |
| Grains per spike [number] | 6 |
| Grains per spikelet [number] | 7 |
| Grains weight per spike [gr.] | 8 |
| N use efficiency [ratio] | 9 |
| NHI [ratio] | 10 |
| NupE [ratio] | 11 |
| Peduncle thickness [mm] | 12 |
| Root length [cm] | 13 |
| SPAD early-mid grain filling [SPAD unit] | 14 |
| SPAD flowering [SPAD unit] | 15 |
| Seminal roots [number] | 16 |
| Shoot C/N [ratio] | 17 |
| Spikelets per spike [number] | 18 |
| Tiller abortion rate [ratio] | 19 |
| Grain C/N ratio | 20 |
| Grain NUtE [ratio] | 21 |
| Grain protein [%] | 22 |
| Peduncle volume [cm$^3$] | 23 |
| Specific N absorption [mg/gr] | 24 |
| Specific root length [gr./cm] | 25 |
| Tiller abortion rate (hd to F) [ratio] | 26 |
| Total NUtE [ratio] | 27 |
| Total grain N [mg] | 28 |
| Total shoot N [mg] | 29 |

Table 223. Provided are the wheat correlated parameters. "TP" = time point; "DW" = dry weight; "FW" = fresh weight; "Low N" = Low Nitrogen; "Relative water content [percent]; "num" = number. "gr." = grams; "cm" = centimeter; "Avr" = average; "RGR' = relative growth rate; "BPE" = biomass production efficiency; "NHI" = Nitrogen harvest index; "NupE" = nitrogen uptake efficiency; "NutE" = nitrogen utilization efficiency; "SPAD" = chlorophyll levels; "F" = flowering stage; "h" = heading stage; "N" = nitrogen.

Experimental Results

Fourteen different Wheat accessions were grown and characterized for different parameters as described above. Tables 222-223 describe the wheat correlated parameters. The average for each of the measured parameters was calculated using the JMP software and values are summarized in Tables 224-229 below. Subsequent correlation analysis between the various transcriptome sets and the average parameters was conducted (Tables 230-232). Follow, results were integrated to the database.

TABLE 224

Measured parameters of correlation IDs in wheat accessions under normal conditions

| Line/Corr. ID | Line-1 | Line-2 | Line-3 | Line-4 | Line-5 | Line-6 | Line-7 |
|---|---|---|---|---|---|---|---|
| 1 | 24.81 | 19.31 | 11.63 | 29.68 | 9.24 | 21.05 | 22.14 |
| 2 | 1.515 | 0.838 | 1.489 | 2.643 | 1.230 | 1.445 | 0.665 |
| 3 | 5.669 | 0.275 | 0.312 | 4.283 | 0.364 | 0.236 | NA |
| 4 | 1.356 | 0.893 | 1.414 | 2.510 | 1.014 | 1.565 | 0.506 |
| 5 | 0.581 | 0.364 | 0.338 | 0.466 | 0.370 | 0.611 | NA |
| 6 | 74.09 | 73.31 | 81.68 | 88.72 | NA | 75.72 | NA |
| 7 | 0.199 | 0.165 | 0.153 | 0.184 | 0.170 | 0.191 | 0.137 |
| 8 | 27.89 | 31.43 | NA | 30.02 | NA | 27.75 | NA |
| 9 | 94.23 | 68.65 | 122.44 | 123.90 | 151.23 | 105.13 | 16.30 |
| 10 | 19.69 | 13.29 | 22.77 | 37.16 | 21.52 | 19.41 | 5.98 |
| 11 | 2.166 | 1.264 | 2.186 | 2.932 | NA | 1.641 | NA |
| 12 | 4.536 | 2.749 | 3.756 | 5.934 | 4.316 | 4.862 | 0.476 |
| 13 | 0.950 | 0.531 | 0.696 | 1.739 | 0.590 | 0.897 | 0.133 |
| 14 | 0.483 | 0.317 | 0.276 | 0.490 | 0.257 | 0.345 | 0.046 |
| 15 | 13.80 | 19.54 | NA | 22.46 | NA | 21.61 | NA |
| 16 | 0.858 | 0.916 | NA | 1.262 | NA | 1.054 | NA |
| 17 | 19.65 | 26.79 | NA | 22.03 | NA | 25.53 | NA |
| 18 | 41.46 | 53.77 | NA | 48.92 | NA | 53.08 | NA |
| 19 | 6.60 | 5.60 | 6.20 | 6.60 | 5.80 | 5.60 | 6.40 |
| 20 | 18.00 | 13.00 | 22.50 | 11.50 | 20.75 | 18.50 | NA |
| 21 | 0.045 | 0.027 | 0.038 | 0.059 | 0.043 | 0.049 | 0.005 |
| 22 | 0.481 | 0.306 | 0.242 | 0.433 | 0.260 | 0.448 | NA |
| 23 | 4.00 | 4.43 | 4.50 | 4.94 | 4.27 | 4.56 | NA |
| 24 | 60.22 | 69.88 | 85.25 | 61.78 | 83.00 | 65.78 | 105.00 |
| 25 | 69.11 | 73.00 | 85.25 | 69.56 | 86.38 | 71.25 | 105.00 |
| 26 | 2.50 | 2.49 | 4.26 | 3.59 | 4.70 | 3.33 | NA |
| 27 | 27.28 | 30.39 | 21.21 | 30.71 | 26.15 | 34.07 | NA |
| 28 | 2.61 | 2.72 | 3.53 | 3.31 | 3.22 | 3.07 | NA |
| 29 | 45.59 | 63.41 | 69.33 | 62.91 | 68.03 | 79.43 | NA |
| 30 | 76.29 | NA | 82.03 | 76.11 | NA | 67.30 | NA |
| 31 | 31.10 | 16.20 | 28.10 | 34.06 | 37.84 | 26.88 | 31.98 |
| 32 | 0.89 | 0.07 | 0.20 | 1.01 | 0.36 | 0.50 | 0.63 |
| 33 | 37.33 | 28.34 | NA | 38.71 | NA | 46.47 | NA |
| 34 | 38.75 | 31.09 | 43.30 | 40.29 | 45.54 | 44.93 | NA |
| 35 | 35.97 | NA | NA | 37.21 | NA | NA | NA |
| 36 | 11.20 | 6.00 | 8.00 | 11.00 | 7.80 | 7.80 | 10.20 |
| 37 | 72.05 | 68.35 | 74.91 | 61.34 | 86.58 | 121.52 | NA |
| 38 | 0.641 | 0.250 | 0.457 | 0.557 | 0.429 | 0.369 | 0.580 |
| 39 | 0.724 | 3.466 | 2.301 | 0.552 | 1.180 | 0.740 | 0.920 |
| 40 | 9.52 | 6.27 | 8.42 | 11.73 | 7.03 | 6.51 | 8.96 |
| 41 | 22.34 | 15.81 | 22.47 | 20.86 | 26.69 | 20.43 | 30.39 |
| 42 | 8.48 | 6.51 | 9.54 | 8.14 | 10.29 | 8.51 | 13.41 |
| 43 | 1.39 | 1.18 | 1.12 | 1.68 | 0.83 | 1.02 | 0.89 |
| 44 | 16.24 | 17.22 | 19.40 | 16.93 | NA | 17.42 | NA |
| 45 | 19.58 | −10.00 | 32.58 | −2.31 | 46.10 | 41.28 | NA |
| 46 | 6.00 | 4.75 | 7.75 | 3.25 | 13.13 | 9.75 | NA |
| 47 | 4.00 | 5.89 | 7.00 | 4.24 | 11.25 | 6.86 | 2.80 |
| 48 | 2.60 | 1.80 | 3.40 | 2.00 | 3.40 | 2.40 | 2.80 |
| 49 | 75.26 | 62.94 | 109.09 | 94.88 | 128.46 | 112.16 | 72.40 |
| 50 | 227.54 | 111.47 | NA | 176.24 | NA | 549.02 | NA |
| 51 | 23.35 | 28.68 | 57.53 | 30.57 | 70.98 | 52.25 | 61.70 |
| 52 | 6.46 | 8.45 | 6.33 | 6.56 | NA | 1.20 | NA |
| 53 | 15.38 | 14.73 | 14.86 | 15.39 | 14.46 | 13.33 | NA |
| 54 | 0.04 | 0.02 | 0.01 | 0.03 | 0.01 | 0.03 | NA |
| 55 | 15.12 | 15.79 | 15.61 | 14.94 | 16.13 | 17.49 | NA |
| 56 | 1.46 | 1.76 | 2.08 | 2.64 | 2.13 | 2.51 | NA |
| 57 | 146.26 | 2391.37 | 1626.16 | 201.95 | 956.25 | 367.62 | NA |
| 58 | 0.03 | 0.00 | 0.01 | 0.03 | 0.01 | 0.02 | 0.02 |
| 59 | −50.00 | 19.42 | −10.71 | 23.31 | −16.67 | −42.19 | NA |
| 60 | 0.301 | 0.253 | 0.256 | 0.264 | 0.274 | 0.337 | NA |
| 61 | 120.32 | 76.17 | 102.85 | 155.55 | 122.14 | 149.13 | 0.00 |
| 62 | 129.59 | 172.80 | 322.79 | 203.44 | 347.42 | 183.50 | 0.00 |

Table 224. Provided are the values of each of the parameters (as described above) measured in wheat accessions (Lines). Growth conditions are specified in the experimental procedure section. "NA" = not available. "Corr."—correlation.

TABLE 225

Measured parameters of correlation IDs in additional wheat accessions under normal conditions

| Line/Corr. ID | Line-8 | Line-9 | Line-10 | Line-11 | Line-12 | Line-13 | Line-14 |
|---|---|---|---|---|---|---|---|
| 1 | 15.08 | 13.61 | 20.71 | 33.52 | 16.66 | 12.74 | 13.43 |
| 2 | 1.593 | 1.670 | 1.962 | 2.894 | 1.642 | 0.618 | 0.419 |
| 3 | 0.266 | 0.279 | 0.473 | 9.111 | 5.109 | NA | NA |
| 4 | 1.416 | 1.480 | 2.056 | 2.458 | 1.158 | 0.440 | 0.359 |
| 5 | 0.581 | 0.271 | 0.556 | 0.831 | 0.759 | NA | NA |
| 6 | 83.70 | 87.05 | 78.99 | 86.83 | 75.82 | NA | NA |
| 7 | 0.204 | 0.174 | 0.183 | 0.195 | 0.172 | 0.115 | 0.112 |
| 8 | 32.84 | NA | 29.20 | 27.10 | 26.48 | NA | NA |
| 9 | 106.83 | 103.09 | 141.63 | 139.23 | 85.38 | 13.10 | 18.57 |
| 10 | 20.00 | 23.41 | 30.03 | 34.00 | 18.49 | 5.07 | 6.60 |
| 11 | 1.828 | 1.934 | 2.303 | 2.803 | 2.283 | NA | NA |
| 12 | 5.294 | 4.111 | 6.007 | 6.907 | 3.589 | 0.396 | 2.531 |
| 13 | 0.962 | 0.926 | 1.260 | 1.686 | 0.777 | 0.091 | 0.772 |
| 14 | 0.406 | 0.326 | 0.423 | 0.480 | 0.451 | 0.033 | 0.175 |
| 15 | 25.44 | 23.31 | 20.79 | 16.25 | 13.46 | NA | NA |
| 16 | 1.169 | 1.116 | 1.187 | 1.012 | 0.828 | NA | NA |
| 17 | 27.80 | 25.91 | 21.67 | 19.98 | 19.81 | NA | NA |
| 18 | 58.95 | 54.29 | 46.10 | 42.25 | 40.93 | NA | NA |
| 19 | 5.40 | 5.40 | 5.20 | 6.00 | 6.20 | 5.00 | 5.00 |
| 20 | 11.00 | 23.75 | 19.00 | 12.50 | 18.75 | NA | NA |
| 21 | 0.053 | 0.041 | 0.060 | 0.069 | 0.036 | NA | NA |
| 22 | 0.472 | 0.229 | 0.403 | 0.542 | 0.536 | NA | NA |
| 23 | 4.21 | 4.57 | 4.94 | 4.69 | 3.94 | NA | NA |
| 24 | 68.75 | 74.29 | 68.75 | 58.89 | 57.11 | 106.25 | 77.00 |
| 25 | 71.88 | 78.00 | 72.38 | 67.33 | 68.67 | 105.00 | NA |
| 26 | 3.28 | 4.78 | 3.51 | 3.04 | 1.81 | NA | NA |
| 27 | 29.78 | 25.44 | 27.41 | 28.13 | 21.53 | NA | NA |
| 28 | 3.06 | 3.25 | 3.51 | 3.02 | 1.92 | NA | NA |
| 29 | 61.86 | 62.33 | 59.18 | 55.23 | 44.72 | NA | NA |
| 30 | 73.33 | NA | 70.94 | 80.72 | 74.88 | NA | NA |
| 31 | 23.42 | 36.02 | 38.88 | 37.20 | 33.00 | 22.38 | 34.60 |
| 32 | 0.11 | 0.16 | 0.52 | 1.04 | 0.54 | 0.27 | 0.25 |
| 33 | 38.62 | 35.80 | 45.58 | 46.95 | 35.32 | NA | NA |
| 34 | 38.98 | 36.10 | 46.43 | 42.89 | 34.15 | NA | NA |
| 35 | NA | NA | NA | 46.27 | 35.81 | NA | NA |
| 36 | 6.00 | 6.20 | 8.20 | 10.80 | 7.60 | 6.60 | 7.80 |
| 37 | 95.65 | 54.23 | 88.39 | 110.33 | 103.07 | NA | NA |
| 38 | 0.339 | 0.447 | 0.461 | 0.520 | 0.427 | 0.331 | 0.386 |
| 39 | 3.116 | 2.755 | 0.891 | 0.498 | 0.785 | 1.238 | 1.532 |
| 40 | 9.88 | 9.43 | 10.33 | 12.38 | 9.53 | 7.33 | 8.14 |
| 41 | 20.81 | 20.89 | 21.34 | 22.76 | 18.72 | 22.74 | 27.02 |
| 42 | 8.11 | 8.25 | 8.57 | 9.13 | 7.46 | 9.69 | 11.24 |
| 43 | 1.50 | 1.43 | 1.55 | 1.64 | 1.52 | 1.03 | 0.92 |
| 44 | 16.22 | 17.25 | 18.84 | 19.56 | 16.93 | NA | NA |
| 45 | −25.88 | 34.26 | 27.41 | 1.18 | 25.60 | NA | NA |
| 46 | 4.25 | 6.75 | 6.75 | 4.25 | 6.25 | NA | NA |
| 47 | 5.32 | 5.81 | 4.57 | 3.19 | 3.43 | 1.80 | 2.80 |
| 48 | 2.20 | 1.60 | 1.80 | 1.60 | 2.00 | 1.80 | 2.80 |
| 49 | 100.76 | 100.02 | 116.56 | 115.89 | 63.75 | 71.40 | 109.78 |
| 50 | 431.85 | 231.67 | 188.34 | 186.23 | 269.35 | NA | NA |
| 51 | 39.99 | 47.89 | 44.82 | 37.47 | 20.86 | 63.48 | 102.17 |
| 52 | 8.57 | 7.47 | 7.41 | 6.17 | 5.30 | NA | NA |
| 53 | 13.99 | 15.33 | 17.26 | 17.11 | 15.05 | NA | NA |
| 54 | 0.03 | 0.01 | 0.03 | 0.05 | 0.04 | NA | NA |
| 55 | 16.67 | 15.14 | 13.42 | 13.60 | 15.44 | NA | NA |
| 56 | 2.19 | 2.11 | 2.65 | 2.02 | 0.62 | NA | NA |
| 57 | 1596.15 | 2272.98 | 404.96 | 133.54 | 154.31 | NA | NA |
| 58 | 0.00 | 0.00 | 0.01 | 0.03 | 0.02 | NA | NA |
| 59 | 20.05 | −16.08 | −47.66 | −33.21 | −82.29 | NA | NA |
| 60 | 0.307 | 0.209 | 0.332 | 0.381 | 0.352 | NA | NA |
| 61 | 154.79 | 109.19 | 141.44 | 164.82 | 97.18 | NA | NA |
| 62 | 173.47 | 368.56 | 209.50 | 139.48 | 83.97 | NA | NA |

Table 225. Provided are the values of each of the parameters (as described above) measured in wheat accessions (Lines). Growth conditions are specified in the experimental procedure section. "NA" = not available. "Corr."—correlation.

TABLE 226

Measured parameters of correlation IDs in wheat accessions under low N conditions

| Line/Corr. ID | Line-1 | Line-2 | Line-3 | Line-4 | Line-5 | Line-6 | Line-7 |
|---|---|---|---|---|---|---|---|
| 1 | 14.16 | 25.17 | 14.38 | 31.87 | 16.45 | 17.73 | 18.58 |
| 2 | 3.13 | 2.01 | 3.00 | 5.55 | 1.32 | 3.31 | 0.83 |
| 3 | 0.286 | 0.329 | 0.304 | 0.502 | 0.228 | 0.319 | NA |
| 4 | 1.364 | 0.993 | 1.758 | 2.656 | 1.116 | 1.452 | 0.790 |
| 5 | 0.918 | 0.930 | 0.740 | 1.005 | 0.675 | 0.887 | NA |
| 6 | 71.78 | 67.63 | 90.51 | 86.83 | 85.63 | 86.29 | 90.18 |
| 7 | 0.177 | 0.164 | 0.137 | 0.175 | 0.154 | 0.181 | 0.121 |
| 8 | 27.54 | 31.57 | 27.11 | 33.14 | 22.43 | 33.75 | NA |
| 9 | 78.65 | 67.44 | 95.73 | 71.48 | 81.53 | 70.10 | 23.67 |
| 10 | 25.30 | 20.12 | 39.44 | 43.83 | 21.07 | 24.53 | 8.38 |
| 11 | 2.69 | 1.73 | 2.94 | 3.57 | 1.93 | 2.45 | 0.69 |
| 12 | 3.43 | 2.50 | 2.98 | 3.29 | 2.54 | 2.93 | 1.26 |
| 13 | 1.062 | 0.746 | 1.220 | 2.021 | 0.641 | 0.970 | 0.402 |
| 14 | 0.506 | 0.410 | 0.380 | 0.503 | 0.268 | 0.376 | 0.092 |
| 15 | 15.28 | 20.23 | NA | 11.13 | NA | 15.37 | NA |
| 16 | 0.939 | 1.010 | NA | 0.802 | NA | 0.903 | NA |
| 17 | 20.01 | 24.79 | NA | 16.84 | NA | 21.17 | NA |
| 18 | 43.99 | 53.54 | NA | 35.89 | NA | 43.81 | NA |
| 19 | 6.40 | 6.40 | 6.80 | 6.00 | 6.00 | 6.20 | 5.00 |
| 20 | NA | NA | NA | NA | 6.25 | NA | NA |
| 21 | 0.137 | 0.100 | 0.119 | 0.132 | 0.102 | 0.117 | 0.051 |
| 22 | 0.544 | 0.490 | 0.416 | 0.657 | 0.282 | 0.558 | NA |
| 23 | 4.125 | 4.077 | 4.438 | 4.750 | 3.938 | 3.813 | NA |
| 24 | 57.56 | 67.11 | 76.22 | 61.33 | 80.63 | 65.11 | 109.00 |
| 25 | 68.89 | 73.00 | 77.89 | 68.00 | 82.57 | 71.25 | 105.00 |
| 26 | 5.03 | 3.92 | 6.22 | 6.07 | 7.61 | 5.99 | 0.00 |
| 27 | 25.91 | 39.58 | 44.70 | 32.31 | 20.79 | 43.84 | NA |
| 28 | 2.45 | 2.85 | 3.54 | 3.59 | 2.88 | 3.42 | NA |
| 29 | 47.48 | 81.12 | 85.36 | 61.31 | 62.29 | 94.38 | NA |
| 30 | 78.08 | 75.04 | 84.41 | 84.12 | NA | 82.70 | NA |
| 31 | 34.60 | 33.36 | 33.10 | 32.00 | 38.60 | 41.90 | 36.90 |
| 32 | 0.777 | 0.629 | 0.284 | 1.100 | 0.477 | 0.682 | 0.608 |
| 33 | 41.11 | 26.03 | NA | 38.94 | NA | 38.05 | NA |
| 34 | 40.38 | 32.17 | 38.19 | 42.45 | 37.49 | 42.30 | NA |
| 35 | 33.10 | NA | NA | 32.57 | NA | NA | NA |
| 36 | 11.20 | 8.00 | 10.00 | 9.60 | 7.00 | 8.80 | 8.20 |
| 37 | 137.82 | 165.87 | 187.00 | 144.70 | 183.80 | 182.45 | NA |
| 38 | 0.448 | 0.482 | 0.637 | 0.511 | 0.387 | 0.552 | 0.478 |
| 39 | 0.577 | 0.766 | 2.242 | 0.465 | 0.812 | 0.810 | 0.786 |
| 40 | 8.05 | 5.90 | 7.31 | 11.08 | 8.29 | 7.38 | 9.73 |
| 41 | 18.48 | 15.54 | 19.57 | 19.84 | 23.88 | 20.11 | 32.44 |
| 42 | 7.32 | 6.31 | 8.17 | 7.87 | 10.05 | 8.70 | 14.36 |
| 43 | 1.285 | 1.103 | 1.128 | 1.514 | 1.034 | 1.067 | 0.916 |
| 44 | 16.20 | 16.29 | 17.49 | 16.44 | 17.97 | 16.49 | 20.62 |
| 45 | 17.33 | 36.36 | 46.11 | 33.00 | 51.94 | 53.20 | NA |
| 46 | 3.75 | 5.50 | 4.50 | 2.50 | 7.75 | 6.25 | NA |
| 47 | 4.14 | 4.22 | 4.29 | 3.00 | 6.05 | 5.29 | 2.40 |
| 48 | 1.80 | 2.60 | 4.20 | 1.60 | 3.20 | 2.80 | 2.40 |
| 49 | 52.66 | 46.55 | 67.18 | 52.36 | 92.33 | 58.79 | 89.95 |
| 50 | 201.42 | 190.89 | NA | 182.97 | NA | 148.36 | NA |
| 51 | 19.12 | 19.55 | 40.05 | 17.70 | 59.04 | 28.30 | 74.95 |
| 52 | 5.77 | 7.70 | 6.64 | 6.17 | NA | NA | NA |
| 53 | 26.65 | 22.91 | 23.37 | 24.05 | 32.57 | 23.51 | NA |
| 54 | 0.060 | 0.050 | 0.033 | 0.063 | 0.019 | 0.044 | NA |
| 55 | 8.60 | 9.96 | 9.81 | 9.58 | 7.09 | 9.80 | NA |
| 56 | 1.22 | 2.52 | 4.39 | 3.26 | 1.36 | 4.02 | 0.00 |
| 57 | 161.96 | 155.87 | 547.22 | 138.06 | 399.44 | 219.78 | NA |
| 58 | 0.022 | 0.019 | 0.009 | 0.034 | 0.012 | 0.016 | NA |
| 59 | 9.48 | −30.26 | −5.00 | 16.67 | −28.15 | −18.24 | NA |
| 60 | 0.419 | 0.475 | 0.432 | 0.345 | 0.485 | 0.392 | NA |
| 61 | 68.42 | 48.01 | 64.65 | 99.72 | 53.69 | 83.57 | NA |
| 62 | 57.37 | 50.04 | 90.78 | 52.09 | 136.69 | 66.27 | NA |

Table 226. Provided are the values of each of the parameters (as described above) measured in wheat accessions (Lines). Growth conditions are specified in the experimental procedure section. "NA" = not available. "Cor."—correlation.

TABLE 227

Measured parameters of correlation IDs in additional wheat accessions under low N conditions

| Line/Corr. ID | Line-8 | Line-9 | Line-10 | Line-11 | Line-12 | Line-13 | Line-14 |
|---|---|---|---|---|---|---|---|
| 1 | 15.41 | 9.52 | 24.18 | 25.37 | 13.45 | 21.45 | 15.71 |
| 2 | 2.96 | 3.21 | 5.22 | 5.01 | 2.98 | 1.14 | 0.84 |
| 3 | 0.371 | 0.339 | 0.697 | 0.575 | 0.266 | NA | NA |
| 4 | 1.457 | 1.516 | 2.603 | 2.500 | 1.262 | 1.085 | 0.711 |
| 5 | 0.809 | 0.806 | 0.541 | 0.888 | 0.761 | NA | NA |
| 6 | 78.66 | 79.08 | 80.66 | 80.58 | 75.68 | 83.34 | 81.51 |
| 7 | 0.191 | 0.161 | 0.166 | 0.169 | 0.159 | 0.134 | 0.121 |
| 8 | 31.43 | 31.93 | 31.14 | 30.37 | 27.98 | NA | NA |
| 9 | 57.70 | 74.75 | 83.60 | 81.60 | 73.13 | 67.66 | 24.52 |
| 10 | 19.91 | 24.84 | 46.51 | 40.93 | 22.11 | 22.96 | 7.78 |
| 11 | 1.85 | 2.29 | 3.58 | 3.62 | 2.26 | 2.02 | 0.63 |
| 12 | 2.77 | 2.63 | 3.27 | 3.41 | 2.75 | 1.50 | 0.92 |
| 13 | 0.932 | 0.879 | 1.819 | 1.672 | 0.832 | 0.506 | 0.198 |
| 14 | 0.386 | 0.326 | 0.420 | 0.464 | 0.451 | 0.165 | 0.142 |
| 15 | 13.37 | 18.07 | 14.65 | 16.78 | 12.92 | NA | NA |
| 16 | 0.806 | 0.976 | 0.945 | 0.934 | 0.922 | NA | NA |
| 17 | 19.79 | 22.14 | 19.60 | 22.26 | 18.02 | NA | NA |
| 18 | 41.85 | 46.51 | 45.20 | 46.58 | 38.43 | NA | NA |
| 19 | 5.60 | 5.40 | 6.00 | 6.00 | 6.00 | 5.80 | 5.40 |
| 20 | NA | NA | NA | NA | NA | NA | NA |
| 21 | 0.111 | 0.105 | 0.131 | 0.137 | 0.110 | NA | NA |
| 22 | 0.563 | 0.466 | 0.453 | 0.660 | 0.507 | NA | NA |
| 23 | 3.313 | 4.250 | 3.533 | 4.563 | 4.563 | NA | NA |
| 24 | 65.56 | 70.00 | 66.44 | 58.44 | 53.11 | 103.56 | 109.00 |
| 25 | 71.00 | 72.57 | 73.00 | 67.78 | 68.44 | 101.13 | 105.00 |
| 26 | 6.24 | 6.00 | 8.40 | 7.49 | 5.44 | NA | NA |
| 27 | 42.72 | 37.81 | 32.50 | 27.66 | 24.56 | NA | NA |
| 28 | 3.16 | 3.23 | 3.69 | 3.51 | 2.44 | NA | NA |
| 29 | 74.44 | 80.19 | 64.56 | 61.81 | 54.06 | NA | NA |
| 30 | 72.54 | 53.64 | 84.04 | 79.53 | 86.25 | NA | NA |
| 31 | 32.16 | 32.90 | 37.30 | 36.44 | 27.40 | 32.20 | 33.00 |
| 32 | 0.653 | 0.745 | 1.508 | 1.051 | 0.720 | 0.403 | 0.596 |
| 33 | 32.06 | 31.48 | 41.45 | 45.34 | 35.17 | NA | NA |
| 34 | 38.79 | 36.31 | NA | 45.14 | 34.60 | NA | NA |
| 35 | NA | NA | NA | 37.87 | 29.01 | NA | NA |
| 36 | 9.20 | 8.80 | 11.40 | 10.40 | 10.80 | 7.00 | 7.40 |
| 37 | 134.09 | 149.77 | 92.57 | 132.22 | 122.57 | NA | NA |
| 38 | 0.661 | 0.595 | 0.610 | 0.603 | 0.628 | 0.425 | 0.429 |
| 39 | 1.013 | 0.798 | 0.405 | 0.574 | 0.873 | 1.055 | 0.720 |
| 40 | 8.21 | 7.77 | 10.74 | 10.17 | 7.26 | 7.27 | 9.72 |
| 41 | 18.68 | 18.65 | 20.31 | 18.97 | 16.29 | 21.77 | 30.30 |
| 42 | 7.00 | 6.99 | 8.08 | 7.44 | 6.43 | 9.01 | 13.43 |
| 43 | 1.403 | 1.395 | 1.505 | 1.571 | 1.327 | 1.121 | 1.047 |
| 44 | 15.16 | 17.20 | 18.53 | 18.00 | 17.13 | 18.38 | 18.97 |
| 45 | 35.00 | 52.00 | 44.62 | 31.67 | 16.88 | NA | NA |
| 46 | 4.50 | 6.25 | 3.25 | 3.00 | 4.00 | NA | NA |
| 47 | 4.76 | 3.90 | 3.65 | 3.19 | 4.10 | 3.20 | 2.40 |
| 48 | 3.20 | 2.40 | 2.80 | 2.00 | 2.00 | 3.20 | 2.40 |
| 49 | 55.21 | 64.50 | 62.16 | 56.55 | 51.08 | 84.82 | 91.80 |
| 50 | 100.45 | 237.33 | 109.86 | 273.83 | 230.90 | NA | NA |
| 51 | 22.35 | 28.23 | 24.71 | 19.81 | 19.47 | 63.20 | 75.93 |
| 52 | 9.31 | 7.49 | 5.63 | 5.46 | 4.75 | NA | NA |
| 53 | 24.35 | 23.75 | 25.39 | 22.62 | 20.96 | NA | NA |
| 54 | 0.041 | 0.033 | 0.028 | 0.054 | 0.041 | NA | NA |
| 55 | 9.46 | 9.69 | 9.02 | 10.20 | 10.94 | NA | NA |
| 56 | 3.34 | 3.09 | 3.46 | 2.68 | 1.14 | NA | NA |
| 57 | 238.66 | 201.24 | 139.26 | 178.14 | 188.90 | NA | NA |
| 58 | 0.020 | 0.023 | 0.040 | 0.029 | 0.026 | NA | NA |
| 59 | 5.50 | −60.06 | 10.96 | 5.97 | 2.33 | NA | NA |
| 60 | 0.354 | 0.430 | 0.296 | 0.302 | 0.376 | NA | NA |
| 61 | 87.82 | 69.89 | 95.05 | 123.62 | 68.89 | NA | NA |
| 62 | 68.21 | 80.06 | 114.89 | 63.65 | 67.08 | NA | NA |

Table 227. Provided are the values of each of the parameters (as described above) measured in wheat accessions (Lines). Growth conditions are specified in the experimental procedure section. "NA" = not available. "Cor."—correlation.

TABLE 228

Additional measured parameters of correlation IDs in wheat accessions under low N vs. normal conditions (ratio)

| Line/Corr. ID | Line-1 | Line-2 | Line-3 | Line-4 | Line-5 | Line-6 | Line-7 |
|---|---|---|---|---|---|---|---|
| 1 | 0.57 | 1.30 | 1.24 | 1.07 | 1.78 | 0.84 | 0.84 |
| 2 | 1.580 | 2.555 | 2.190 | 2.155 | 1.827 | 1.451 | NA |
| 3 | 0.969 | 0.922 | 1.108 | 0.979 | NA | 1.140 | NA |
| 4 | 0.889 | 0.990 | 0.897 | 0.948 | 0.905 | 0.950 | 0.880 |
| 5 | 0.987 | 1.005 | NA | 1.104 | NA | 1.216 | NA |
| 6 | 1.28 | 1.51 | 1.73 | 1.18 | 0.98 | 1.26 | 1.40 |
| 7 | 1.24 | 1.37 | 1.34 | 1.22 | NA | 1.49 | NA |
| 8 | 1.12 | 1.41 | 1.75 | 1.16 | 1.09 | 1.08 | 3.03 |
| 9 | 3.026 | 3.634 | 3.170 | 2.217 | 2.354 | 2.408 | 10.621 |
| 10 | 1.130 | 1.601 | 1.721 | 1.516 | 1.084 | 1.244 | NA |
| 11 | 2.013 | 1.575 | 1.461 | 1.691 | 1.622 | 1.802 | NA |
| 12 | 0.939 | 1.049 | 1.001 | 1.084 | 0.895 | 1.114 | NA |
| 13 | 1.113 | 2.059 | 1.178 | 0.940 | 1.020 | 1.559 | 1.154 |
| 14 | 1.101 | 0.918 | NA | 1.006 | NA | 0.819 | NA |
| 15 | 1.042 | 1.035 | 0.882 | 1.054 | 0.823 | 0.941 | NA |
| 16 | 1.000 | 1.333 | 1.250 | 0.873 | 0.897 | 1.128 | 0.804 |
| 17 | 1.913 | 2.427 | 2.496 | 2.359 | 2.123 | 1.501 | NA |
| 18 | 0.997 | 0.946 | 0.901 | NA | 0.971 | 0.946 | NA |
| 19 | 0.885 | −3.636 | 1.415 | −14.300 | 1.127 | 1.289 | NA |
| 20 | 1.733 | 1.556 | 1.572 | 1.563 | 2.252 | 1.764 | NA |
| 21 | 1.709 | 3.138 | 2.818 | 2.165 | 1.496 | 1.667 | NA |
| 22 | 0.569 | 0.630 | 0.629 | 0.641 | 0.440 | 0.560 | NA |
| 23 | 0.838 | 1.432 | 2.113 | 1.236 | 0.636 | 1.598 | NA |
| 24 | 1.107 | 0.065 | 0.337 | 0.684 | 0.418 | 0.598 | NA |
| 25 | 0.788 | 4.227 | 1.215 | 1.162 | 1.286 | 0.876 | NA |
| 26 | −0.190 | −1.558 | 0.467 | 0.715 | 1.689 | 0.432 | NA |
| 27 | 1.390 | 1.878 | 1.686 | 1.305 | 1.773 | 1.164 | NA |
| 28 | 0.569 | 0.630 | 0.629 | 0.641 | 0.440 | 0.560 | NA |
| 29 | 0.443 | 0.290 | 0.281 | 0.256 | 0.393 | 0.361 | NA |

Table 228. Provided are the values of each of the parameters (as described above) measured in wheat accessions (Lines). Growth conditions are specified in the experimental procedure section. "NA" = not available. "Cor."—correlation.

TABLE 229

Additional measured parameters of correlation IDs in wheat accessions under low N vs. normal conditions (ratio)

| Line/Corr. ID | Line-8 | Line-9 | Line-10 | Line-11 | Line-12 | Line-13 | Line-14 |
|---|---|---|---|---|---|---|---|
| 1 | 1.02 | 0.70 | 1.17 | 0.76 | 0.81 | 1.68 | 1.17 |
| 2 | 1.393 | 2.969 | 0.972 | 1.069 | 1.003 | NA | NA |
| 3 | 0.940 | 0.908 | 1.021 | 0.928 | 0.998 | NA | NA |
| 4 | 0.937 | 0.924 | 0.903 | 0.866 | 0.923 | 1.169 | 1.079 |
| 5 | 0.957 | NA | 1.067 | 1.121 | 1.057 | NA | NA |
| 6 | 1.00 | 1.06 | 1.55 | 1.20 | 1.20 | 4.52 | 1.18 |
| 7 | 1.01 | 1.19 | 1.55 | 1.29 | 0.99 | NA | NA |
| 8 | 0.97 | 0.95 | 1.44 | 0.99 | 1.07 | 5.54 | 0.26 |
| 9 | 2.097 | 2.559 | 2.179 | 1.977 | 3.070 | NA | NA |
| 10 | 1.194 | 2.039 | 1.123 | 1.219 | 0.944 | NA | NA |
| 11 | 1.901 | 1.255 | 2.393 | 2.462 | 3.002 | NA | NA |
| 12 | 1.031 | 0.992 | 1.050 | 1.162 | 1.269 | NA | NA |
| 13 | 1.373 | 0.913 | 0.959 | 0.980 | 0.830 | 1.439 | 0.954 |
| 14 | 0.830 | 0.879 | 0.909 | 0.966 | 0.996 | NA | NA |
| 15 | 0.995 | 1.006 | NA | 1.052 | 1.013 | NA | NA |
| 16 | 1.533 | 1.419 | 1.390 | 0.963 | 1.421 | 1.061 | 0.949 |
| 17 | 1.402 | 2.762 | 1.047 | 1.198 | 1.189 | NA | NA |
| 18 | 0.934 | 0.997 | 0.983 | 0.920 | 1.012 | NA | NA |
| 19 | −1.352 | 1.518 | 1.628 | 26.917 | 0.659 | NA | NA |
| 20 | 1.741 | 1.550 | 1.471 | 1.322 | 1.393 | NA | NA |
| 21 | 1.333 | 2.945 | 0.993 | 1.083 | 0.961 | NA | NA |
| 22 | 0.567 | 0.640 | 0.672 | 0.750 | 0.709 | NA | NA |
| 23 | 1.526 | 1.464 | 1.308 | 1.329 | 1.836 | NA | NA |
| 24 | 0.150 | 0.089 | 0.344 | 1.334 | 1.224 | NA | NA |
| 25 | 4.376 | 5.031 | 3.037 | 1.028 | 1.593 | NA | NA |
| 26 | 0.274 | 3.734 | −0.230 | −0.180 | −0.028 | NA | NA |
| 27 | 1.153 | 2.055 | 0.891 | 0.793 | 1.068 | NA | NA |
| 28 | 0.567 | 0.640 | 0.672 | 0.750 | 0.709 | NA | NA |
| 29 | 0.393 | 0.217 | 0.548 | 0.456 | 0.799 | NA | NA |

Table 229. Provided are the values of each of the parameters (as described above) measured in wheat accessions (Lines). Growth conditions are specified in the experimental procedure section. "NA" = not available. "Cor."—correlation

TABLE 230

Correlation between the expression level of selected genes of some embodiments of the invention in various tissues and the phenotypic performance under normal conditions across wheat accessions

| Gene Name | R | P value | Exp. set | Corr. Set ID | Gene Name | R | P value | Exp. set | Corr. Set ID |
|---|---|---|---|---|---|---|---|---|---|
| LBY214 | 0.73 | 2.70E−02 | 3 | 18 | LBY214 | 0.73 | 2.60E−02 | 3 | 17 |
| LBY214 | 0.71 | 2.06E−02 | 1 | 47 | LBY214 | 0.80 | 5.46E−03 | 1 | 29 |
| LBY214 | 0.79 | 6.57E−03 | 1 | 51 | LBY214 | 0.80 | 5.42E−02 | 5 | 37 |
| LBY214 | 0.72 | 1.96E−02 | 6 | 36 | LBY214 | 0.72 | 1.18E−02 | 8 | 54 |
| LBY214 | 0.74 | 9.54E−03 | 8 | 5 | LBY214 | 0.75 | 7.36E−03 | 8 | 60 |
| LBY215 | 0.94 | 4.95E−04 | 2 | 16 | LBY215 | 0.88 | 6.72E−04 | 2 | 12 |
| LBY215 | 0.72 | 2.00E−02 | 2 | 14 | LBY215 | 0.83 | 2.73E−03 | 2 | 56 |
| LBY215 | 0.88 | 6.72E−04 | 2 | 21 | LBY215 | 0.71 | 2.24E−02 | 2 | 43 |
| LBY215 | 0.74 | 1.52E−02 | 2 | 40 | LBY215 | 0.71 | 2.11E−02 | 2 | 2 |
| LBY215 | 0.88 | 8.88E−04 | 2 | 61 | LBY215 | 0.72 | 1.82E−02 | 2 | 7 |
| LBY215 | 0.84 | 8.79E−03 | 2 | 50 | LBY215 | 0.78 | 8.14E−03 | 2 | 13 |
| LBY215 | 0.72 | 1.86E−02 | 2 | 4 | LBY215 | 0.71 | 4.83E−02 | 7 | 15 |
| LBY215 | 0.79 | 1.85E−02 | 7 | 18 | LBY215 | 0.76 | 2.80E−02 | 7 | 17 |
| LBY215 | 0.71 | 2.21E−02 | 7 | 55 | LBY215 | 0.85 | 7.17E−03 | 7 | 50 |
| LBY215 | 0.78 | 4.47E−03 | 3 | 1 | LBY215 | 0.79 | 4.13E−03 | 3 | 32 |
| LBY215 | 0.72 | 1.31E−02 | 3 | 12 | LBY215 | 0.73 | 1.12E−02 | 3 | 14 |
| LBY215 | 0.77 | 5.65E−03 | 3 | 58 | LBY215 | 0.75 | 7.39E−03 | 3 | 3 |
| LBY215 | 0.72 | 1.31E−02 | 3 | 21 | LBY215 | 0.79 | 3.65E−03 | 3 | 43 |
| LBY215 | 0.94 | 2.09E−05 | 3 | 40 | LBY215 | 0.92 | 7.61E−05 | 3 | 2 |
| LBY215 | 0.84 | 1.26E−03 | 3 | 36 | LBY215 | 0.93 | 8.73E−05 | 3 | 11 |
| LBY215 | 0.87 | 4.71E−04 | 3 | 13 | LBY215 | 0.82 | 2.15E−03 | 3 | 4 |
| LBY215 | 0.83 | 1.39E−03 | 3 | 10 | LBY215 | 0.85 | 1.65E−03 | 1 | 46 |
| LBY215 | 0.79 | 6.14E−03 | 1 | 24 | LBY215 | 0.90 | 4.53E−04 | 1 | 47 |
| LBY215 | 0.71 | 2.13E−02 | 1 | 29 | LBY215 | 0.78 | 7.38E−03 | 1 | 25 |
| LBY215 | 0.72 | 1.79E−02 | 1 | 41 | LBY215 | 0.79 | 6.41E−03 | 1 | 42 |
| LBY215 | 0.76 | 1.79E−02 | 1 | 50 | LBY215 | 0.84 | 2.49E−03 | 1 | 49 |
| LBY215 | 0.93 | 7.35E−05 | 1 | 51 | LBY215 | 0.75 | 1.25E−02 | 4 | 32 |
| LBY215 | 0.72 | 1.89E−02 | 4 | 14 | LBY215 | 0.84 | 2.37E−03 | 4 | 58 |
| LBY215 | 0.82 | 3.74E−03 | 4 | 22 | LBY215 | 0.75 | 1.29E−02 | 4 | 7 |

TABLE 230-continued

Correlation between the expression level of selected genes of some embodiments of the invention in various tissues and the phenotypic performance under normal conditions across wheat accessions

| Gene Name | R | P value | Exp. set | Corr. Set ID | Gene Name | R | P value | Exp. set | Corr. Set ID |
|---|---|---|---|---|---|---|---|---|---|
| LBY215 | 0.72 | 4.22E−02 | 4 | 50 | LBY215 | 0.74 | 1.49E−02 | 9 | 37 |
| LBY215 | 0.82 | 4.06E−03 | 9 | 12 | LBY215 | 0.82 | 4.06E−03 | 9 | 21 |
| LBY215 | 0.89 | 1.31E−03 | 9 | 33 | LBY215 | 0.81 | 4.28E−03 | 9 | 61 |
| LBY215 | 0.75 | 2.10E−02 | 9 | 50 | LBY215 | 0.89 | 1.77E−02 | 5 | 1 |
| LBY215 | 0.92 | 9.72E−03 | 5 | 32 | LBY215 | 0.80 | 5.81E−02 | 5 | 14 |
| LBY215 | 0.89 | 1.72E−02 | 5 | 6 | LBY215 | 0.90 | 1.52E−02 | 5 | 58 |
| LBY215 | 0.81 | 5.16E−02 | 5 | 3 | LBY215 | 0.95 | 4.01E−03 | 5 | 43 |
| LBY215 | 0.88 | 1.94E−02 | 5 | 40 | LBY215 | 0.91 | 1.21E−02 | 5 | 2 |
| LBY215 | 0.78 | 6.96E−02 | 5 | 61 | LBY215 | 0.85 | 3.33E−02 | 5 | 36 |
| LBY215 | 0.93 | 6.35E−03 | 5 | 11 | LBY215 | 0.84 | 3.70E−02 | 5 | 13 |
| LBY215 | 0.80 | 5.62E−02 | 5 | 4 | LBY215 | 0.72 | 1.07E−01 | 5 | 19 |
| LBY215 | 0.83 | 4.11E−02 | 5 | 10 | LBY215 | 0.70 | 2.31E−02 | 6 | 37 |
| LBY215 | 0.72 | 1.77E−02 | 6 | 55 | LBY215 | 0.96 | 2.19E−04 | 6 | 50 |
| LBY215 | 0.81 | 2.54E−03 | 8 | 1 | LBY215 | 0.85 | 1.00E−03 | 8 | 32 |
| LBY215 | 0.78 | 4.39E−03 | 8 | 12 | LBY215 | 0.83 | 1.39E−03 | 8 | 14 |
| LBY215 | 0.84 | 1.28E−03 | 8 | 58 | LBY215 | 0.79 | 3.60E−03 | 8 | 3 |
| LBY215 | 0.74 | 9.07E−03 | 8 | 54 | LBY215 | 0.78 | 4.39E−03 | 8 | 21 |
| LBY215 | 0.70 | 1.61E−02 | 8 | 43 | LBY215 | 0.80 | 3.39E−03 | 8 | 40 |
| LBY215 | 0.85 | 9.66E−04 | 8 | 2 | LBY215 | 0.84 | 1.31E−03 | 8 | 36 |
| LBY215 | 0.85 | 2.06E−03 | 8 | 11 | LBY215 | 0.85 | 1.02E−03 | 8 | 13 |
| LBY215 | 0.85 | 9.09E−04 | 8 | 4 | LBY215 | 0.80 | 2.83E−03 | 8 | 10 |
| LBY216 | 0.76 | 2.93E−02 | 2 | 50 | LBY216 | 0.81 | 4.37E−03 | 7 | 36 |
| LBY216 | 0.91 | 2.51E−04 | 4 | 62 | LBY216 | 0.76 | 1.00E−02 | 4 | 24 |
| LBY216 | 0.89 | 5.12E−04 | 4 | 26 | LBY216 | 0.79 | 6.90E−03 | 4 | 25 |
| LBY216 | 0.71 | 2.03E−02 | 4 | 20 | LBY216 | 0.72 | 2.89E−02 | 9 | 15 |
| LBY216 | 0.79 | 7.00E−03 | 9 | 29 | LBY216 | 0.73 | 2.55E−02 | 9 | 18 |
| LBY216 | 0.81 | 7.91E−03 | 9 | 50 | LBY216 | 0.71 | 1.17E−01 | 5 | 3 |
| LBY216 | 0.86 | 2.99E−02 | 5 | 48 | LBY216 | 0.72 | 1.07E−01 | 5 | 22 |
| LBY216 | 0.71 | 5.07E−02 | 6 | 50 | LBY216 | 0.80 | 3.30E−03 | 8 | 24 |
| LBY216 | 0.74 | 8.72E−03 | 8 | 25 | LBY217 | 0.79 | 6.55E−03 | 2 | 27 |
| LBY217 | 0.95 | 3.06E−05 | 4 | 62 | LBY217 | 0.77 | 9.70E−03 | 4 | 24 |
| LBY217 | 0.94 | 4.47E−05 | 4 | 26 | LBY217 | 0.77 | 9.02E−03 | 4 | 25 |
| LBY217 | 0.74 | 1.43E−02 | 4 | 51 | LBY217 | 0.88 | 3.38E−04 | 8 | 62 |
| LBY217 | 0.80 | 3.04E−03 | 8 | 26 | LBY217 | 0.75 | 7.45E−03 | 8 | 25 |
| LBY218 | 0.86 | 1.36E−02 | 2 | 30 | LBY218 | 0.74 | 9.56E−03 | 3 | 32 |
| LBY218 | 0.75 | 7.99E−03 | 3 | 14 | LBY218 | 0.75 | 8.44E−03 | 3 | 58 |
| LBY218 | 0.81 | 2.58E−03 | 3 | 3 | LBY218 | 0.71 | 1.48E−02 | 3 | 54 |
| LBY218 | 0.74 | 9.23E−03 | 3 | 19 | LBY218 | 0.80 | 4.97E−03 | 1 | 1 |
| LBY218 | 0.77 | 8.62E−03 | 1 | 32 | LBY218 | 0.82 | 6.53E−03 | 1 | 6 |
| LBY218 | 0.82 | 3.97E−03 | 1 | 58 | LBY218 | 0.71 | 2.07E−02 | 1 | 3 |
| LBY218 | 0.82 | 3.53E−03 | 1 | 2 | LBY218 | 0.78 | 7.83E−03 | 1 | 36 |
| LBY218 | 0.77 | 1.50E−02 | 1 | 11 | LBY218 | 0.80 | 5.46E−03 | 1 | 13 |
| LBY218 | 0.78 | 7.69E−03 | 1 | 4 | LBY218 | 0.84 | 2.34E−03 | 1 | 19 |
| LBY218 | 0.82 | 3.90E−03 | 1 | 10 | LBY218 | 0.71 | 2.17E−02 | 9 | 55 |
| LBY218 | 0.70 | 1.18E−01 | 5 | 32 | LBY218 | 0.79 | 6.36E−02 | 5 | 14 |
| LBY218 | 0.74 | 9.39E−02 | 5 | 58 | LBY218 | 0.77 | 7.05E−02 | 5 | 3 |
| LBY218 | 0.80 | 5.41E−02 | 5 | 22 | LBY218 | 0.87 | 2.34E−02 | 5 | 19 |
| LBY218 | 0.94 | 5.98E−04 | 6 | 50 | LBY218 | 0.76 | 6.58E−03 | 8 | 1 |
| LBY218 | 0.78 | 4.63E−03 | 8 | 32 | LBY218 | 0.71 | 1.46E−02 | 8 | 14 |
| LBY218 | 0.81 | 2.56E−03 | 8 | 58 | LBY218 | 0.85 | 9.31E−04 | 8 | 3 |
| LBY218 | 0.82 | 1.82E−03 | 8 | 54 | LBY218 | 0.79 | 3.65E−03 | 8 | 22 |
| LBY218 | 0.80 | 3.23E−03 | 8 | 5 | LBY219 | 0.74 | 2.28E−02 | 2 | 44 |
| LBY219 | 0.77 | 9.11E−03 | 7 | 38 | LBY219 | 0.72 | 1.85E−02 | 7 | 36 |
| LBY219 | 0.83 | 5.17E−03 | 7 | 11 | LBY219 | 0.82 | 3.30E−03 | 7 | 19 |
| LBY219 | 0.83 | 3.24E−03 | 1 | 14 | LBY219 | 0.77 | 9.43E−03 | 1 | 54 |
| LBY219 | 0.80 | 4.97E−03 | 1 | 43 | LBY219 | 0.77 | 9.18E−03 | 1 | 40 |
| LBY219 | 0.70 | 2.35E−02 | 1 | 5 | LBY219 | 0.80 | 8.93E−03 | 1 | 11 |
| LBY219 | 0.76 | 1.15E−02 | 9 | 48 | LBY220 | 0.76 | 4.71E−02 | 7 | 30 |
| LBY220 | 0.75 | 1.22E−02 | 1 | 1 | LBY220 | 0.75 | 5.34E−02 | 1 | 30 |
| LBY220 | 0.93 | 8.31E−05 | 1 | 14 | LBY220 | 0.71 | 2.25E−02 | 1 | 3 |
| LBY220 | 0.79 | 6.64E−03 | 1 | 54 | LBY220 | 0.72 | 1.85E−02 | 1 | 22 |
| LBY220 | 0.81 | 4.40E−03 | 1 | 53 | LBY220 | 0.91 | 2.36E−04 | 1 | 43 |
| LBY220 | 0.90 | 4.20E−04 | 1 | 40 | LBY220 | 0.81 | 4.68E−03 | 1 | 2 |
| LBY220 | 0.90 | 9.18E−04 | 1 | 11 | LBY220 | 0.84 | 2.10E−03 | 1 | 13 |
| LBY220 | 0.77 | 9.01E−03 | 1 | 4 | LBY220 | 0.71 | 2.04E−02 | 1 | 10 |
| LBY220 | 0.70 | 2.34E−02 | 4 | 39 | LBY220 | 0.77 | 2.64E−02 | 9 | 30 |
| LBY220 | 0.71 | 2.08E−02 | 9 | 24 | LBY220 | 0.77 | 9.03E−03 | 9 | 48 |
| LBY220 | 0.79 | 6.15E−03 | 9 | 25 | LBY220 | 0.88 | 2.02E−02 | 5 | 46 |
| LBY220 | 0.78 | 6.81E−03 | 5 | 31 | LBY220 | 0.87 | 2.40E−02 | 5 | 48 |
| LBY220 | 0.74 | 9.23E−02 | 5 | 34 | LBY220 | 0.92 | 9.20E−03 | 5 | 20 |
| LBY220 | 0.87 | 2.26E−02 | 5 | 45 | LBY220 | 0.81 | 1.40E−02 | 6 | 15 |
| LBY220 | 0.74 | 3.64E−02 | 6 | 16 | LBY220 | 0.83 | 2.64E−03 | 6 | 56 |
| LBY220 | 0.77 | 8.69E−03 | 6 | 29 | LBY220 | 0.76 | 2.88E−02 | 6 | 33 |

TABLE 230-continued

Correlation between the expression level of selected genes of some embodiments of the invention in various tissues and the phenotypic performance under normal conditions across wheat accessions

| Gene Name | R | P value | Exp. set | Corr. Set ID | Gene Name | R | P value | Exp. set | Corr. Set ID |
|---|---|---|---|---|---|---|---|---|---|
| LBY220 | 0.71 | 2.26E−02 | 6 | 49 | LBY220 | 0.75 | 7.57E−03 | 8 | 37 |
| LBY220 | 0.72 | 2.83E−02 | 8 | 50 | LBY221 | 0.71 | 1.34E−02 | 3 | 3 |
| LBY221 | 0.78 | 6.91E−02 | 5 | 48 | LBY221 | 0.70 | 1.21E−01 | 5 | 50 |
| LBY222 | 0.78 | 8.27E−03 | 2 | 27 | LBY222 | 0.76 | 3.02E−02 | 2 | 50 |
| LBY222 | 0.74 | 9.74E−03 | 3 | 1 | LBY222 | 0.79 | 4.18E−03 | 3 | 32 |
| LBY222 | 0.77 | 5.53E−03 | 3 | 58 | LBY222 | 0.91 | 1.24E−04 | 3 | 3 |
| LBY222 | 0.81 | 2.62E−03 | 3 | 54 | LBY222 | 0.80 | 3.32E−03 | 3 | 5 |
| LBY222 | 0.74 | 9.56E−03 | 3 | 60 | LBY222 | 0.75 | 1.17E−02 | 1 | 24 |
| LBY222 | 0.74 | 1.37E−02 | 1 | 47 | LBY222 | 0.74 | 1.44E−02 | 1 | 25 |
| LBY222 | 0.71 | 3.23E−02 | 1 | 33 | LBY222 | 0.72 | 1.86E−02 | 1 | 42 |
| LBY222 | 0.70 | 2.37E−02 | 1 | 51 | LBY222 | 0.75 | 1.26E−02 | 4 | 55 |
| LBY222 | 0.84 | 9.19E−03 | 4 | 50 | LBY222 | 0.88 | 1.70E−03 | 9 | 50 |
| LBY222 | 0.71 | 1.16E−01 | 5 | 14 | LBY222 | 0.79 | 6.01E−02 | 5 | 58 |
| LBY222 | 0.71 | 1.12E−01 | 5 | 3 | LBY222 | 0.83 | 4.30E−02 | 5 | 48 |
| LBY222 | 0.76 | 7.95E−02 | 5 | 38 | LBY222 | 0.74 | 9.31E−02 | 5 | 36 |
| LBY222 | 0.96 | 2.14E−03 | 5 | 19 | LBY222 | 0.89 | 2.98E−03 | 6 | 50 |
| LBY222 | 0.70 | 1.64E−02 | 8 | 1 | LBY222 | 0.84 | 1.19E−03 | 8 | 32 |
| LBY222 | 0.73 | 1.15E−02 | 8 | 14 | LBY222 | 0.84 | 1.23E−02 | 8 | 58 |
| LBY222 | 0.83 | 1.56E−03 | 8 | 3 | LBY222 | 0.80 | 3.04E−03 | 8 | 38 |
| LBY222 | 0.74 | 9.40E−03 | 8 | 2 | LBY222 | 0.82 | 2.11E−03 | 8 | 36 |
| LBY222 | 0.83 | 3.00E−03 | 8 | 11 | LBY222 | 0.73 | 1.09E−02 | 8 | 13 |
| LBY222 | 0.84 | 1.27E−03 | 8 | 19 | LBY224 | 0.76 | 1.03E−02 | 2 | 14 |
| LBY224 | 0.84 | 2.57E−03 | 2 | 54 | LBY224 | 0.84 | 2.18E−03 | 2 | 22 |
| LBY224 | 0.70 | 2.34E−02 | 2 | 61 | LBY224 | 0.80 | 5.83E−03 | 2 | 7 |
| LBY224 | 0.79 | 6.49E−03 | 2 | 5 | LBY224 | 0.83 | 1.03E−02 | 2 | 50 |
| LBY224 | 0.72 | 6.86E−02 | 7 | 30 | LBY224 | 0.82 | 6.56E−03 | 7 | 11 |
| LBY224 | 0.72 | 4.21E−02 | 3 | 30 | LBY224 | 0.73 | 1.70E−02 | 1 | 32 |
| LBY224 | 0.82 | 3.79E−03 | 1 | 14 | LBY224 | 0.83 | 2.78E−03 | 1 | 3 |
| LBY224 | 0.88 | 8.49E−04 | 1 | 54 | LBY224 | 0.77 | 8.91E−03 | 1 | 22 |
| LBY224 | 0.85 | 2.02E−03 | 1 | 43 | LBY224 | 0.74 | 1.38E−02 | 1 | 40 |
| LBY224 | 0.79 | 6.69E−03 | 1 | 2 | LBY224 | 0.85 | 1.89E−03 | 1 | 5 |
| LBY224 | 0.72 | 1.87E−02 | 1 | 60 | LBY224 | 0.87 | 2.38E−03 | 1 | 11 |
| LBY224 | 0.75 | 1.20E−02 | 1 | 13 | LBY224 | 0.71 | 2.09E−02 | 1 | 10 |
| LBY224 | 0.79 | 6.71E−03 | 9 | 28 | LBY224 | 0.72 | 1.83E−02 | 9 | 56 |
| LBY224 | 0.84 | 2.39E−03 | 9 | 34 | LBY224 | 0.82 | 3.49E−03 | 9 | 9 |
| LBY224 | 0.72 | 3.03E−03 | 9 | 33 | LBY224 | 0.77 | 9.72E−03 | 9 | 49 |
| LBY224 | 0.74 | 1.43E−02 | 9 | 23 | LBY224 | 0.93 | 6.93E−03 | 5 | 1 |
| LBY224 | 0.83 | 3.89E−02 | 5 | 32 | LBY224 | 0.72 | 1.09E−01 | 5 | 12 |
| LBY224 | 0.70 | 1.19E−01 | 5 | 14 | LBY224 | 0.88 | 2.01E−02 | 5 | 6 |
| LBY224 | 0.77 | 7.12E−02 | 5 | 58 | LBY224 | 0.84 | 3.57E−02 | 5 | 3 |
| LBY224 | 0.71 | 1.15E−01 | 5 | 54 | LBY224 | 0.72 | 1.09E−01 | 5 | 21 |
| LBY224 | 0.80 | 5.69E−02 | 5 | 43 | LBY224 | 0.84 | 3.48E−02 | 5 | 40 |
| LBY224 | 0.91 | 1.27E−02 | 5 | 2 | LBY224 | 0.77 | 7.40E−02 | 5 | 61 |
| LBY224 | 0.72 | 1.05E−01 | 5 | 36 | LBY224 | 0.84 | 3.62E−02 | 5 | 11 |
| LBY224 | 0.84 | 3.82E−02 | 5 | 13 | LBY224 | 0.77 | 7.08E−02 | 5 | 4 |
| LBY224 | 0.75 | 8.35E−02 | 5 | 10 | LBY224 | 0.83 | 2.65E−03 | 6 | 53 |
| LBY225 | 0.72 | 1.96E−02 | 7 | 53 | LBY225 | 0.79 | 1.17E−02 | 7 | 44 |
| LBY225 | 0.80 | 2.88E−03 | 3 | 31 | LBY225 | 0.78 | 4.51E−03 | 3 | 53 |
| LBY225 | 0.89 | 5.46E−04 | 4 | 62 | LBY225 | 0.77 | 2.49E−02 | 4 | 15 |
| LBY225 | 0.81 | 4.33E−03 | 4 | 24 | LBY225 | 0.72 | 6.72E−02 | 4 | 8 |
| LBY225 | 0.82 | 4.01E−03 | 4 | 26 | LBY225 | 0.73 | 1.70E−02 | 4 | 57 |
| LBY225 | 0.78 | 7.51E−03 | 4 | 25 | LBY225 | 0.72 | 1.99E−02 | 4 | 51 |
| LBY225 | 0.78 | 6.53E−02 | 5 | 3 | LBY225 | 0.79 | 6.36E−02 | 5 | 54 |
| LBY225 | 0.86 | 2.84E−02 | 5 | 22 | LBY225 | 0.76 | 8.01E−02 | 5 | 5 |
| LBY225 | 0.82 | 4.68E−02 | 5 | 50 | LBY225 | 0.92 | 8.98E−03 | 5 | 19 |
| LBY225 | 0.83 | 1.60E−03 | 8 | 62 | LBY225 | 0.75 | 7.43E−03 | 8 | 26 |
| LBY225 | 0.72 | 1.23E−02 | 8 | 25 | LBY225 | 0.71 | 1.52E−02 | 8 | 20 |
| LBY227 | 0.71 | 4.85E−02 | 2 | 50 | LBY227 | 0.84 | 1.38E−03 | 3 | 3 |
| LBY227 | 0.76 | 7.06E−03 | 3 | 54 | LBY227 | 0.70 | 1.63E−02 | 3 | 5 |
| LBY227 | 0.78 | 8.25E−03 | 1 | 46 | LBY227 | 0.81 | 4.76E−03 | 1 | 48 |
| LBY227 | 0.80 | 5.58E−03 | 9 | 55 | LBY227 | 0.96 | 4.82E−05 | 9 | 50 |
| LBY227 | 0.74 | 9.25E−02 | 5 | 3 | LBY227 | 0.75 | 8.41E−02 | 5 | 54 |
| LBY227 | 0.81 | 5.23E−02 | 5 | 22 | LBY227 | 0.71 | 2.17E−02 | 6 | 55 |
| LBY227 | 0.92 | 1.09E−03 | 6 | 50 | LBY227 | 0.71 | 1.34E−02 | 8 | 32 |
| LBY227 | 0.88 | 2.96E−04 | 8 | 3 | LBY227 | 0.84 | 1.12E−03 | 8 | 54 |
| LBY227 | 0.72 | 1.17E−02 | 8 | 22 | LBY227 | 0.83 | 1.60E−03 | 8 | 5 |
| LBY227 | 0.74 | 9.40E−03 | 8 | 60 | LBY228 | 0.71 | 1.53E−02 | 3 | 5 |
| LBY228 | 0.83 | 1.10E−02 | 4 | 50 | LBY228 | 0.75 | 1.26E−02 | 9 | 46 |
| LBY230 | 0.79 | 6.04E−03 | 2 | 31 | LBY230 | 0.75 | 2.11E−02 | 7 | 44 |
| LBY230 | 0.75 | 8.50E−03 | 3 | 57 | LBY230 | 0.91 | 2.31E−04 | 1 | 46 |
| LBY230 | 0.72 | 1.92E−02 | 1 | 47 | LBY230 | 0.71 | 2.04E−02 | 1 | 20 |
| LBY230 | 0.77 | 8.94E−03 | 1 | 45 | LBY230 | 0.78 | 7.98E−03 | 4 | 28 |
| LBY230 | 0.76 | 1.09E−02 | 4 | 62 | LBY230 | 0.72 | 1.83E−02 | 4 | 24 |

TABLE 230-continued

Correlation between the expression level of selected genes of some embodiments of the invention in various tissues and the phenotypic performance under normal conditions across wheat accessions

| Gene Name | R | P value | Exp. set | Corr. Set ID | Gene Name | R | P value | Exp. set | Corr. Set ID |
|---|---|---|---|---|---|---|---|---|---|
| LBY230 | 0.72 | 4.36E−02 | 4 | 16 | LBY230 | 0.79 | 6.28E−03 | 4 | 26 |
| LBY230 | 0.71 | 2.07E−02 | 4 | 49 | LBY230 | 0.73 | 1.57E−02 | 4 | 51 |
| LBY230 | 0.73 | 1.03E−01 | 5 | 53 | LBY230 | 0.74 | 9.19E−02 | 5 | 33 |
| LBY230 | 0.82 | 4.60E−02 | 5 | 7 | LBY230 | 0.72 | 1.08E−01 | 5 | 60 |
| LBY230 | 0.80 | 5.76E−02 | 5 | 41 | LBY230 | 0.83 | 4.22E−02 | 5 | 42 |
| LBY230 | 0.73 | 1.65E−02 | 6 | 32 | LBY230 | 0.76 | 1.01E−02 | 6 | 58 |
| LBY230 | 0.75 | 1.21E−02 | 6 | 36 | LBY231 | 0.87 | 1.20E−03 | 7 | 19 |
| LBY231 | 0.73 | 1.13E−02 | 3 | 29 | LBY231 | 0.78 | 1.35E−02 | 3 | 50 |
| LBY231 | 0.77 | 1.42E−02 | 1 | 11 | LBY231 | 0.83 | 2.95E−03 | 9 | 61 |
| LBY231 | 0.77 | 9.13E−03 | 9 | 7 | LBY231 | 0.79 | 6.21E−02 | 5 | 62 |
| LBY231 | 0.74 | 9.49E−02 | 5 | 15 | LBY231 | 0.98 | 6.52E−04 | 5 | 24 |
| LBY231 | 0.81 | 5.18E−02 | 5 | 47 | LBY231 | 0.79 | 6.02E−02 | 5 | 8 |
| LBY231 | 0.78 | 6.82E−02 | 5 | 29 | LBY231 | 0.77 | 7.36E−02 | 5 | 18 |
| LBY231 | 0.90 | 1.35E−02 | 5 | 25 | LBY231 | 0.75 | 8.43E−02 | 5 | 17 |
| LBY231 | 0.90 | 1.39E−02 | 5 | 52 | LBY231 | 0.92 | 4.28E−04 | 6 | 44 |
| LBY231 | 0.75 | 8.36E−03 | 8 | 24 | LBY231 | 0.71 | 1.45E−02 | 8 | 25 |
| LGN1 | 0.73 | 1.64E−02 | 7 | 40 | LGN1 | 0.78 | 7.33E−03 | 7 | 2 |
| LGN1 | 0.82 | 7.07E−03 | 7 | 11 | LGN1 | 0.70 | 2.33E−02 | 7 | 10 |
| LGN1 | 0.72 | 1.90E−02 | 1 | 2 | LGN1 | 0.83 | 5.45E−03 | 1 | 11 |
| LGN1 | 0.72 | 1.89E−02 | 1 | 13 | LGN1 | 0.82 | 3.70E−03 | 1 | 10 |
| LGN1 | 0.80 | 5.93E−03 | 4 | 37 | LGN1 | 0.77 | 8.63E−03 | 4 | 54 |
| LGN1 | 0.80 | 5.20E−03 | 4 | 22 | LGN1 | 0.86 | 1.59E−03 | 4 | 5 |
| LGN1 | 0.80 | 5.26E−03 | 4 | 60 | LGN1 | 0.71 | 4.70E−02 | 4 | 50 |
| LGN1 | 0.75 | 8.63E−03 | 5 | 28 | LGN1 | 0.82 | 4.40E−02 | 5 | 62 |
| LGN1 | 0.87 | 2.57E−02 | 5 | 15 | LGN1 | 0.83 | 4.12E−02 | 5 | 24 |
| LGN1 | 0.87 | 2.60E−02 | 5 | 16 | LGN1 | 0.76 | 7.94E−02 | 5 | 8 |
| LGN1 | 0.76 | 7.64E−02 | 5 | 56 | LGN1 | 0.91 | 1.13E−02 | 5 | 29 |
| LGN1 | 0.76 | 7.73E−02 | 5 | 26 | LGN1 | 0.81 | 4.85E−02 | 5 | 18 |
| LGN1 | 0.74 | 9.17E−02 | 5 | 25 | LGN1 | 0.75 | 8.79E−02 | 5 | 17 |
| LGN1 | 0.75 | 8.86E−02 | 5 | 52 | LGN1 | 0.76 | 7.83E−02 | 5 | 23 |
| LGN1 | 0.85 | 1.44E−02 | 6 | 8 | LGN1 | 0.77 | 1.46E−02 | 6 | 44 |

Table 230. Provided are the correlations (R) between the genes expression levels in various tissues and the phenotypic performance. "Corr. ID"—correlation set ID according to the correlated parameters specified in Table 222. "Exp. Set"—Expression set specified in Table 219. "R" = Pearson correlation coefficient; "P" = p value.

TABLE 231

Correlation between the expression level of selected genes of some embodiments of the invention in various tissues and the phenotypic performance under low N conditions across wheat accessions

| Gene Name | R | P value | Exp. set | Corr. Set ID | Gene Name | R | P value | Exp. set | Corr. Set ID |
|---|---|---|---|---|---|---|---|---|---|
| LBY214 | 0.73 | 1.12E−02 | 2 | 5 | LBY214 | 0.72 | 2.99E−02 | 2 | 50 |
| LBY214 | 0.75 | 5.45E−02 | 3 | 19 | LBY214 | 0.70 | 2.32E−02 | 5 | 34 |
| LBY214 | 0.72 | 1.32E−02 | 8 | 43 | LBY214 | 0.81 | 2.45E−03 | 8 | 7 |
| LBY214 | 0.77 | 8.48E−03 | 7 | 55 | LBY214 | 0.72 | 1.07E−01 | 4 | 1 |
| LBY214 | 0.79 | 6.03E−02 | 4 | 22 | LBY214 | 0.74 | 9.32E−02 | 4 | 50 |
| LBY214 | 0.79 | 5.96E−02 | 4 | 23 | LBY214 | 0.76 | 6.33E−03 | 1 | 22 |
| LBY214 | 0.76 | 6.78E−03 | 1 | 7 | LBY215 | 0.75 | 7.41E−03 | 5 | 22 |
| LBY215 | 0.71 | 1.54E−02 | 8 | 61 | LBY215 | 0.73 | 1.75E−02 | 7 | 43 |
| LBY215 | 0.85 | 3.35E−02 | 4 | 30 | LBY215 | 0.71 | 1.11E−01 | 4 | 57 |
| LBY215 | 0.74 | 9.00E−02 | 4 | 55 | LBY215 | 0.70 | 1.21E−01 | 4 | 39 |
| LBY215 | 0.71 | 3.14E−02 | 1 | 18 | LBY216 | 0.81 | 2.79E−02 | 3 | 32 |
| LBY216 | 0.72 | 6.81E−02 | 3 | 58 | LBY216 | 0.76 | 4.76E−02 | 3 | 3 |
| LBY216 | 0.70 | 7.69E−02 | 3 | 10 | LBY216 | 0.72 | 1.91E−02 | 7 | 48 |
| LBY216 | 0.81 | 1.59E−02 | 7 | 52 | LBY216 | 0.70 | 1.20E−01 | 4 | 55 |
| LBY216 | 0.82 | 2.01E−03 | 6 | 46 | LBY216 | 0.73 | 1.07E−02 | 6 | 37 |
| LBY216 | 0.75 | 7.38E−03 | 6 | 47 | LBY216 | 0.75 | 7.61E−03 | 6 | 31 |
| LBY216 | 0.74 | 8.59E−03 | 6 | 42 | LBY216 | 0.74 | 9.35E−03 | 6 | 51 |
| LBY217 | 0.78 | 3.69E−02 | 3 | 24 | LBY217 | 0.94 | 1.58E−03 | 3 | 31 |
| LBY217 | 0.72 | 6.83E−02 | 3 | 53 | LBY217 | 0.80 | 3.24E−02 | 3 | 45 |
| LBY217 | 0.82 | 2.48E−02 | 3 | 41 | LBY217 | 0.78 | 3.98E−02 | 3 | 42 |
| LBY217 | 0.72 | 6.99E−02 | 3 | 49 | LBY217 | 0.76 | 7.15E−02 | 5 | 47 |
| LBY217 | 0.70 | 2.32E−02 | 7 | 62 | LBY217 | 0.76 | 1.09E−02 | 7 | 26 |
| LBY217 | 0.71 | 1.38E−02 | 6 | 24 | LBY217 | 0.72 | 1.17E−02 | 6 | 25 |
| LBY218 | 0.74 | 9.74E−03 | 2 | 14 | LBY218 | 0.72 | 1.16E−02 | 2 | 54 |
| LBY218 | 0.76 | 1.64E−02 | 2 | 50 | LBY218 | 0.92 | 7.40E−05 | 2 | 23 |
| LBY218 | 0.75 | 8.22E−03 | 8 | 57 | LBY218 | 0.90 | 1.54E−04 | 8 | 39 |

TABLE 231-continued

Correlation between the expression level of selected genes of some embodiments of the invention in various tissues and the phenotypic performance under low N conditions across wheat accessions

| Gene Name | R | P value | Exp. set | Corr. Set ID | Gene Name | R | P value | Exp. set | Corr. Set ID |
|---|---|---|---|---|---|---|---|---|---|
| LBY218 | 0.71 | 1.16E−01 | 4 | 12 | LBY218 | 0.92 | 1.05E−02 | 4 | 14 |
| LBY218 | 0.78 | 6.54E−02 | 4 | 54 | LBY218 | 0.84 | 3.85E−02 | 4 | 22 |
| LBY218 | 0.71 | 1.16E−01 | 4 | 21 | LBY218 | 0.74 | 9.53E−02 | 4 | 7 |
| LBY218 | 0.72 | 1.04E−01 | 4 | 5 | LBY218 | 0.82 | 4.73E−02 | 4 | 23 |
| LBY218 | 0.81 | 2.56E−03 | 1 | 14 | LBY218 | 0.77 | 5.67E−03 | 1 | 54 |
| LBY218 | 0.70 | 1.63E−02 | 6 | 54 | LBY218 | 0.89 | 1.41E−03 | 6 | 50 |
| LBY219 | 0.77 | 5.37E−03 | 2 | 62 | LBY219 | 0.74 | 8.97E−03 | 2 | 24 |
| LBY219 | 0.72 | 1.33E−02 | 2 | 6 | LBY219 | 0.75 | 7.98E−03 | 2 | 45 |
| LBY219 | 0.84 | 1.13E−03 | 2 | 41 | LBY219 | 0.84 | 1.11E−03 | 2 | 42 |
| LBY219 | 0.71 | 1.35E−02 | 2 | 49 | LBY219 | 0.74 | 8.75E−03 | 2 | 51 |
| LBY219 | 0.70 | 7.86E−02 | 3 | 47 | LBY219 | 0.88 | 9.63E−03 | 3 | 57 |
| LBY219 | 0.70 | 7.97E−02 | 3 | 49 | LBY219 | 0.80 | 3.05E−02 | 3 | 19 |
| LBY219 | 0.74 | 5.97E−02 | 3 | 51 | LBY219 | 0.84 | 1.14E−03 | 8 | 19 |
| LBY219 | 0.89 | 1.68E−02 | 4 | 55 | LBY219 | 0.75 | 7.56E−03 | 1 | 14 |
| LBY219 | 0.73 | 1.07E−02 | 1 | 2 | LBY219 | 0.74 | 9.63E−03 | 1 | 36 |
| LBY219 | 0.74 | 9.16E−03 | 6 | 8 | LBY219 | 0.82 | 1.98E−03 | 6 | 26 |
| LBY219 | 0.73 | 1.09E−02 | 6 | 2 | LBY220 | 0.76 | 1.86E−02 | 2 | 15 |
| LBY220 | 0.71 | 1.43E−02 | 2 | 48 | LBY220 | 0.72 | 1.17E−02 | 2 | 57 |
| LBY220 | 0.75 | 1.96E−02 | 2 | 18 | LBY220 | 0.75 | 7.50E−03 | 2 | 9 |
| LBY220 | 0.79 | 1.15E−02 | 2 | 17 | LBY220 | 0.89 | 2.26E−04 | 2 | 39 |
| LBY220 | 0.73 | 9.85E−02 | 3 | 16 | LBY220 | 0.75 | 8.50E−02 | 3 | 18 |
| LBY220 | 0.71 | 1.50E−02 | 5 | 62 | LBY220 | 0.80 | 2.87E−03 | 5 | 32 |
| LBY220 | 0.77 | 5.72E−03 | 5 | 58 | LBY220 | 0.78 | 4.95E−03 | 5 | 3 |
| LBY220 | 0.75 | 7.98E−03 | 5 | 40 | LBY220 | 0.77 | 5.42E−03 | 5 | 9 |
| LBY220 | 0.70 | 1.61E−02 | 5 | 2 | LBY220 | 0.77 | 5.94E−03 | 5 | 13 |
| LBY220 | 0.74 | 8.98E−03 | 5 | 4 | LBY220 | 0.73 | 1.12E−02 | 5 | 10 |
| LBY220 | 0.74 | 2.40E−02 | 8 | 16 | LBY220 | 0.71 | 1.41E−02 | 8 | 39 |
| LBY220 | 0.75 | 3.16E−02 | 7 | 16 | LBY220 | 0.78 | 8.16E−03 | 7 | 48 |
| LBY220 | 0.78 | 8.05E−03 | 7 | 57 | LBY220 | 0.87 | 1.23E−03 | 7 | 39 |
| LBY220 | 0.76 | 8.01E−02 | 4 | 12 | LBY220 | 0.76 | 8.01E−02 | 4 | 21 |
| LBY220 | 0.79 | 6.29E−02 | 4 | 9 | LBY220 | 0.85 | 3.03E−02 | 4 | 33 |
| LBY220 | 0.73 | 9.78E−02 | 4 | 36 | LBY220 | 0.76 | 6.54E−03 | 1 | 3 |
| LBY220 | 0.72 | 1.33E−02 | 1 | 38 | LBY220 | 0.72 | 1.28E−02 | 1 | 36 |
| LBY220 | 0.71 | 3.15E−02 | 6 | 52 | LBY221 | 0.76 | 1.66E−02 | 2 | 50 |
| LBY221 | 0.73 | 1.00E−01 | 3 | 16 | LBY221 | 0.74 | 9.31E−02 | 3 | 52 |
| LBY221 | 0.77 | 1.60E−02 | 5 | 15 | LBY221 | 0.79 | 1.10E−02 | 5 | 16 |
| LBY221 | 0.84 | 3.55E−02 | 4 | 12 | LBY221 | 0.74 | 9.17E−02 | 4 | 31 |
| LBY221 | 0.92 | 9.15E−03 | 4 | 53 | LBY221 | 0.84 | 3.55E−02 | 4 | 21 |
| LBY221 | 0.83 | 4.17E−02 | 4 | 7 | LBY221 | 0.74 | 9.60E−02 | 4 | 41 |
| LBY221 | 0.74 | 8.93E−02 | 4 | 42 | LBY221 | 0.74 | 8.78E−03 | 1 | 7 |
| LBY222 | 0.75 | 8.45E−03 | 2 | 14 | LBY222 | 0.70 | 1.65E−02 | 2 | 54 |
| LBY222 | 0.77 | 5.36E−03 | 2 | 22 | LBY222 | 0.80 | 5.59E−02 | 3 | 50 |
| LBY222 | 0.70 | 7.85E−02 | 3 | 23 | LBY222 | 0.71 | 1.13E−01 | 4 | 37 |
| LBY222 | 0.83 | 4.29E−02 | 4 | 54 | LBY222 | 0.97 | 9.79E−04 | 4 | 22 |
| LBY222 | 0.83 | 4.28E−02 | 4 | 5 | LBY222 | 0.76 | 7.99E−02 | 4 | 50 |
| LBY222 | 0.93 | 6.33E−03 | 4 | 23 | LBY222 | 0.85 | 3.82E−03 | 1 | 15 |
| LBY222 | 0.72 | 2.93E−02 | 1 | 18 | LBY222 | 0.84 | 4.94E−03 | 1 | 17 |
| LBY222 | 0.83 | 6.02E−03 | 1 | 50 | LBY222 | 0.82 | 6.45E−03 | 6 | 33 |
| LBY222 | 0.70 | 1.57E−02 | 6 | 45 | LBY222 | 0.80 | 2.81E−03 | 6 | 41 |
| LBY222 | 0.84 | 1.34E−03 | 6 | 42 | LBY222 | 0.78 | 4.98E−03 | 6 | 49 |
| LBY222 | 0.71 | 1.47E−02 | 6 | 51 | LBY222 | 0.87 | 1.05E−02 | 3 | 46 |
| LBY224 | 0.77 | 4.40E−02 | 3 | 37 | LBY224 | 0.75 | 5.31E−02 | 3 | 24 |
| LBY224 | 0.93 | 2.37E−03 | 3 | 47 | LBY224 | 0.94 | 1.71E−03 | 3 | 57 |
| LBY224 | 0.84 | 1.73E−02 | 3 | 53 | LBY224 | 0.83 | 2.16E−02 | 3 | 25 |
| LBY224 | 0.72 | 6.85E−02 | 3 | 60 | LBY224 | 0.73 | 6.25E−02 | 3 | 42 |
| LBY224 | 0.85 | 1.47E−02 | 3 | 49 | LBY224 | 0.91 | 4.12E−03 | 3 | 51 |
| LBY224 | 0.81 | 2.68E−03 | 8 | 28 | LBY224 | 0.75 | 7.86E−03 | 8 | 6 |
| LBY224 | 0.74 | 9.32E−03 | 8 | 13 | LBY224 | 0.71 | 1.52E−02 | 8 | 4 |
| LBY224 | 0.84 | 1.17E−03 | 8 | 10 | LBY224 | 0.71 | 2.27E−02 | 7 | 57 |
| LBY224 | 0.81 | 4.82E−02 | 4 | 14 | LBY224 | 0.86 | 2.79E−02 | 4 | 57 |
| LBY224 | 0.73 | 9.62E−02 | 4 | 36 | LBY224 | 0.77 | 7.54E−02 | 4 | 59 |
| LBY224 | 0.74 | 9.92E−03 | 1 | 14 | LBY224 | 0.72 | 1.25E−02 | 1 | 36 |
| LBY225 | 0.76 | 6.91E−03 | 2 | 28 | LBY225 | 0.72 | 1.32E−02 | 2 | 8 |
| LBY225 | 0.74 | 8.83E−03 | 2 | 45 | LBY225 | 0.77 | 5.15E−03 | 2 | 41 |
| LBY225 | 0.73 | 6.37E−02 | 3 | 45 | LBY225 | 0.82 | 1.81E−03 | 5 | 56 |
| LBY225 | 0.74 | 8.75E−03 | 5 | 27 | LBY225 | 0.73 | 1.09E−02 | 5 | 10 |
| LBY225 | 0.81 | 4.65E−03 | 7 | 32 | LBY225 | 0.82 | 3.55E−03 | 7 | 12 |
| LBY225 | 0.77 | 9.29E−03 | 7 | 3 | LBY225 | 0.85 | 4.10E−03 | 7 | 34 |
| LBY225 | 0.82 | 3.55E−03 | 7 | 21 | LBY225 | 0.93 | 7.80E−04 | 7 | 33 |
| LBY225 | 0.82 | 3.62E−03 | 7 | 2 | LBY225 | 0.74 | 1.45E−02 | 7 | 61 |
| LBY225 | 0.85 | 1.77E−03 | 7 | 11 | LBY225 | 0.74 | 1.40E−02 | 7 | 13 |
| LBY225 | 0.75 | 1.29E−02 | 7 | 4 | LBY225 | 0.70 | 2.38E−02 | 7 | 10 |
| LBY225 | 0.78 | 6.57E−02 | 4 | 14 | LBY225 | 0.78 | 6.60E−02 | 4 | 54 |

TABLE 231-continued

Correlation between the expression level of selected genes of some embodiments of the invention in various tissues and the phenotypic performance under low N conditions across wheat accessions

| Gene Name | R | P value | Exp. set | Corr. Set ID | Gene Name | R | P value | Exp. set | Corr. Set ID |
|---|---|---|---|---|---|---|---|---|---|
| LBY225 | 0.97 | 1.16E−03 | 4 | 22 | LBY225 | 0.73 | 9.98E−02 | 4 | 50 |
| LBY225 | 0.87 | 2.28E−02 | 4 | 23 | LBY225 | 0.82 | 2.08E−03 | 6 | 42 |
| LBY227 | 0.72 | 2.74E−02 | 2 | 50 | LBY227 | 0.77 | 5.57E−03 | 2 | 23 |
| LBY227 | 0.77 | 4.38E−02 | 3 | 14 | LBY227 | 0.78 | 3.93E−02 | 3 | 54 |
| LBY227 | 0.72 | 7.04E−02 | 3 | 55 | LBY227 | 0.76 | 6.91E−03 | 5 | 39 |
| LBY227 | 0.72 | 1.07E−01 | 4 | 57 | LBY227 | 0.77 | 7.06E−02 | 4 | 50 |
| LBY227 | 0.79 | 5.99E−02 | 4 | 23 | LBY227 | 0.79 | 3.97E−03 | 1 | 54 |
| LBY227 | 0.74 | 9.50E−03 | 1 | 22 | LBY227 | 0.77 | 5.20E−03 | 1 | 5 |
| LBY230 | 0.86 | 1.27E−02 | 3 | 1 | LBY230 | 0.72 | 6.83E−02 | 3 | 32 |
| LBY230 | 0.77 | 4.32E−02 | 3 | 3 | LBY230 | 0.70 | 1.54E−02 | 8 | 32 |
| LBY230 | 0.72 | 1.22E−02 | 8 | 58 | LBY230 | 0.72 | 1.21E−02 | 8 | 3 |
| LBY230 | 0.71 | 1.39E−02 | 8 | 40 | LBY230 | 0.77 | 5.39E−03 | 8 | 2 |
| LBY230 | 0.84 | 1.19E−03 | 8 | 11 | LBY230 | 0.87 | 5.05E−04 | 8 | 13 |
| LBY230 | 0.81 | 2.52E−03 | 8 | 4 | LBY230 | 0.87 | 4.87E−04 | 8 | 10 |
| LBY230 | 0.85 | 7.36E−03 | 7 | 15 | LBY230 | 0.71 | 5.03E−02 | 7 | 16 |
| LBY230 | 0.83 | 1.02E−02 | 7 | 18 | LBY230 | 0.83 | 1.15E−02 | 7 | 17 |
| LBY230 | 0.89 | 6.17E−04 | 7 | 60 | LBY230 | 0.70 | 3.54E−02 | 1 | 50 |
| LBY230 | 0.74 | 8.60E−03 | 1 | 23 | LBY231 | 0.72 | 1.26E−02 | 2 | 39 |
| LBY231 | 0.72 | 1.25E−02 | 5 | 28 | LBY231 | 0.86 | 7.90E−04 | 5 | 10 |
| LBY231 | 0.78 | 4.79E−03 | 8 | 27 | LBY231 | 0.81 | 5.10E−02 | 4 | 9 |
| LBY231 | 0.95 | 3.52E−03 | 4 | 36 | LBY231 | 0.70 | 1.19E−01 | 4 | 49 |
| LBY231 | 0.72 | 1.31E−02 | 1 | 32 | LBY231 | 0.72 | 1.32E−02 | 1 | 58 |
| LBY231 | 0.78 | 4.54E−03 | 1 | 3 | LBY231 | 0.80 | 3.00E−03 | 1 | 40 |
| LBY231 | 0.85 | 8.93E−04 | 1 | 2 | LBY231 | 0.86 | 7.08E−04 | 1 | 11 |
| LBY231 | 0.92 | 5.09E−05 | 1 | 13 | LBY231 | 0.89 | 2.60E−04 | 1 | 4 |
| LBY231 | 0.91 | 1.13E−04 | 1 | 10 | LBY231 | 0.83 | 1.47E−03 | 6 | 12 |
| LBY231 | 0.83 | 1.47E−03 | 6 | 21 | LBY231 | 0.86 | 7.26E−04 | 6 | 43 |
| LBY231 | 0.82 | 7.06E−03 | 6 | 33 | LBY231 | 0.78 | 4.28E−03 | 6 | 2 |
| LBY231 | 0.82 | 1.94E−03 | 6 | 61 | LBY231 | 0.77 | 5.29E−03 | 6 | 36 |
| LBY231 | 0.77 | 5.60E−03 | 6 | 11 | LBY231 | 0.72 | 1.33E−02 | 6 | 13 |
| LBY231 | 0.74 | 8.92E−03 | 6 | 4 | LGN1 | 0.77 | 4.50E−02 | 3 | 39 |
| LGN1 | 0.82 | 1.80E−03 | 5 | 48 | LGN1 | 0.87 | 4.53E−04 | 5 | 57 |
| LGN1 | 0.74 | 9.56E−03 | 5 | 9 | LGN1 | 0.88 | 3.77E−04 | 5 | 39 |
| LGN1 | 0.74 | 9.20E−03 | 8 | 57 | LGN1 | 0.80 | 2.86E−03 | 8 | 9 |
| LGN1 | 0.72 | 1.22E−02 | 8 | 44 | LGN1 | 0.75 | 1.21E−02 | 7 | 48 |
| LGN1 | 0.79 | 6.71E−03 | 7 | 57 | LGN1 | 0.90 | 3.51E−04 | 7 | 39 |
| LGN1 | 0.95 | 3.79E−03 | 4 | 30 | LGN1 | 0.84 | 3.81E−02 | 4 | 6 |
| LGN1 | 0.73 | 9.62E−02 | 4 | 58 | LGN1 | 0.89 | 1.64E−02 | 4 | 22 |
| LGN1 | 0.77 | 7.10E−02 | 4 | 43 | LGN1 | 0.73 | 1.03E−01 | 4 | 2 |
| LGN1 | 0.79 | 5.96E−02 | 4 | 61 | LGN1 | 0.76 | 8.00E−02 | 4 | 23 |
| LGN1 | 0.75 | 7.80E−03 | 1 | 58 | | | | | |

Table 231. Provided are the correlations (R) between the genes expression levels in various tissues and the phenotypic performance. "Corr. ID"—correlation set ID according to the correlated parameters specified in Table 222. "Exp. Set"—Expression set specified in Table 220. "R" = Pearson correlation coefficient; "P" = p value

TABLE 232

Correlation between the expression level of selected genes of some embodiments of the invention in various tissues and the phenotypic performance under low N vs. normal (ratio) conditions across wheat accessions

| Gene Name | R | P value | Exp. set | Corr. Set ID | Gene Name | R | P value | Exp. set | Corr. Set ID |
|---|---|---|---|---|---|---|---|---|---|
| LBY214 | 0.71 | 1.37E−02 | 2 | 9 | LBY214 | 0.70 | 1.55E−02 | 2 | 2 |
| LBY214 | 0.80 | 3.13E−03 | 2 | 21 | LBY214 | 0.95 | 8.68E−04 | 3 | 9 |
| LBY214 | 0.71 | 7.53E−02 | 3 | 4 | LBY214 | 0.70 | 7.98E−02 | 3 | 13 |
| LBY214 | 0.76 | 4.82E−02 | 3 | 8 | LBY214 | 0.73 | 6.16E−02 | 3 | 6 |
| LBY214 | 0.73 | 1.73E−02 | 7 | 12 | LBY214 | 0.77 | 1.53E−02 | 6 | 14 |
| LBY215 | 0.91 | 7.19E−04 | 2 | 14 | LBY215 | 0.73 | 6.16E−02 | 3 | 11 |
| LBY215 | 0.80 | 3.21E−02 | 3 | 29 | LBY215 | 0.82 | 2.52E−02 | 3 | 12 |
| LBY215 | 0.73 | 6.37E−02 | 3 | 23 | LBY215 | 0.80 | 3.33E−03 | 8 | 29 |
| LBY215 | 0.88 | 2.06E−02 | 4 | 11 | LBY215 | 0.90 | 1.34E−02 | 4 | 29 |
| LBY215 | 0.79 | 6.24E−02 | 4 | 12 | LBY215 | 0.70 | 1.20E−01 | 4 | 23 |
| LBY216 | 0.76 | 6.34E−03 | 2 | 29 | LBY216 | 0.91 | 1.22E−02 | 3 | 7 |
| LBY216 | 0.84 | 1.82E−02 | 3 | 8 | LBY216 | 0.84 | 1.75E−02 | 3 | 6 |
| LBY216 | 0.72 | 1.04E−01 | 4 | 11 | LBY216 | 0.80 | 5.48E−02 | 4 | 29 |
| LBY216 | 0.76 | 7.67E−02 | 4 | 12 | LBY216 | 0.74 | 9.51E−02 | 4 | 23 |
| LBY216 | 0.72 | 1.34E−02 | 1 | 6 | LBY216 | 0.75 | 8.50E−03 | 6 | 20 |
| LBY217 | 0.81 | 5.25E−02 | 3 | 7 | LBY217 | 0.81 | 2.51E−03 | 6 | 1 |

TABLE 232-continued

Correlation between the expression level of selected genes of some embodiments of the invention in various tissues and the phenotypic performance under low N vs. normal (ratio) conditions across wheat accessions

| Gene Name | R | P value | Exp. set | Corr. Set ID | Gene Name | R | P value | Exp. set | Corr. Set ID |
|---|---|---|---|---|---|---|---|---|---|
| LBY218 | 0.72 | 1.23E−02 | 2 | 24 | LBY218 | 0.80 | 9.86E−03 | 2 | 14 |
| LBY218 | 0.78 | 6.89E−02 | 3 | 14 | LBY218 | 0.94 | 5.37E−03 | 3 | 18 |
| LBY218 | 0.76 | 1.08E−02 | 7 | 12 | LBY218 | 0.77 | 7.56E−02 | 4 | 24 |
| LBY218 | 0.77 | 7.26E−02 | 4 | 14 | LBY218 | 0.81 | 4.85E−03 | 1 | 15 |
| LBY218 | 0.87 | 2.13E−03 | 1 | 14 | LBY218 | 0.84 | 4.77E−03 | 6 | 14 |
| LBY218 | 0.76 | 7.22E−03 | 6 | 19 | LBY219 | 0.74 | 5.78E−02 | 3 | 13 |
| LBY219 | 0.91 | 2.87E−04 | 5 | 18 | LBY219 | 0.76 | 7.07E−03 | 8 | 9 |
| LBY219 | 0.94 | 5.86E−03 | 4 | 12 | LBY219 | 0.71 | 1.15E−01 | 4 | 28 |
| LBY219 | 0.71 | 1.15E−01 | 4 | 22 | LBY219 | 0.95 | 3.47E−03 | 4 | 23 |
| LBY220 | 0.72 | 1.22E−02 | 2 | 8 | LBY220 | 0.85 | 1.55E−02 | 3 | 13 |
| LBY220 | 0.78 | 4.01E−02 | 3 | 8 | LBY220 | 0.72 | 6.67E−02 | 3 | 6 |
| LBY220 | 0.73 | 1.09E−02 | 8 | 9 | LBY220 | 0.71 | 2.08E−02 | 7 | 9 |
| LBY220 | 0.82 | 4.68E−02 | 4 | 24 | LBY220 | 0.87 | 2.55E−02 | 4 | 19 |
| LBY220 | 0.76 | 6.81E−03 | 1 | 6 | LBY221 | 0.72 | 1.24E−02 | 2 | 24 |
| LBY221 | 0.73 | 1.14E−02 | 2 | 19 | LBY221 | 0.84 | 1.87E−02 | 3 | 9 |
| LBY221 | 0.74 | 5.57E−02 | 3 | 17 | LBY221 | 0.75 | 5.41E−02 | 3 | 2 |
| LBY221 | 0.85 | 1.46E−02 | 3 | 21 | LBY221 | 0.81 | 1.47E−02 | 6 | 5 |
| LBY222 | 0.79 | 3.89E−03 | 2 | 11 | LBY222 | 0.79 | 3.83E−03 | 2 | 24 |
| LBY222 | 0.75 | 1.31E−02 | 2 | 15 | LBY222 | 0.85 | 9.33E−04 | 2 | 12 |
| LBY222 | 0.77 | 4.12E−02 | 3 | 26 | LBY222 | 0.82 | 3.59E−03 | 7 | 24 |
| LBY222 | 0.89 | 3.38E−03 | 7 | 14 | LBY222 | 0.92 | 1.26E−03 | 6 | 5 |
| LBY224 | 0.95 | 1.30E−03 | 3 | 20 | LBY224 | 0.84 | 1.07E−01 | 5 | 10 |
| LBY224 | 0.78 | 4.87E−03 | 5 | 2 | LBY224 | 0.73 | 1.11E−02 | 8 | 8 |
| LBY224 | 0.82 | 1.23E−02 | 7 | 14 | LBY224 | 0.85 | 3.28E−02 | 4 | 11 |
| LBY224 | 0.82 | 4.64E−02 | 4 | 29 | LBY224 | 0.87 | 2.52E−02 | 4 | 24 |
| LBY224 | 0.74 | 9.14E−02 | 4 | 12 | LBY224 | 0.89 | 1.71E−02 | 4 | 14 |
| LBY224 | 0.77 | 7.51E−02 | 4 | 26 | LBY224 | 0.71 | 1.44E−02 | 1 | 11 |
| LBY224 | 0.81 | 7.47E−03 | 1 | 14 | LBY225 | 0.73 | 1.08E−02 | 2 | 19 |
| LBY225 | 0.71 | 7.36E−02 | 3 | 26 | LBY225 | 0.72 | 1.23E−02 | 5 | 10 |
| LBY225 | 0.74 | 2.21E−02 | 7 | 7 | LBY225 | 0.81 | 5.33E−02 | 4 | 5 |
| LBY225 | 0.73 | 1.02E−02 | 1 | 23 | LBY225 | 0.90 | 3.91E−04 | 6 | 3 |
| LBY225 | 0.72 | 1.95E−02 | 6 | 7 | LBY225 | 0.74 | 8.76E−03 | 6 | 8 |
| LBY227 | 0.76 | 6.16E−03 | 2 | 24 | LBY227 | 0.80 | 2.87E−03 | 2 | 12 |
| LBY227 | 0.83 | 4.14E−02 | 3 | 15 | LBY227 | 0.83 | 3.06E−03 | 7 | 12 |
| LBY227 | 0.88 | 2.14E−02 | 4 | 24 | LBY227 | 0.75 | 8.92E−02 | 4 | 12 |
| LBY227 | 0.76 | 1.00E−02 | 1 | 15 | LBY228 | 0.84 | 1.33E−03 | 8 | 13 |
| LBY228 | 0.76 | 6.12E−03 | 6 | 4 | LBY230 | 0.91 | 1.22E−02 | 3 | 7 |
| LBY230 | 0.84 | 1.81E−02 | 3 | 8 | LBY230 | 0.91 | 4.56E−03 | 3 | 6 |
| LBY230 | 0.70 | 1.57E−02 | 5 | 13 | LBY230 | 0.75 | 1.19E−02 | 7 | 27 |
| LBY230 | 0.76 | 7.81E−02 | 4 | 14 | LBY231 | 0.79 | 1.93E−02 | 2 | 5 |
| LBY231 | 0.84 | 2.43E−03 | 2 | 3 | LBY231 | 0.87 | 1.05E−02 | 3 | 13 |
| LBY231 | 0.90 | 6.48E−03 | 3 | 8 | LBY231 | 0.83 | 2.14E−02 | 3 | 6 |
| LBY231 | 0.75 | 7.68E−03 | 5 | 8 | LBY231 | 0.70 | 1.55E−02 | 5 | 6 |
| LBY231 | 0.76 | 6.93E−03 | 8 | 8 | LBY231 | 0.70 | 1.62E−02 | 8 | 21 |
| LBY231 | 0.76 | 6.13E−03 | 8 | 6 | LBY231 | 0.78 | 6.85E−02 | 4 | 11 |
| LBY231 | 0.77 | 7.28E−02 | 4 | 29 | LGN1 | 0.76 | 7.09E−03 | 2 | 8 |
| LGN1 | 0.74 | 5.49E−02 | 3 | 29 | LGN1 | 0.75 | 5.32E−02 | 3 | 12 |
| LGN1 | 0.84 | 1.26E−03 | 5 | 8 | LGN1 | 0.77 | 8.93E−03 | 7 | 8 |
| LGN1 | 0.86 | 2.74E−02 | 4 | 5 | LGN1 | 0.93 | 8.06E−03 | 4 | 3 |
| LGN1 | 0.78 | 6.88E−02 | 4 | 26 | LGN1 | 0.76 | 6.71E−03 | 6 | 13 |

Table 232. Provided are the correlations (R) between the genes expression levels in various tissues and the phenotypic performance. "Corr. ID"—correlation set ID according to the correlated parameters specified in Table 223. "Exp. Set"—Expression set specified in Table 221. "R" = Pearson correlation coefficient; "P" = p value.

Example 25

Gene Cloning and Generation of Binary Vectors for Plant Expression

To validate their role in improving yield, selected genes were over-expressed in plants, as follows.

Cloning Strategy

Selected genes from those presented in Examples 1-24 hereinabove were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves, roots or other plant tissues, growing under normal/limiting or stress conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York) which are well known to those skilled in the art. PCR products were purified using PCR purification kit (Qiagen).

Usually, 2 sets of primers were prepared for the amplification of each gene, via nested PCR (if required). Both sets of primers were used for amplification on a cDNA. In case no product was obtained, a nested PCR reaction was performed. Nested PCR was performed by amplification of the gene using external primers and then using the produced PCR product as a template for a second PCR reaction, where the internal set of primers were used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc) according to the sites designed in the primers. Each digested/undigested PCR product was inserted into a high copy vector pUC19 (New England BioLabs Inc], or into plasmids originating from this vector. In some cases the undigested PCR product was inserted into pCR-Blunt II-TOPO (Invitrogen) or into pJET1.2 (CloneJET PCR Cloning Kit, Thermo Scientific) or directly into the binary vector. The digested/undigested products and the linearized plasmid vector were ligated using T4 DNA ligase enzyme (Roche, Switzerland or other manufacturers). In cases where pCR-Blunt II-TOPO is used no T4 ligase is needed.

Sequencing of the inserted genes was performed, using the ABI 377 sequencer (Applied Biosystems). In some cases, after confirming the sequences of the cloned genes, the cloned cDNA was introduced into a modified pGI binary vector containing the At6669 promoter (e.g., pQFNc or pQsFN) and the NOS terminator (SEQ ID NO: 10665) via digestion with appropriate restriction endonucleases.

Several DNA sequences of the selected genes were synthesized by GeneArt (Life Technologies, Grand Island, N.Y., USA). Synthetic DNA was designed in silico. Suitable restriction enzymes sites were added to the cloned sequences at the 5' end and at the 3' end to enable later cloning into the desired binary vector.

Binary vectors—The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI is similar to pPI, but the original gene in the backbone is GUS-Intron and not GUS.

Figure 11:
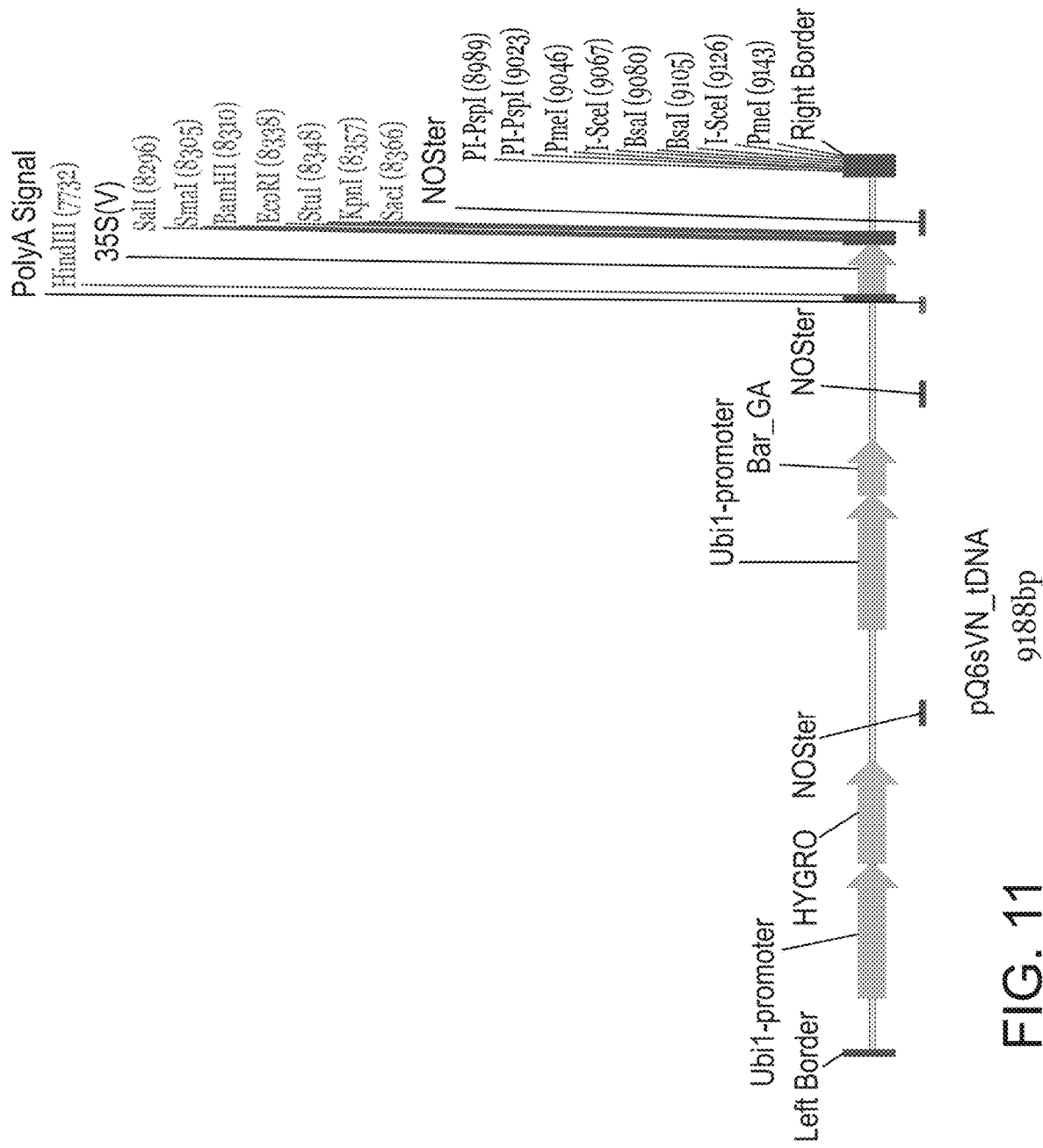
FIG. 11 is a schematic illustration of the pQ6sVN plasmid. pQ6sVN was used for expression of the isolated polynucleotide sequences of some embodiments of the invention in *Brachypodium*. "35S(V)"=35S promoter (SEQ ID NO:10666); "NOS ter"=nopaline synthase terminator; "Bar_GA"=BAR open reading frame optimized for expression in *Brachypodium* (SEQ ID NO: 11335); "Hygro"=Hygromycin resistance gene. "Ubi1 promoter"=10640; The isolated polynucleotide sequences of some embodiments of the invention were cloned into the Multiple cloning site of the vector (downstream of the "35S(V)" promoter) using one or more of the indicated restriction enzyme sites.
Figure 12:
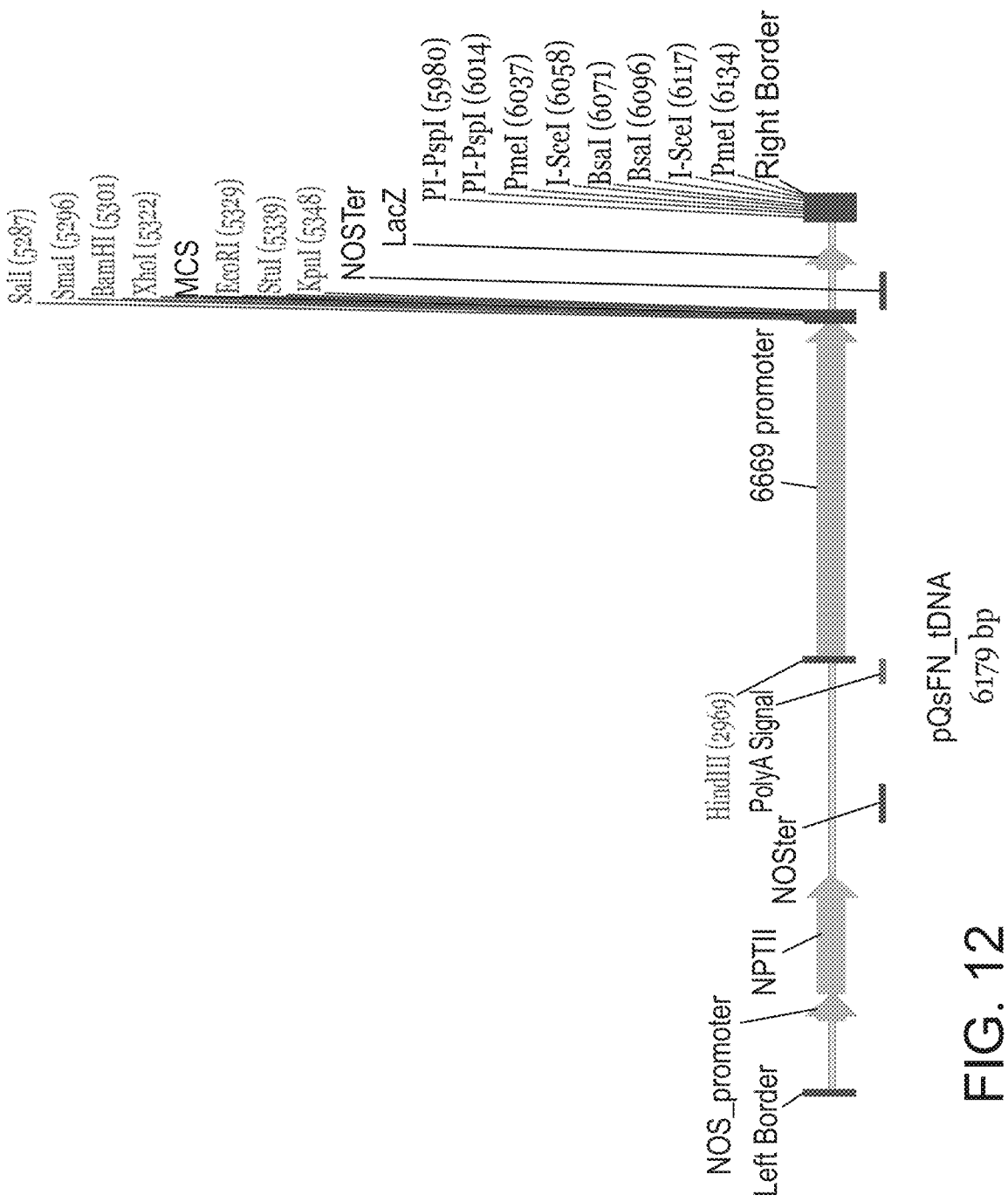
FIG. 12 is a schematic illustration of the pQsFN plasmid containing the new At6669 promoter (SEQ ID NO: 10654) used for expression the isolated polynucleotide sequences of the invention in *Arabidopsis*. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); The isolated polynucleotide sequences of the invention were cloned into the MCS of the vector.

The modified pGI vector (e.g., pQFN, pQFNc, pQYN_6669, pQNa_RP, pQFYN, pQXNc, pQ6sVN (FIG. 11) or pQsFN (FIG. 12)) is a modified version of the pGI vector in which the cassette is inverted between the left and right borders so the gene and its corresponding promoter are close to the right border and the NPTII gene is close to the left border.

At6669, the new *Arabidopsis thaliana* promoter sequence (SEQ ID NO: 10654) was inserted in the modified pGI binary vector, upstream to the cloned genes, followed by DNA ligation and binary plasmid extraction from positive *E. coli* colonies, as described above. Colonies were analyzed by PCR using the primers covering the insert which were designed to span the introduced promoter and gene. Positive plasmids were identified, isolated and sequenced.

In case of *Brachypodium* transformation, after confirming the sequences of the cloned genes, the cloned cDNAs were introduced into pQ6sVN (FIG. 11) containing 35S promoter (SEQ ID NO: 10666) and the NOS terminator (SEQ ID NO: 10665) via digestion with appropriate restriction endonucleases. The genes were cloned downstream to the 35S promoter and upstream to the NOS terminator. In the pQ6sVN vector the Hygromycin resistance gene cassette and the Bar_GA resistance gene cassette replaced the NPTII resistance gene cassette. pQ6sVN contains the 35S promoter (SEQ ID NO: 10666). Bar_GA resistance gene (SEQ ID NO: 11335) is an optimized sequence of the BAR gene for expression in *Brachypodium* plants (ordered from GeneArt).

Figure 9A:
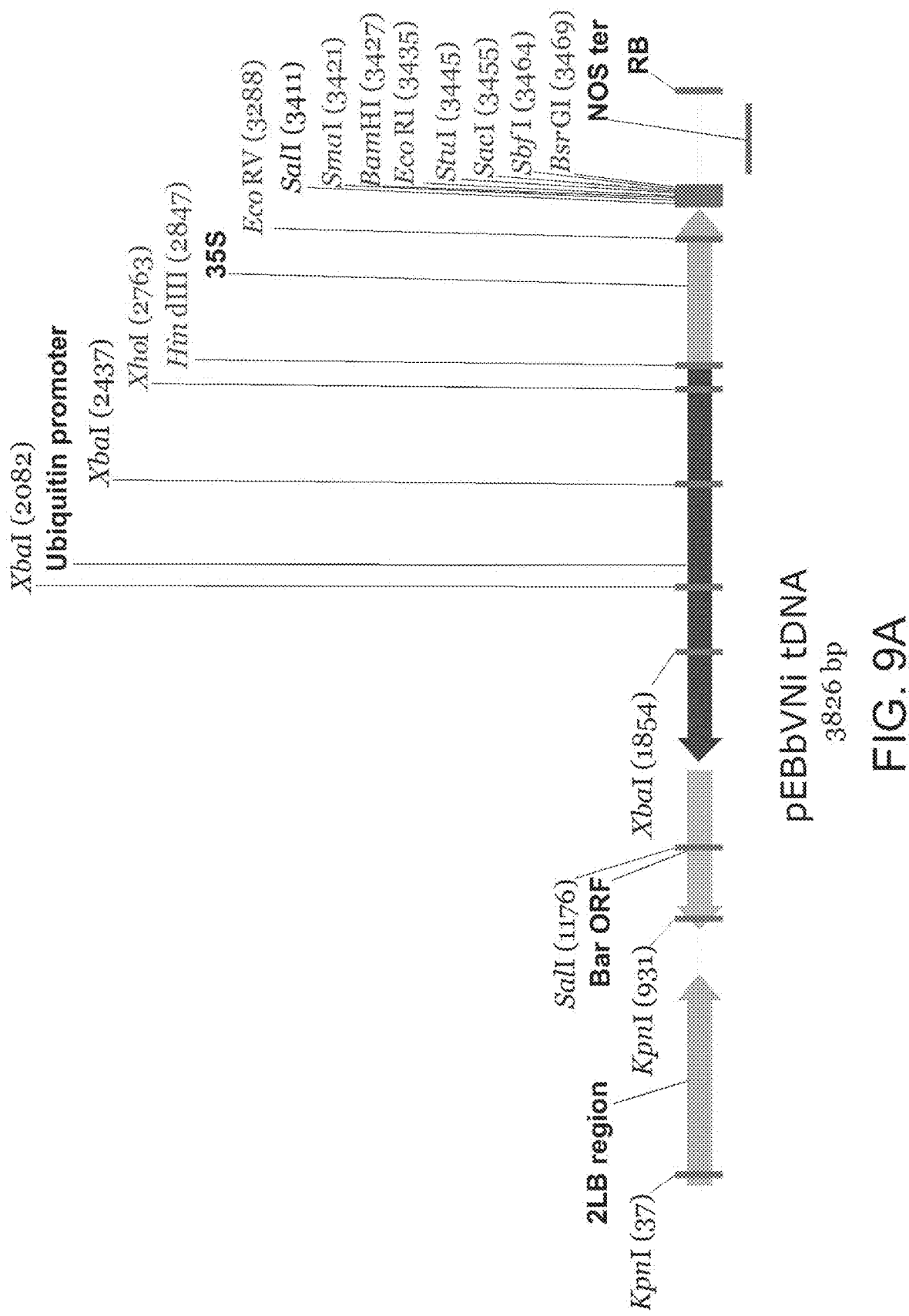
FIGS. 9A-9B are schematic illustrations of the pEBbVNi tDNA (FIG. 9A) and the pEBbNi tDNA (FIG. 9B) plasmids used in the Brachypodium experiments. pEBbVNi tDNA (FIG. 9A) was used for expression of the isolated polynucleotide sequences of some embodiments of the invention in Brachypodium. pEBbNi tDNA (FIG. 9B) was used for transformation into Brachypodium as a negative control. "RB"=right border; "2LBregion"=2 repeats of left border; "35S"=35S promoter (SEQ ID NO: 10666 in FIG. 9A); "Ubiquitin promoter (SEQ ID NO: 10640 in both of FIGS. 9A and 9B; "NOS ter"=nopaline synthase terminator; "Bar ORF"—BAR open reading frame (GenBank Accession No. JQ293091.1; SEQ ID NO: 10667; The isolated polynucleotide sequences of some embodiments of the invention were cloned into the Multiple cloning site of the vector using one or more of the indicated restriction enzyme sites.

Additionally or alternatively, *Brachypodium* transformation was performed using the pEBbVNi vector. pEBbVNi (FIG. 9A) is a modified version of pJJ2LB in which the Hygromycin resistance gene was replaced with the BAR gene which confers resistance to the BASTA herbicide [BAR gene coding sequence is provided in GenBank Accession No. JQ293091.1 (SEQ ID NO: 10667); further description is provided in Akama K, et al. "*Efficient Agrobacterium-mediated transformation of Arabidopsis thaliana using the bar gene as selectable marker*", Plant Cell Rep. 1995, 14(7):450-4; Christiansen P, et al. "*A rapid and efficient transformation protocol for the grass Brachypodium distachyon*", Plant Cell Rep. 2005 March; 23(10-11):751-8. Epub 2004 Oct. 19; and Păcurar D I, et al. "*A high-throughput Agrobacterium-mediated transformation system for the grass model species Brachypodium distachyon L*", Transgenic Res. 2008 17(5):965-75; each of which is fully incorporated herein by reference in its entirety]. The pEBbVNi construct contains the 35S promoter (SEQ ID NO: 10666). pJJ2LB is a modified version of pCambia0305.2 (Cambia).

In case genomic DNA was cloned, the genes were amplified by direct PCR on genomic DNA extracted from leaf tissue using the DNAeasy kit (Qiagen Cat. No. 69104).

Selected genes cloned by the present inventors are provided in Table 233 below.

TABLE 233

| Cloned genes | | | | | |
|---|---|---|---|---|---|
| Gene Name | High copy plasmid | Organism | Primers used SEQ ID NOs: | Polynucleotide SEQ ID NO: | Polypeptide SEQ ID NO: |
| LBY100 | pMA-T_LBY100_GA | | | 388 | 634 |
| LBY102 | pMA-T_LBY102_GA | | | 389 | 635 |
| LBY103 | pQFNc_LBY103 | MAIZE Zea mays L. | 11069, 10874, 11006, 10847 | 390 | 636 |
| LBY104 | pUC19g_LBY104 | MAIZE Zea mays L. | 11093, 11191, 11105, 11166 | 391 | 637 |

TABLE 233-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LBY105 | pQFNc_LBY105 | MAIZE *Zea mays L.* | 11005, 10887, 11119, 10808 | 392 | 638 |
| LBY106-H3 | pQFNc_LBY106_H3 | MAIZE *Zea mays L.* | 11003, 11160, 11028, 11160 | 505 | 884 |
| LBY107 | pQFNc_LBY107 | MAIZE *Zea mays L.* | 11158, 10766, 11158, 10814 | 393 | 640 |
| LBY108 | pQFNc_LBY108 | MAIZE *Zea mays L.* | 10774, 10707, 10756, 10699 | 394 | 838 |
| LBY109 | pUC19c_LBY109 | MAIZE *Zea mays L.* | 11088, 10910, 11019, 10859 | 395 | 642 |
| LBY110 | pQFNc_LBY110 | MAIZE *Zea mays L.* | 11120, 10788, 11038, 10883 | 396 | 643 |
| LBY111 | pMA-RQ_LBY111_GA | | | 397 | 644 |
| LBY112 | pQFNc_LBY112 | MAIZE *Zea mays L.* | 10949, 10935, 10948, 10928 | 398 | 645 |
| LBY113 | TopoB_LBY113 | MAIZE *Zea mays L.* | 11091, 11162, 11130, 11182 | 399 | 646 |
| LBY114 | pQFNc_LBY114 | MAIZE *Zea mays L.* | 10886, 10692, 10899, 10693 | 400 | 647 |
| LBY115 | TopoB_LBY115 | MAIZE *Zea mays L.* | 11154, 10763, 11154, 10763 | 401 | 648 |
| LBY116 | pUC19c_LBY116 | MAIZE *Zea mays L.* | 10991, 10809, 11012, 10792 | 402 | 839 |
| LBY117 | pUC19g_LBY117 | MAIZE *Zea mays L.* | 10947, 10786, 10946, 10902 | 403 | 650 |
| LBY118 | pQFNc_LBY118 | MAIZE *Zea mays L.* | 11017, 10755, 11104, 10888 | 404 | 651 |
| LBY119-H1 | pQFNc_LBY119_H1 | | 10671, 11197, 10671, 11197 | 506 | 885 |
| LBY120 | pQFNc_LBY120 | MAIZE *Zea mays L.* | 11144, 10794, 10974, 10912 | 405 | 840 |
| LBY121 | pQFNc_LBY121 | MAIZE *Zea mays L.* | 10959, 11185, 10959, 11185 | 406 | 841 |
| LBY122 | pQFNc_LBY122 | MAIZE *Zea mays L.* | 11108, 10782, 11110, 11216 | 407 | 842 |
| LBY123 | pQFNc_LBY123 | MAIZE *Zea mays L.* | 11106, 10870, 11034, 10800 | 408 | 656 |
| LBY125 | pMA_LBY125_GA | | | 409 | 657 |
| LBY126 | pQFNc_LBY126 | MEDICAGO *Medicago truncatula* | | 410 | 658 |
| LBY127 | pQFNc_LBY127 | MEDICAGO *Medicago truncatula* | 11095, 11200, 11139, 11193 | 411 | 843 |
| LBY128 | pMA-T_LBY128_GA | | | 412 | 660 |
| LBY129 | pMA-RQ_LBY129_GA | | | 413 | 661 |
| LBY132 | pMA-RQ_LBY132_GA | | | 414 | 663 |
| LBY133 | pMA-T_LBY133_GA | | | 415 | 664 |
| LBY134 | pMA-T_LBY134_GA | | | 416 | 665 |
| LBY135 | pQFNc_LBY135 | POTATO *Solanum tuberosum* | 11082, 10789, 11116, 10798 | 417 | 666 |
| LBY136 | pUC19c_LBY136 | POTATO *Solanum tuberosum* | 10812, 10932, 10749, 10937 | 418 | 844 |
| LBY137 | pQFNc_LBY137 | POTATO *Solanum tuberosum* | 10856, 10712, 10856, 10712 | 419 | 845 |
| LBY138 | pUC19c_LBY138 | RICE *Oryza sativa L.* | 11092, 10922, 11092, 10833 | 420 | 669 |
| LBY139 | TopoB_LBY139 | RICE *Oryza sativa L.* | 10728, 11204, 10728, 11165 | 421 | 846 |
| LBY14 | pQsFN_LBY14 | SORGHUM *Sorghum bicolor* | 10744, 11210, 10744, 11210 | 551 | — |
| LBY140 | pQFNc_LBY140 | RICE *Oryza sativa L.* | 10956, 10821, 10958, 10841 | 422 | 671 |
| LBY141 | pMA-RQ_LBY141_GA | | | 423 | 672 |
| LBY142 | pMA-RQ_LBY142_GA | | | 424 | 673 |
| LBY143 | pQFNc_LBY143 | RICE *Oryza sativa L.* | 10943, 10781, 10942, 10840 | 425 | 674 |
| LBY144 | pQFNc_LBY144 | RICE *Oryza sativa L.* | 11129, 10915, 11129, 10915 | 426 | 847 |
| LBY145 | pQFNc_LBY145 | RICE *Oryza sativa L.* | 11018, 10863, 11018, 10863 | 427 | 676 |
| LBY146 | pUC19c_LBY146 | RICE *Oryza sativa L.* | 10729, 10931, 10729, 10931 | 428 | 848 |
| LBY148 | pMA-RQ_LBY148_GA | | | 429 | 679 |
| LBY149 | pUC19c_LBY149 | SORGHUM *Sorghum bicolor* | 11146, 10923, 11146, 10923 | 430 | 680 |

TABLE 233-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LBY15 | pMA-RQ_LBY15_GA | | | 261 | — |
| LBY150 | pQFNc_LBY150 | SORGHUM Sorghum bicolor | 11014, 10801, 11109, 10884 | 431 | 681 |
| LBY151 | pUC19_LBY151 | SORGHUM Sorghum bicolor | 11015, 10907, 11015, 10907 | 432 | 682 |
| LBY152 | pMA-RQ_LBY152_GA | | | 433 | 683 |
| LBY153 | TopoB_LBY153 | SORGHUM Sorghum bicolor | 10963, 11171, 10963, 11171 | 434 | 684 |
| LBY154 | pQFNc_LBY154 | SORGHUM Sorghum bicolor | 11145, 10865, 10998, 10764 | 435 | 685 |
| LBY155 | pQFNc_LBY155 | SORGHUM Sorghum bicolor | 11048, 11168, 11048, 11168 | 436 | 849 |
| LBY156 | pUC19c_LBY156 | SORGHUM Sorghum bicolor | 10784, 10722, 10860, 10682 | 437 | 850 |
| LBY157 | pMA-RQ_LBY157_GA | | | 438 | 688 |
| LBY158 | pQFNc_LBY158 | SORGHUM Sorghum bicolor | 10968, 10836, 11041, 10817 | 439 | 851 |
| LBY159 | pQFNc_LBY159 | SORGHUM Sorghum bicolor | 11086, 10845, 11103, 10843 | 440 | 690 |
| LBY16 | pUC19c_LBY16 | ARABIDOPSIS Arabidopsis thalia | 11076, 10739, 11076, 10894 | 311 | 552 |
| LBY160 | TopoB_LBY160 | SORGHUM Sorghum bicolor | 11022, 10740, 11151, 10754 | 441 | 691 |
| LBY161 | pMA_LBY161_GA | | | 442 | 692 |
| LBY162 | pUC19g_LBY162 | SORGHUM Sorghum bicolor | 10966, 11159, 11090, 11181 | 443 | 693 |
| LBY163 | pQFNc_LBY163 | SORGHUM Sorghum bicolor | 11011, 11180, 10973, 11177 | 444 | 694 |
| LBY164 | pQFNc_LBY164 | SORGHUM Sorghum bicolor | 11078, 10815, 11078, 10815 | 445 | 852 |
| LBY165 | pQFNc_LBY165 | SORGHUM Sorghum bicolor | 11140, 10677, 11155, 10672 | 446 | 853 |
| LBY166 | pQFNc_LBY166 | SORGHUM Sorghum bicolor | 11125, 10878, 11135, 10881 | 447 | 697 |
| LBY167 | pQFNc_LBY167 | SORGHUM Sorghum bicolor | 10675, 10708, 10873, 10695 | 448 | 698 |
| LBY17 | pQFNc_LBY17 | ARABIDOPSIS Arabidopsis thalia | 10993, 10775, 10982, 10743 | 312 | 553 |
| LBY170 | pMK-RQ_LBY170_GA | | | 449 | 700 |
| LBY171 | pMK-RQ_LBY171_GA | | | 450 | 701 |
| LBY173 | pQFNc_LBY173 | SORGHUM Sorghum bicolor | 10737, 10711, 10891, 10716 | 451 | 702 |
| LBY174 | pUC19g_LBY174 | SORGHUM Sorghum bicolor | 10960, 11188, 10952, 11196 | 452 | 703 |
| LBY175 | pQFNc_LBY175 | SORGHUM Sorghum bicolor | 10994, 10791, 11150, 10918 | 453 | 704 |
| LBY176 | pMA-RQ_LBY176_GA | | | 454 | 705 |
| LBY177 | pUC19g_LBY177 | SORGHUM Sorghum bicolor | 10941, 10877, 10953, 10924 | 455 | 706 |
| LBY178 | pMK-RQ_LBY178_GA | | | 456 | 707 |
| LBY179 | pQFNc_LBY179 | SORGHUM Sorghum bicolor | 11133, 10741, 11133, 10895 | 457 | 708 |
| LBY18 | pMA-RQ_LBY18_GA | | | 313 | 554 |
| LBY180 | TopoB_LBY180 | SORGHUM Sorghum bicolor | 10853, 10685, 10919, 10718 | 458 | 854 |
| LBY181 | TopoB_LBY181 | SORGHUM Sorghum bicolor | 10730, 11199, 10730, 11199 | 459 | 855 |
| LBY182 | pQFNc_LBY182 | SORGHUM Sorghum bicolor | 11064, 10686, 11064, 10691 | 460 | 856 |
| LBY183 | pMA-RQ_LBY183_GA | | | 461 | 712 |
| LBY184 | pQFNc_LBY184 | SORGHUM Sorghum bicolor | 10978, 10871, 10976, 10835 | 462 | 713 |
| LBY185 | pQFNc_LBY185 | SORGHUM Sorghum bicolor | 11035, 10898, 11100, 10868 | 463 | 857 |
| LBY186 | pQFNc_LBY186 | SORGHUM Sorghum bicolor | 11127, 10851, 10986, 10772 | 464 | 715 |
| LBY187 | pUC19_LBY187 | SORGHUM Sorghum bicolor | 10736, 10734, 10736, 10735 | 465 | 858 |
| LBY188 | pQFNc_LBY188 | SORGHUM Sorghum bicolor | 11148, 10760, 10996, 10795 | 466 | 717 |
| LBY190 | pQFNc_LBY190 | SORGHUM Sorghum bicolor | 11023, 10778, 11117, 10866 | 467 | 719 |
| LBY191 | pMA-RQ_LBY191_GA | | | 468 | 720 |
| LBY192 | pQsFN_LBY192 | SORGHUM Sorghum bicolor | 10731, 11183, 10727, 11205 | 469 | 859 |

TABLE 233-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LBY193 | pQFNc_LBY193 | SOYBEAN Glycine max | 11004, 10769, 11025, 10785 | 470 | 860 |
| LBY194 | pMA-RQ_LBY194_GA | | | 471 | 723 |
| LBY195 | pQFNc_LBY195 | SOYBEAN Glycine max | 10925, 10717, 10925, 10717 | 472 | 861 |
| LBY196 | pMA_LBY196_GA | | | 473 | 725 |
| LBY197 | pUC19c_LBY197 | SUNFLOWER Helianthus annuus | 10689, 10938, 10689, 10934 | 474 | 726 |
| LBY199 | pUC19g_LBY199 | SUNFLOWER Helianthus annuus | 11067, 11172, 11067, 11174 | 475 | 862 |
| LBY20 | TopoB_LBY20 | BARLEY Hordeum vulgare L. | 11149, 11163, 11063, 11173 | 314 | 817 |
| LBY200 | pQFNc_LBY200 | SUNFLOWER Helianthus annuus | 11045, 10779, 11056, 10857 | 476 | 863 |
| LBY201 | TopoB_LBY201 | SUNFLOWER Helianthus annuus | 10981, 10669, 11049, 10670 | 477 | 864 |
| LBY202 | pQFNc_LBY202 | SUNFLOWER Helianthus annuus | 11032, 10767, 11032, 10767 | 478 | 865 |
| LBY203 | pQFNc_LBY203 | SUNFLOWER Helianthus annuus | 10725, 11178, 10725, 11178 | 479 | 866 |
| LBY204 | pUC19c_LBY204 | SUNFLOWER Helianthus annuus | 10706, 10930, 10688, 10936 | 480 | 732 |
| LBY205 | pQFNc_LBY205 | SUNFLOWER Helianthus annuus | 11083, 10897, 11097, 10838 | 481 | 867 |
| LBY206 | pQFNc_LBY206 | SUNFLOWER Helianthus annuus | 11062, 11195, 11047, 11176 | 482 | 868 |
| LBY207 | pQFNc_LBY207 | SUNFLOWER Helianthus annuus | 10987, 10816, 11059, 10820 | 483 | 869 |
| LBY208 | pQFNc_LBY208 | SUNFLOWER Helianthus annuus | 11157, 10804, 11157, 10804 | 484 | 736 |
| LBY209 | pUC19g_LBY209 | SUNFLOWER Helianthus annuus | 10969, 10964, 11153, 10962 | 485 | 870 |
| LBY21 | pQFNc_LBY21 | BARLEY Hordeum vulgare L. | 11114, 10780, 11053, 10810 | 315 | 557 |
| LBY210 | pQFNc_LBY210 | SUNFLOWER Helianthus annuus | 11123, 11192, 11050, 11192 | 486 | 871 |
| LBY211 | pQFNc_LBY211 | SUNFLOWER Helianthus annuus | 10698, 11209, 10700, 11208 | 487 | 872 |
| LBY212 | pQFNc_LBY212 | TOMATO Lycopersicum ND | 11111, 10751, 11099, 10849 | 488 | 873 |
| LBY213 | pQFNc_LBY213 | TOMATO Lycopersicum ND | 11033, 10752, 10967, 10837 | 489 | 874 |
| LBY214 | pQFNc_LBY214 | WHEAT Triticum aestivum L. | | 490 | 742 |
| LBY216 | pQFNc_LBY216 | WHEAT Triticum aestivum L. | 10957, 10783, 10951, 10892 | 491 | 875 |
| LBY217 | pQFNc_LBY217 | WHEAT Triticum aestivum L. | 11152, 11170, 11079, 11167 | 492 | 876 |
| LBY218 | pQFNc_LBY218 | WHEAT Triticum aestivum L. | 10869, 10694, 10862, 10696 | 493 | 877 |
| LBY219_H9 | pMA-RQ_LBY219_H9_GA | | | 507 | 761 |
| LBY22 | pQFNc_LBY22 | BARLEY Hordeum vulgare L. | 10989, 10745, 10984, 10876 | 316 | 558 |
| LBY220 | pMA-RQ_LBY220_GA | | | 494 | 748 |
| LBY221 | pMA-RQ_LBY221_GA | | | 495 | 749 |
| LBY222 | TopoB_LBY222 | WHEAT Triticum aestivum L. | 10970, 11161, 10970, 11187 | 496 | 878 |
| LBY224 | TopoB_LBY224 | WHEAT Triticum aestivum L. | 10733, 10732, 10726, 11206 | 497 | 751 |
| LBY225 | pUC19c_LBY225 | WHEAT Triticum aestivum L. | 10747, 10724, 10747, 10724 | 498 | 879 |
| LBY227 | pQFNc_LBY227 | WHEAT Triticum aestivum L. | 11112, 10855, 10990, 10822 | 499 | 753 |
| LBY228 | pUC19c_LBY228 | WHEAT Triticum aestivum L. | 11115, 10858, 11046, 10819 | 500 | 880 |
| LBY23 | pQFNc_LBY23 | BARLEY Hordeum vulgare L. | 10961, 10823, 10944, 10824 | 317 | 559 |
| LBY230 | pQFNc_LBY230 | WHEAT Triticum aestivum L. | 11075, 10742, 11042, 10844 | 501 | 881 |
| LBY231 | TopoB_LBY231 | WHEAT Triticum aestivum L. | 11072, 10906, 11072, 10906 | 502 | 882 |
| LBY232 | pQsFN_LBY232 | WHEAT Triticum aestivum L. | 11128, 11215, 11128, 11215 | 503 | 883 |
| LBY233 | pQFNc_LBY233 | MAIZE Zea mays L. | 11118, 10827, 11089, 10830 | 504 | 758 |

TABLE 233-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LBY24 | pQFNc_LBY24 | BARLEY *Hordeum vulgare* L. | 11147, 11194, 11057, 11189 | 318 | 818 |
| LBY25 | pQFNc_LBY25 | BARLEY *Hordeum vulgare* L. | 11094, 10738, 11021, 10770 | 319 | 561 |
| LBY26 | pMK-RQ_LBY26_GA | | | 320 | 562 |
| LBY27_H4 | pMA-RQ_LBY27_H4_GA | | | 508 | 762 |
| LBY28 | pQFNc_LBY28 | BARLEY *Hordeum vulgare* L. | 11002, 10818, 11002, 10828 | 321 | 819 |
| LBY29 | pUC19c_LBY29 | BARLEY *Hordeum vulgare* L. | 10850, 10679, 10905, 10714 | 322 | 565 |
| LBY3 | pQFNc_LBY3 | FOXTAIL *Setaria italica* | 11058, 10758, 11080, 10909 | 547 | — |
| LBY30 | pUC19_LBY30 | BARLEY *Hordeum vulgare* L. | 11000, 10880, 11126, 10776 | 323 | 566 |
| LBY31 | pQFNc_LBY31 | BARLEY *Hordeum vulgare* L. | 11087, 10842, 11087, 10829 | 324 | 820 |
| LBY32 | pMA-RQ_LBY32_GA | | | 325 | 568 |
| LBY33 | pQFNc_LBY33 | BEAN *Phaseolus vulgaris* | 10889, 10719, 10864, 10690 | 326 | 821 |
| LBY34_H2 | pMA-RQ_LBY34_H2_GA | | | 509 | 763 |
| LBY35 | TopoB_LBY35 | BEAN *Phaseolus vulgaris* | 11141, 10903, 10972, 10806 | 327 | 822 |
| LBY36 | pUC19c_LBY36 | BEAN *Phaseolus vulgaris* | 11142, 10867, 11156, 10926 | 328 | 823 |
| LBY37 | pQFNc_LBY37 | BRACHYPODIUM *Brachypodiums dis* | 10997, 11184, 11024, 11201 | 329 | 573 |
| LBY4 | pQsFN_LBY4 | COTTON *Gossypium* ND | 11068, 10796, 11068, 10796 | 548 | — |
| LBY40 | pMA-RQ_LBY40_GA | | | 331 | 575 |
| LBY41 | pMA-RQ_LBY41_GA | | | 332 | 576 |
| LBY43 | pQFNc_LBY43 | CHLAMYDOMONAS *Chlamydomonas re* | 11055, 10761, 11137, 10834 | 333 | 578 |
| LBY44 | pMK-RQ_LBY44_GA | | | 334 | 579 |
| LBY45 | pQFNc_LBY45 | COTTON *Gossypium* ND | 11065, 10846, 11065, 10846 | 335 | 580 |
| LBY46 | pQFNc_LBY46 | COTTON *Gossypium* ND | | 336 | 824 |
| LBY47 | TopoB_LBY47 | COTTON *Gossypium* ND | 10713, 10927, 10709, 10929 | 337 | 825 |
| LBY48 | pQFNc_LBY48 | COTTON *Gossypium* ND | 11026, 10904, 11027, 10920 | 338 | 826 |
| LBY49 | pQFNc_LBY49 | COTTON *Gossypium* ND | 10759, 11207, 10872, 11207 | 339 | 827 |
| LBY5 | pQFNc_LBY5 | MAIZE *Zea mays* L. | 11077, 11211, 11124, 11211 | 549 | — |
| LBY50 | pUC19c_LBY50 | COTTON *Gossypium* ND | 11030, 10893, 11043, 10748 | 340 | 828 |
| LBY51 | pQFNc_LBY51 | COTTON *Gossypium* ND | 11039, 10900, 11143, 10762 | 341 | 586 |
| LBY52 | pQFNc_LBY52 | COTTON *Gossypium* ND | 11066, 11037, 11066, 11037 | 342 | 829 |
| LBY53 | pQFNc_LBY53 | COTTON *Gossypium* ND | 10896, 10702, 10896, 10702 | 343 | 830 |
| LBY54 | pUC19c_LBY54 | COTTON *Gossypium* ND | 11009, 10875, 11085, 10875 | 344 | 589 |
| LBY55 | TopoB_LBY55 | FOXTAIL *Setaria italica* | 11102, 11213, 11102, 11213 | 345 | 590 |
| LBY56 | pQFNc_LBY56 | FOXTAIL *Setaria italica* | 10807, 10720, 10807, 10720 | 346 | 591 |
| LBY57 | pQFNc_LBY57 | FOXTAIL *Setaria italica* | 11098, 10753, 11052, 10921 | 347 | 592 |
| LBY58 | pQFNc_LBY58 | FOXTAIL *Setaria italica* | 11113, 10746, 10983, 10839 | 348 | 593 |
| LBY59 | pMA_LBY59_GA | | | 349 | 594 |
| LBY6 | pQFNc_LBY6 | MAIZE *Zea mays* L. | 10799, 10680, 10799, 10680 | 550 | — |
| LBY61 | pMA-RQ_LBY61_GA | | | 350 | 595 |
| LBY62 | pQFNc_LBY62 | FOXTAIL *Setaria italica* | 10995, 10854, 11096, 10831 | 351 | 596 |
| LBY63 | pUC19c_LBY63 | FOXTAIL *Setaria italica* | 11040, 10802, 11040, 10885 | 352 | 597 |
| LBY64 | pQFNc_LBY64 | FOXTAIL *Setaria italica* | | 353 | 598 |
| LBY65 | TopoB_LBY65 | FOXTAIL *Setaria italica* | 10965, 10703, 10965, 10721 | 354 | 599 |

TABLE 233-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LBY66 | pUC19c_LBY66 | FOXTAIL Setaria italica | 10975, 10710, 10975, 10710 | 355 | 600 |
| LBY68 | pMA-RQ_LBY68_GA | | | 356 | 602 |
| LBY69 | pQFNc_LBY69 | FOXTAIL Setaria italica | 11081, 11198, 11131, 11179 | 357 | 831 |
| LBY70 | pQFNc_LBY70 | FOXTAIL Setaria italica | 11132, 10674, 10999, 10676 | 358 | 604 |
| LBY71 | pUC19_LBY71 | FOXTAIL Setaria italica | 11107, 11212, 11054, 11214 | 359 | 605 |
| LBY72 | pQFNc_LBY72 | FOXTAIL Setaria italica | 11044, 10765, 11044, 10765 | 360 | 832 |
| LBY73 | pQFNc_LBY73 | FOXTAIL Setaria italica | 10861, 10723, 10879, 10697 | 361 | 607 |
| LBY74 | pQFNc_LBY74 | FOXTAIL Setaria italica | 11029, 11202, 11031, 11169 | 362 | 833 |
| LBY75 | TopoB_LBY75 | FOXTAIL Setaria italica | 11074, 11186, 10988, 11203 | 363 | 609 |
| LBY76 | TopoB_LBY76 | FOXTAIL Setaria italica | 11007, 10917, 11101, 10901 | 364 | 610 |
| LBY77 | pQFNc_LBY77 | FOXTAIL Setaria italica | 11061, 10787, 11136, 10757 | 365 | 611 |
| LBY78 | TopoB_LBY78 | FOXTAIL Setaria italica | 10992, 10797, 11020, 10826 | 366 | 612 |
| LBY79 | pQFNc_LBY79 | FOXTAIL Setaria italica | 10971, 10908, 10971, 10908 | 367 | 613 |
| LBY80 | pQFNc_LBY80 | FOXTAIL Setaria italica | 11084, 10890, 11051, 10793 | 368 | 614 |
| LBY81 | pQFNc_LBY81 | FOXTAIL Setaria italica | 10805, 10933, 10805, 10939 | 369 | 615 |
| LBY82 | pQFNc_LBY82 | FOXTAIL Setaria italica | 11010, 10955, 10985, 10954 | 370 | 616 |
| LBY83 | MA-RQ_LBY83_GA | FOXTAIL Setaria italica | | 371 | 617 |
| LBY84 | pQFNc_LBY84 | FOXTAIL Setaria italica | 11008, 10882, 11013, 10825 | 372 | 618 |
| LBY85 | pQFNc_LBY85 | FOXTAIL Setaria italica | 11071, 10914, 11071, 10914 | 373 | 619 |
| LBY86 | pMA-RQ_LBY86_GA | | | 374 | 620 |
| LBY87 | TopoB_LBY87 | FOXTAIL Setaria italica | 11070, 10803, 11134, 10852 | 375 | 621 |
| LBY88 | pQFNc_LBY88 | FOXTAIL Setaria italica | 10768, 10704, 10811, 10681 | 376 | 622 |
| LBY89 | pUC19_LBY89 | FOXTAIL Setaria italica | 10980, 10773, 10980, 10773 | 377 | 623 |
| LBY90 | pQFNc_LBY90 | FOXTAIL Setaria italica | 11016, 10848, 11073, 10832 | 378 | 624 |
| LBY91 | TopoB_LBY91 | FOXTAIL Setaria italica | 10945, 10750, 10945, 10750 | 379 | 625 |
| LBY92 | pQFNc_LBY92 | FOXTAIL Setaria italica | 10668, 10683, 10678, 10701 | 380 | 626 |
| LBY93 | pQFNc_LBY93 | COTTON Gossypium ND | 11001, 11164, 10979, 11175 | 381 | 834 |
| LBY94 | TopoB_LBY94 | COTTON Gossypium ND | 10977, 10940, 11036, 10950 | 382 | 835 |
| LBY95 | pQFNc_LBY95 | COTTON Gossypium ND | 11138, 10673, 11138, 10673 | 383 | 836 |
| LBY96 | pUC19_LBY96 | COTTON Gossypium ND | 11060, 10790, 11060, 10913 | 384 | 630 |
| LBY97 | pQFNc_LBY97 | COTTON Gossypium ND | 10916, 10705, 10911, 10687 | 385 | 837 |
| LBY98 | pMA-T_LBY98_GA | | | 386 | 632 |
| LBY99 | pMA-RQ_LBY99_GA | | | 387 | 633 |
| LGN1 | pQFNc_LGN1 | WHEAT Triticum aestivum L. | 11291, 11313, 11292, 11309 | 510 | 764 |
| LGN13 | pUCsFN_LGN13 | RICE Oryza sativa L. | 11270, 11333, 11270, 11333 | 518 | 772 |
| LGN14 | pUC19c_LGN14 | RICE Oryza sativa L. | 11254, 11218, 11256, 11219 | 519 | 773 |
| LGN17 | pUCsFN_LGN17 | MAIZE Zea mays L. | 11279, 11315, 11282, 11331 | 520 | 886 |
| LGN18 | pUCsFN_LGN18 | MAIZE Zea mays L. | 11321, 11252, 11322, 11253 | 521 | 887 |
| LGN2 | pUCsFN_LGN2 | SOYBEAN Glycine max | 11303, 11245, 11304, 11236 | 511 | 765 |
| LGN20 | pUCsFN_LGN20 | MAIZE Zea mays L. | 11295, 11314, 11295, 11311 | 522 | 888 |

TABLE 233-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LGN23 | pUCsFN_LGN23 | MAIZE Zea mays L. | 11275, 11246, 11275, 11246 | 523 | 777 |
| LGN24 | pUCsFN_LGN24 | MAIZE Zea mays L. | 11294, 11324, 11294, 11324 | 524 | 889 |
| LGN26 | pUCsFN_LGN26 | MAIZE Zea mays L. | 11306, 11310, 11271, 11307 | 525 | 779 |
| LGN3 | pUCsFN_LGN3 | SORGHUM Sorghum bicolor | 11278, 11230, 11278, 11227 | 512 | 766 |
| LGN33 | pUCsFN_LGN33 | MAIZE Zea mays L. | 11247, 11327, 11247, 11327 | 526 | 780 |
| LGN34 | TopoB_LGN34 | MAIZE Zea mays L. | 11284, 11228, 11299, 11221 | 527 | 890 |
| LGN35 | pUC19c_LGN35 | MAIZE Zea mays L. | 11318, 11249, 11318, 11249 | 528 | 782 |
| LGN36 | pUCsFN_LGN36 | MAIZE Zea mays L. | 11281, 11261, 11281, 11261 | 529 | 783 |
| LGN39 | pQFNc_LGN39 | MAIZE Zea mays L. | 11264, 11250, 11264, 11250 | 530 | 891 |
| LGN4 | pUC19c_LGN4 | SORGHUM Sorghum bicolor | 11268, 11222, 11273, 11232 | 513 | 767 |
| LGN40 | pUCsFN_LGN40 | COTTON Gossypium hirsutum | 11267, 11239, 11305, 11243 | 531 | 785 |
| LGN41 | pUCsFN_LGN41 | BRACHYPODIUM Brachypodiums dis | 11269, 11244, 11283, 11329 | 532 | 786 |
| LGN42 | pQsFN_LGN42 | BARLEY Hordeum vulgare L. | 11280, 11229, 11301, 11226 | 533 | 787 |
| LGN43 | pUCsFN_LGN43 | BARLEY Hordeum vulgare L. | 11274, 11237, 11277, 11231 | 534 | 788 |
| LGN44 | pUCsFN_LGN44 | BARLEY Hordeum vulgare L. | 11276, 11326, 11286, 11334 | 535 | 789 |
| LGN45 | pUCsFN_LGN45 | BARLEY Hordeum vulgare L. | 11265, 11332, 11265, 11332 | 536 | 892 |
| LGN46 | TopoB_LGN46 | BARLEY Hordeum vulgare L. | 11298, 11312, 11287, 11308 | 537 | 791 |
| LGN47 | TopoB_LGN47 | BARLEY Hordeum vulgare L. | 11242, 11330, 11242, 11330 | 538 | 893 |
| LGN48 | pUC19c_LGN48 | BARLEY Hordeum vulgare L. | 11289, 11225, 11296, 11328 | 539 | 793 |
| LGN49 | pQFNc_LGN49 | MAIZE Zea mays L. | 11240, 11257, 11235, 11248 | 540 | 894 |
| LGN5 | pQFNc_LGN5 | SORGHUM Sorghum bicolor | 11317, 11259, 11317, 11259 | 514 | 768 |
| LGN52 | pQsFN_LGN52 | FOXTAIL Setaria italica | 11293, 11234, 11293, 11234 | 541 | 795 |
| LGN54 | pQFNc_LGN54 | SORGHUM Sorghum bicolor | 11288, 11238, 11288, 11238 | 542 | 796 |
| LGN57 | pQFNc_LGN57 | SORGHUM Sorghum bicolor | 11266, 11258, 11272, 11260 | 543 | 895 |
| LGN6 | pUCsFN_LGN6 | SORGHUM Sorghum bicolor | 11262, 11220, 11263, 11217 | 515 | 769 |
| LGN60 | pUC19c_LGN60 | FOXTAIL Setaria italica | 11323, 11325, 11323, 11325 | 544 | 798 |
| LGN61 | pUCsFN_LGN61 | MAIZE Zea mays L. | 11290, 11223, 11297, 11224 | 545 | 896 |
| LGN62_H2 | TopoB_LGN62_H2 | Foxtail millet | 11320, 11285, 11320, 11285 | 546 | 897 |
| LGN7 | pUC19c_LGN7 | SORGHUM Sorghum bicolor | 11316, 11255, 11319, 11251 | 516 | 770 |
| LGN9 | pUCsFN_LGN9 | RICE Oryza sativa L. | 11300, 11241, 11302, 11233 | 517 | 771 |
| LBY39 | — | | | 330 | 574 |

Table 233: Provided are the gene names, cluster names, organisms from which they were derived, and polynucleotide and polypeptide sequence identifiers of selected genes of some embodiments of the invention. "GA"—Gene Art (synthetically prepared gene sequence).

Example 26

Transforming *Agrobacterium Tumefaciens* Cells with Binary Vectors Harboring Putative Genes Each of the binary vectors described in Example 25 above were used to transform *Agrobacterium* cells. Two additional binary constructs, having only the At6669 or the 35S promoter, or no additional promoter were used as negative controls.

The binary vectors were introduced to *Agrobacterium tumefaciens* GV301 or LB4404 (for *Arabidopsis*) or AGL1 (for *Brachypodium*) competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (for *Arabidopsis;* 50 mg/L; for *Agrobacterium* strains GV301) or streptomycin (for *Arabidopsis;* 300 mg/L; for *Agrobacterium* strain LB4404); or with Carbenicillin (for *Brachypodium;* 50 mg/L) and kanamycin (for *Arabidopsis* and *Brachypodium;* 50 mg/L) at 28° C. for 48 hours. *Agrobacterium* colonies, which were developed on the selective media, were further analyzed by PCR using the primers designed to span the inserted sequence in the pPI plasmid. The resulting PCR products were isolated and sequenced to verify that the correct polynucleotide sequences of the invention are properly introduced to the *Agrobacterium* cells.

Example 27

Producing Transgenic *Arabidopsis* Plants Expressing Selected Genes According to Some Embodiments of the Invention Materials and Experimental Methods Plant transformation—The *Arabidopsis thaliana* var Columbia ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues were the primary targets of *Agrobacterium*-mediated transformation by the *Arabidopsis* floral-dip method. Plant Physiol. 123(3): 895-904] with minor modifications. Briefly, *Arabidopsis thaliana* Columbia (Co10) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Single colonies of *Agrobacterium* carrying the binary vectors harboring the yield genes were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contained half-strength (2.15 g/L) Murashige-Skoog (Duchefa); 0.044 μM benzylamino purine (Sigma); 112 μg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the above ground plant tissue was submerged for 3-5 seconds. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ *Arabidopsis* plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 28

Transformation of *Brachypodium Distachyon* Plants with the Polynucleotides of the Invention Similar to the *Arabidopsis* model plant, *Brachypodium distachyon* has several features that recommend it as a model plant for functional genomic studies, especially in the grasses. Traits that make it an ideal model include its small genome (~160 Mbp for a diploid genome and 355 Mbp for a polyploidy genome), small physical stature, a short lifecycle, and few growth requirements. *Brachypodium* is related to the major cereal grain species but is understood to be more closely related to the Triticeae (wheat, barley) than to the other cereals. *Brachypodium*, with its polyploidy accessions, can serve as an ideal model for these grains (whose genomics size and complexity is a major barrier to biotechnological improvement).

*Brachypodium distachyon* embryogenic calli were transformed using the procedure described by Vogel and Hill (2008) [High-efficiency *Agrobacterium*-mediated transformation of *Brachypodium distachyon* inbred line Bd21-3. Plant Cell Rep 27:471-478], Vain et al (2008) [*Agrobacterium*-mediated transformation of the temperate grass *Brachypodium distachyon* (genotypeBd21) for T-DNA insertional mutagenesis. Plant Biotechnology J 6: 236-245], and Vogel J, et al. (2006) [*Agrobacterium* mediated transformation and inbred line development in the model grass *Brachypodium distachyon*. Plant Cell Tiss Org. Cult. 85:199-211], each of which is fully incorporated herein by reference, with some minor modifications, which are briefly summarized hereinbelow.

Callus initiation—Immature spikes (about 2 months after seeding) were harvested at the very beginning of seeds filling. Spikes were then husked and surface sterilized with 3% NaClO containing 0.1% Tween 20, shaken on a gyratory shaker at low speed for 20 minutes. Following three rinses with sterile distilled water, embryos were excised under a dissecting microscope in a laminar flow hood using fine forceps.

Excised embryos (size ~0.3 mm, bell shaped) were placed on callus induction medium (CIM) [LS salts (Linsmaier, E. M. & Skoog, F. 1965. Physiol. Plantarum 18, 100) and vitamins plus 3% sucrose, 6 mg/L $CuSO_4$, 2.5 mg/l 2,4-Dichlorophenoxyacetic Acid, pH 5.8 and 0.25% phytagel (Sigma)] scutellar side down, 100 embryos on a plate, and incubated at 28° C. in the dark. One week later, the embryonic calli is cleaned from emerging roots, shoots and somatic calli, and was subcultured onto fresh CIM medium. During culture, yellowish embryogenic callus (EC)

appeared and were further selected (e.g., picked and transferred) for further incubation in the same conditions for additional 2 weeks. Twenty-five pieces of sub-cultured calli were then separately placed on 90×15 mm petri plates, and incubated as before for three additional weeks.

Transformation—As described in Vogel and Hill (2008, Supra), *Agrobacterium* is scraped off 2-day-old MGL plates (plates with the MGL medium which contains: Tryptone 5 g/l, Yeast Extract 2.5 g/l, NaCl 5 g/l, D-Mannitol 5 g/l, $MgSO_4 \cdot 7H_2O$ 0.204 g/l, $K_2HPO_4$ 0.25 g/l, Glutamic Acid 1.2 g/l, Plant Agar 7.5 g/l) and resuspended in liquid MS medium supplemented with 200 µM acetosyringone to an optic density (OD) at 600 nm (OD600) of 0.6. Once the desired OD was attained, 1 ml of 10% Synperonic PE/F68 (Sigma) per 100 ml of inoculation medium is added.

To begin inoculation, 300 callus pieces were placed in approximately 12 plates (25 callus pieces in each plate) and covered with the *Agrobacterium* suspension (8-8.5 ml). The callus was incubated in the *Agrobacterium* suspension for 15 minutes with occasional gentle rocking. After incubation, the *Agrobacterium* suspension was aspirated off and the calli are then transferred into co-cultivation plates, prepared by placing a sterile 7-cm diameter filter paper in an empty 90×15 mm petri plate. The calli pieces were then gently distributed on the filter paper. One co-cultivation plate was used for two starting callus plates (50 initial calli pieces). The co-cultivation plates were then sealed with parafilm and incubated at 22° C. in the dark for 3 days.

The callus pieces were then individually transferred onto CIM medium as described above, which is further supplemented with 200 mg/l Ticarcillin (to kill the *Agrobacterium*) and Bialaphos (5 mg/L) (for selection of the transformed resistant embryogenic calli sections), and incubated at 28° C. in the dark for 14 days.

The calli pieces were then transferred to shoot induction media (SIM; LS salts and vitamins plus 3% Maltose monohydrate) supplemented with 200 mg/l Ticarcillin, Bialaphos (5 mg/L), Indol-3-acetic acid (IAA) (0.25 mg/L), and 6-Benzylaminopurine (BAP) (1 mg/L), and are sub-cultured in light to the same media after 10 days (total of 20 days). At each sub-culture all the pieces from a single callus are kept together to maintain their independence and are incubated under the following conditions: lighting to a level of 60 1E m-2 s-1, a 16-h light, 8-h dark photoperiod and a constant 24° C. temperature. Plantlets emerged from the transformed calli.

When plantlets were large enough to handle without damage, they were transferred to plates containing the above mentioned shoot induction media (SIM) without Bialaphos. Each plantlet was considered as a different event. The plantlets grew axillary tillers and eventually became bushy. Each bush from the same plant (event ID) was then divided to tissue culture boxes ("Humus") containing "rooting medium" [MS basal salts, 3% sucrose, 3 g/L phytagel, 2 mg/l α-Naphthalene Acetic Acid (NAA) and 1 mg/L IAA and Ticarcillin 200 mg/L, PH 5.8). All plants in a "Humus box" were different plants of the same transformation event.

When plantlets establish roots they were transplanted to soil and transferred to a greenhouse. To verify the transgenic status of plants containing the other constructs, T0 plants were subjected to PCR as previously described by Vogel et al. 2006 [*Agrobacterium* mediated transformation and inbred line development in the model grass *Brachypodium distachyon*. Plant Cell Tiss Org. Cult. 85:199-211].

Example 29

Evaluation of Transgenic *Arabidopsis* for Seed Yield and Plant Growth Rate Under Normal Conditions in Greenhouse Assays (GH-SM Assays)

Assay 1: Seed Yield, Plant Biomass and Plant Growth Rate in Greenhouse Conditions (Seed Maturation Assay).

Under Normal conditions—This assay follows seed yield production, the biomass formation and the rosette area growth of plants grown in the greenhouse at non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:2 ratio. The plant were grown under normal growth conditions which included irrigation of the trays with a solution containing 6 mM inorganic nitrogen in the form of $KNO_3$ with 1 mM $KH_2PO_4$, 1 mM $MgSO_4$, 1.5 mM $CaCl_2$ and microelements. Under normal conditions the plants grow in a controlled environment in a closed transgenic greenhouse, temperature about 18-22° C., humidity around 70%. Irrigation was done by flooding with a water solution containing 6 mM N (nitrogen) (as described hereinabove), and flooding was repeated whenever water loss reached 50%. All plants were grown in the greenhouse until mature seeds. Seeds were harvested, extracted and weighted. The remaining plant biomass (the above ground tissue) was also harvested, and weighted immediately or following drying in oven at 50° C. for 24 hours.

Under drought conditions and standard growth conditions—This assay follows seed yield production, the biomass formation and the rosette area growth of plants grown in the greenhouse under drought conditions and under standard growth conditions. Transgenic *Arabidopsis* seeds were sown in phytogel media supplemented with ½ MS medium and a selection agent (Kanamycin). The $T_2$ transgenic seedlings were then transplanted to 1.7 trays filled with peat and perlite in a 1:2 ratio and tuff at the bottom of the tray and a net below the trays (in order to facilitate water drainage). Half of the plants were irrigated with tap water (standard growth conditions) when tray weight reached 50% of its field capacity. The other half of the plants were irrigated with tap water when tray weight reached 20% of its field capacity in order to induce drought stress. All plants were grown in the greenhouse until seeds maturation. Seeds were harvested, extracted and weighted. The remaining plant biomass (the above ground tissue) was also harvested, and weighted immediately or following drying in oven at 50° C. for 24 hours.

Under nitrogen limiting (low N) and standard (nitrogen non-limiting) conditions—This assay follows seed yield production, the biomass formation and the rosette area growth of plants grown in the greenhouse at limiting and non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 2.8 mM inorganic nitrogen in the form of $KNO_3$, supplemented with 1 mM $KH_2PO_4$, 1 mM $MgSO_4$, 1.5 mM $CaCl_2$ and microelements, while normal nitrogen levels were achieved by applying a solution of 5.5 mM inorganic nitrogen also in the form of $KNO_3$ with 1 mM $KH_2PO_4$, 1 mM $MgSO_4$, 1.5 mM $CaCl_2$ and microelements.

All plants were grown in the greenhouse until mature seeds. Seeds were harvested, extracted and weight. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying a promoter and the selectable marker were used as control [The promoters which were used are described in Example 25 above, e.g., the At6669 promoter (SEQ ID NO: 10654) or the 35S promoter (SEQ ID NO: 10650]

The plants were analyzed for their overall size, growth rate, flowering, seed yield, 1,000-seed weight, dry matter and harvest index (HI-seed yield/dry matter). Transgenic plants performance was compared to control plants grown in parallel under the same (e.g., identical) conditions. Mock-transgenic plants expressing the uidA reporter gene (GUS-Intron) or with no gene at all, under the same promoter were used as controls.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at/rsbweb (dot) nih (dot) gov/]. Images are captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number [Formula VIII (described above)], rosette area (Formula IX above), plot coverage (Formula XI above) and harvest index (Formula XV above) were calculated with the indicated formulas.

Seeds average weight—At the end of the experiment all seeds were collected. The seeds were scattered on a glass tray and a picture is taken. Using the digital analysis, the number of seeds in each sample was calculated.

Dry weight and seed yield—On about day 80 from sowing, the plants were harvested and left to dry at 30° C. in a drying chamber. The vegetative portion above ground was separated from the seeds. The total weight of the vegetative portion above ground and the seed weight of each plot were measured and divided by the number of plants.

Dry weight=total weight of the vegetative portion above ground (excluding roots) after drying at 30° C. in a drying chamber;

Seed yield per plant=total seed weight per plant (gr.).

1000 seed weight (the weight of 1000 seeds) (gr.).

Oil percentage in seeds—At the end of the experiment all seeds from each plot were collected. Seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) is used to create a calibration curve for the Low Resonance NMR. The content of oil of all seed samples was determined using the Low Resonance NMR (MARAN Ultra-Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical analyses—To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Tables 234-240 summarize the observed phenotypes of transgenic plants exogenously expressing the gene constructs using the seed maturation (GH-SM) assays under low nitrogen (Low N) conditions. The evaluation of each gene was performed by testing the performance of different number of events. Event with p-value <0.1 was considered statistically significant.

TABLE 234

Genes showing improved plant performance at Low Nitrogen growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LGN5 | 88198.1 | 884.2 | 0.27 | 2 | 46.0 | 0.14 | −2 | 38.5 | 0.20 | −1 |
| LGN5 | 88198.4 | — | — | — | 45.2 | 0.03 | −3 | 38.2 | 0.04 | −2 |
| LGN5 | 88201.1 | — | — | — | 47.1 | L | −1 | 38.9 | L | −2 |

TABLE 234-continued

Genes showing improved plant performance at Low Nitrogen growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LGN5 | 88201.3 | 947.9 | 0.27 | 10 | 46.3 | 0.29 | −3 | 38.9 | 0.27 | −2 |
| CONT. | — | 864.8 | — | — | 46.7 | — | — | 38.9 | — | — |
| LGN60 | 89175.1 | — | — | — | 47.4 | 0.10 | −3 | — | — | — |
| LGN60 | 89175.2 | — | — | — | 47.6 | 0.18 | −2 | — | — | — |
| LGN60 | 89176.1 | — | — | — | 47.5 | 0.12 | −2 | — | — | — |
| LGN60 | 89176.3 | 956.2 | 0.04 | 17 | 46.1 | 0.02 | −5 | 38.4 | 0.03 | −5 |
| CONT. | — | 818.1 | — | — | 48.7 | — | — | 40.3 | — | — |
| LGN49 | 89079.3 | — | — | — | 47.4 | 0.26 | −1 | — | — | — |
| LGN49 | 89081.1 | — | — | — | 47.1 | 0.12 | −2 | 39.0 | 0.29 | −2 |
| LGN49 | 89081.3 | 932.1 | 0.03 | 12 | — | — | — | — | — | — |
| LGN49 | 89082.1 | — | — | — | 45.6 | 0.09 | −5 | 38.2 | 0.08 | −4 |
| CONT. | — | 828.8 | — | — | 47.0 | — | — | 39.8 | — | — |
| LGN54 | 88208.2 | 955.9 | 0.16 | 5 | — | — | — | — | — | — |
| CONT. | — | 992.0 | — | — | — | — | — | — | — | — |
| LGN2 | 89029.2 | 855.0 | 0.17 | 9 | 46.4 | 0.02 | −3 | — | — | — |
| LGN2 | 89032.1 | 847.1 | 0.10 | 8 | — | — | — | — | — | — |
| CONT. | — | 782.4 | — | — | 48.0 | — | — | — | — | — |
| LGN5 | 88198.1 | — | — | — | 48.2 | 0.23 | −1 | 40.2 | 0.23 | −1 |
| LGN5 | 88198.4 | — | — | — | 47.1 | L | −3 | 39.8 | 0.05 | −2 |
| LGN5 | 88201.3 | 802.7 | 0.09 | 8 | — | — | — | — | — | — |
| CONT. | — | 793.1 | — | — | 48.8 | — | — | 40.4 | — | — |
| LGN54 | 88206.1 | — | — | — | 47.3 | 0.27 | −1 | 39.1 | 0.20 | −2 |
| CONT. | — | — | — | — | 47.9 | — | — | 39.8 | — | — |
| LGN36 | 89045.1 | — | — | — | 47.2 | 0.26 | −3 | — | — | — |
| LGN36 | 89047.1 | 590.4 | 0.13 | 9 | — | — | — | — | — | — |
| CONT. | — | 539.6 | — | — | 48.5 | — | — | — | — | — |
| LGN24 | 89094.2 | 570.4 | 0.02 | 11 | — | — | — | — | — | — |
| CONT. | — | 513.8 | — | — | — | — | — | — | — | — |
| NUE102 | 90004.1 | — | — | — | — | — | — | 38.0 | 0.23 | −4 |
| NUE102 | 90004.3 | — | — | — | — | — | — | 38.6 | 0.25 | −3 |
| NUE102 | 90005.2 | — | — | — | — | — | — | 38.3 | 0.25 | −3 |
| CONT. | — | — | — | — | — | — | — | 39.7 | — | — |
| LGN2 | 89029.2 | — | — | — | 43.3 | 0.02 | −5 | 35.2 | 0.15 | −5 |
| LGN2 | 89032.3 | — | — | — | 44.9 | 0.19 | −2 | — | — | — |
| LGN2 | 89033.1 | 795.0 | 0.17 | 8 | — | — | — | — | — | — |
| CONT. | — | 738.8 | — | — | 45.7 | — | — | 37.1 | — | — |
| NUE102 | 90004.3 | 849.6 | 0.25 | 5 | — | — | — | — | — | — |
| CONT. | — | 805.8 | — | — | — | — | — | — | — | — |
| LGN26 | 89036.1 | 720.8 | 0.29 | 6 | — | — | — | — | — | — |
| LGN26 | 89036.4 | 774.9 | 0.24 | 14 | — | — | — | — | — | — |
| LGN26 | 89037.2 | 854.6 | 0.01 | 26 | — | — | — | — | — | — |
| LGN26 | 89037.4 | 844.2 | L | 24 | — | — | — | — | — | — |
| CONT. | — | 680.3 | — | — | — | — | — | — | — | — |
| LGN60 | 89174.2 | — | — | — | — | — | — | 39.9 | 0.15 | −1 |
| LGN60 | 89175.1 | — | — | — | 47.6 | 0.21 | −2 | 39.9 | 0.14 | −1 |
| LGN60 | 89176.3 | 1000.7 | 0.09 | 20 | 46.7 | 0.03 | −4 | 39.7 | 0.05 | −2 |
| CONT. | — | 831.9 | — | — | 48.4 | — | — | 40.4 | — | — |
| LGN26 | 89036.4 | 504.3 | 0.17 | 10 | — | — | — | — | — | — |
| LGN26 | 89037.2 | 548.1 | L | 20 | — | — | — | 38.0 | 0.16 | −3 |
| LGN26 | 89037.3 | 514.6 | 0.06 | 13 | — | — | — | — | — | — |
| CONT. | — | 457.2 | — | — | — | — | — | 39.1 | — | — |
| LGN49 | 89079.3 | 712.4 | 0.29 | 10 | — | — | — | — | — | — |
| LGN49 | 89081.3 | 739.2 | 0.28 | 14 | 48.8 | 0.09 | −4 | 40.7 | 0.21 | −4 |
| LGN49 | 89081.6 | 710.4 | 0.25 | 10 | 48.0 | 0.03 | −5 | 40.2 | 0.12 | −5 |
| LGN49 | 89082.1 | — | — | — | 49.3 | 0.16 | −3 | 41.3 | 0.23 | −1 |
| CONT. | — | 647.8 | — | — | 50.8 | — | — | 42.2 | — | — |

Table 234. "CONT."—Control; "Ave."—Average; "% Incr." = % increment; "p-val."—p-value, L-p < 0.01.

TABLE 235

Genes showing improved plant performance at Low Nitrogen growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LGN36 | 89044.1 | 0.482 | 0.02 | 10 | 10.0 | L | 4 | 27.0 | 0.13 | 10 |
| LGN36 | 89047.1 | 0.461 | 0.08 | 5 | — | — | — | — | — | — |
| CONT. | — | 0.440 | — | — | 9.62 | — | — | 24.5 | — | — |
| LGN5 | 88198.1 | — | — | — | 10.8 | 0.21 | 5 | — | — | — |
| LGN5 | 88198.4 | 1.07 | 0.16 | 13 | 11.4 | 0.10 | 7 | 64.6 | 0.10 | 20 |
| LGN5 | 88201.1 | — | — | — | — | — | — | 52.1 | 0.23 | 3 |
| LGN5 | 88201.3 | 1.06 | 0.28 | 11 | 12.4 | 0.01 | 16 | 66.9 | 0.19 | 24 |
| CONT. | — | 0.949 | — | — | 10.7 | — | — | 54.0 | — | — |
| LGN60 | 89174.2 | — | — | — | 10.4 | 0.07 | 3 | — | — | — |
| LGN60 | 89175.2 | — | — | — | 10.4 | 0.13 | 3 | 46.8 | 0.24 | 9 |
| LGN60 | 89176.1 | 0.879 | 0.09 | 10 | — | — | — | 48.6 | 0.13 | 13 |
| LGN60 | 89176.3 | 0.938 | 0.01 | 18 | 10.7 | 0.04 | 4 | 53.0 | 0.02 | 23 |
| CONT. | — | 0.795 | — | — | 10.3 | — | — | 43.0 | — | — |
| LGN49 | 89081.1 | 0.888 | 0.09 | 5 | — | — | — | 51.1 | 0.09 | 7 |
| LGN49 | 89081.3 | 0.998 | 0.28 | 8 | 10.9 | 0.02 | 6 | 59.8 | 0.09 | 14 |
| LGN49 | 89081.6 | 1.01 | 0.13 | 20 | 11.1 | 0.08 | 9 | 60.8 | 0.29 | 16 |
| LGN49 | 89082.1 | 0.963 | 0.03 | 14 | — | — | — | 56.9 | 0.22 | 8 |
| CONT. | — | 0.925 | — | — | 10.2 | — | — | 52.5 | — | — |
| LGN54 | 88207.3 | — | — | — | 10.7 | 0.22 | 6 | — | — | — |
| CONT. | — | — | — | — | 10.1 | — | — | — | — | — |
| LGN2 | 89029.2 | 0.925 | 0.09 | 10 | 11.4 | L | 7 | 58.2 | 0.03 | 21 |
| CONT. | — | 0.838 | — | — | 10.6 | — | — | 48.2 | — | — |
| LGN5 | 88198.4 | 1.06 | L | 22 | 10.8 | 0.20 | 5 | 61.3 | L | 26 |
| LGN5 | 88201.3 | — | — | — | 10.7 | 0.19 | 6 | — | — | — |
| LGN5 | 88203.2 | 0.932 | 0.24 | 8 | — | — | — | — | — | — |
| CONT. | — | 0.870 | — | — | 10.3 | — | — | 48.5 | — | — |
| LGN24 | 89094.2 | 0.677 | L | 33 | 10.0 | 0.18 | 5 | 37.7 | L | 35 |
| LGN24 | 89094.3 | 0.573 | 0.14 | 13 | — | — | — | 31.8 | 0.13 | 14 |
| LGN24 | 89096.1 | 0.553 | 0.22 | 9 | 10.0 | 0.24 | 4 | 30.8 | 0.21 | 10 |
| LGN24 | 89096.2 | — | — | — | — | — | — | 30.9 | 0.30 | 10 |
| CONT. | — | 0.509 | — | — | 9.59 | — | — | 28.0 | — | — |
| LGN54 | 88207.3 | — | — | — | 10.4 | 0.20 | 2 | 55.3 | 0.27 | 6 |
| CONT. | — | — | — | — | 10.2 | — | — | 52.3 | — | — |
| LGN36 | 89044.1 | — | — | — | — | — | — | 30.5 | 0.22 | 5 |
| LGN36 | 89047.2 | — | — | — | 10.4 | 0.13 | 2 | — | — | — |
| CONT. | — | — | — | — | 10.2 | — | — | 29.2 | — | — |
| LGN6 | 89169.2 | — | — | — | 10.9 | 0.04 | 6 | — | — | — |
| LGN6 | 89170.1 | — | — | — | 11.0 | 0.05 | 6 | — | — | — |
| LGN6 | 89171.4 | — | — | — | 10.8 | 0.06 | 5 | — | — | — |
| CONT. | — | — | — | — | 10.3 | — | — | — | — | — |
| LGN24 | 89094.2 | 0.768 | 0.01 | 21 | — | — | — | 42.7 | L | 21 |
| CONT. | — | 0.634 | — | — | — | — | — | 35.4 | — | — |
| NUE102 | 90003.5 | — | — | — | — | — | — | 34.5 | 0.10 | 6 |
| NUE102 | 90004.1 | 0.690 | 0.11 | 15 | — | — | — | 38.6 | 0.07 | 19 |
| CONT. | — | 0.602 | — | — | — | — | — | 32.5 | — | — |
| LGN2 | 89029.2 | 0.890 | 0.02 | 24 | 10.2 | 0.29 | 3 | 48.7 | L | 25 |
| CONT. | — | 0.717 | — | — | 9.84 | — | — | 38.9 | — | — |
| LGN60 | 89175.2 | — | — | — | 10.3 | 0.01 | 4 | 51.7 | 0.28 | 12 |
| LGN60 | 89176.3 | 0.924 | L | 9 | 10.6 | 0.06 | 6 | 53.6 | 0.10 | 13 |
| CONT. | — | 0.886 | — | — | 9.97 | — | — | 47.4 | — | — |
| LGN26 | 89036.1 | 0.581 | 0.27 | 4 | — | — | — | — | — | — |
| CONT. | — | 0.557 | — | — | — | — | — | — | — | — |
| LGN49 | 89081.3 | 0.886 | 0.29 | 6 | — | — | — | 49.1 | 0.27 | 9 |
| LGN49 | 89081.6 | 0.970 | 0.06 | 16 | — | — | — | 53.5 | 0.06 | 19 |
| CONT. | — | 0.838 | — | — | — | — | — | 44.9 | — | — |

Table 235. "CONT."—Control; "Ave."—Average; "% Incr." = % increment; "p-val."—p-value, L-p < 0.01.

TABLE 236

Genes showing improved plant performance at Low Nitrogen growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LGN36 | 89044.1 | 0.664 | 0.21 | 12 | 3.00 | 0.16 | 9 | 0.192 | 0.30 | 3 |
| CONT. | — | 0.592 | — | — | 2.74 | — | — | 0.185 | — | — |

TABLE 236-continued

Genes showing improved plant performance at Low Nitrogen growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LGN5 | 88198.4 | — | — | — | 7.16 | 0.13 | 18 | 0.341 | 0.19 | 9 |
| LGN5 | 88201.1 | — | — | — | 5.87 | 0.25 | 3 | — | — | — |
| LGN5 | 88201.3 | 0.618 | 0.12 | 12 | 7.50 | 0.22 | 24 | — | — | — |
| CONT. | — | 0.551 | — | — | 6.05 | — | — | 0.322 | — | — |
| LGN60 | 89174.2 | 0.641 | L | 16 | — | — | — | — | — | — |
| LGN60 | 89175.2 | 0.596 | 0.13 | 8 | 5.30 | 0.30 | 9 | — | — | — |
| LGN60 | 89176.1 | — | — | — | 5.56 | 0.13 | 14 | 0.314 | 0.21 | 9 |
| LGN60 | 89176.3 | — | — | — | 5.77 | 0.06 | 18 | — | — | — |
| CONT. | — | 0.551 | — | — | 4.88 | — | — | 0.289 | — | — |
| LGN49 | 89079.3 | 0.566 | 0.05 | 20 | — | — | — | — | — | — |
| LGN49 | 89081.1 | — | — | — | 5.68 | 0.09 | 8 | 0.308 | 0.03 | 7 |
| LGN49 | 89081.3 | — | — | — | 6.45 | 0.15 | 12 | 0.311 | 0.10 | 8 |
| LGN49 | 89081.6 | — | — | — | 6.64 | 0.19 | 27 | 0.335 | 0.16 | 16 |
| LGN49 | 89082.1 | — | — | — | 6.29 | 0.24 | 9 | 0.317 | 0.11 | 10 |
| CONT. | — | 0.471 | — | — | 5.76 | — | — | 0.310 | — | — |
| LGN54 | 88206.1 | 0.619 | 0.12 | 21 | — | — | — | — | — | — |
| LGN54 | 88207.3 | 0.637 | 0.11 | 25 | — | — | — | — | — | — |
| CONT. | — | 0.510 | — | — | — | — | — | — | — | — |
| LGN2 | 89029.2 | 0.719 | 0.14 | 10 | 6.87 | 0.03 | 22 | 0.361 | 0.04 | 11 |
| CONT. | — | 0.652 | — | — | 5.65 | — | — | 0.325 | — | — |
| LGN5 | 88198.4 | — | — | — | 6.99 | 0.01 | 28 | 0.354 | 0.02 | 14 |
| LGN5 | 88203.2 | — | — | — | — | — | — | 0.339 | 0.07 | 9 |
| CONT. | — | — | — | — | 5.48 | — | — | 0.310 | — | — |
| LGN24 | 89094.2 | — | — | — | 4.05 | 0.01 | 32 | 0.196 | 0.16 | 16 |
| LGN24 | 89094.3 | — | — | — | 3.47 | 0.17 | 14 | — | — | — |
| LGN24 | 89096.1 | — | — | — | 3.34 | 0.30 | 9 | — | — | — |
| CONT. | — | — | — | — | 3.06 | — | — | 0.169 | — | — |
| LGN54 | 88206.4 | 0.577 | 0.08 | 8 | — | — | — | — | — | — |
| LGN54 | 88207.3 | 0.579 | 0.21 | 8 | — | — | — | — | — | — |
| LGN54 | 88208.2 | 0.632 | 0.08 | 17 | — | — | — | — | — | — |
| CONT. | — | 0.540 | — | — | — | — | — | — | — | — |
| LGN36 | 89047.2 | 0.728 | 0.08 | 10 | — | — | — | — | — | — |
| CONT. | — | 0.662 | — | — | — | — | — | — | — | — |
| LGN6 | 89169.2 | 0.659 | 0.07 | 18 | — | — | — | — | — | — |
| LGN6 | 89170.1 | 0.681 | L | 22 | — | — | — | — | — | — |
| LGN6 | 89171.4 | 0.682 | 0.11 | 22 | — | — | — | — | — | — |
| LGN6 | 89173.1 | 0.646 | 0.24 | 15 | — | — | — | — | — | — |
| CONT. | — | 0.560 | — | — | — | — | — | — | — | — |
| LGN24 | 89094.2 | — | — | — | 4.68 | L | 19 | 0.201 | 0.16 | 7 |
| LGN24 | 89094.3 | — | — | — | — | — | — | 0.197 | 0.27 | 5 |
| LGN24 | 89096.2 | — | — | — | — | — | — | 0.199 | 0.29 | 6 |
| CONT. | — | — | — | — | 3.93 | — | — | 0.188 | — | — |
| NUE102 | 90003.5 | — | — | — | 4.68 | 0.25 | 5 | — | — | — |
| NUE102 | 90004.1 | — | — | — | 5.29 | 0.11 | 18 | 0.341 | 0.30 | 4 |
| CONT. | — | — | — | — | 4.48 | — | — | 0.328 | — | — |
| LGN2 | 89029.2 | — | — | — | 6.80 | L | 27 | 0.414 | L | 18 |
| LGN2 | 89029.7 | 0.820 | 0.11 | 6 | — | — | — | — | — | — |
| CONT. | — | 0.774 | — | — | 5.34 | — | — | 0.352 | — | — |
| LGN26 | 89037.4 | 0.707 | 0.29 | 7 | — | — | — | — | — | — |
| CONT. | — | 0.658 | — | — | — | — | — | — | — | — |
| LGN60 | 89174.2 | — | — | — | — | — | — | 0.330 | L | 4 |
| LGN60 | 89175.1 | — | — | — | — | — | — | 0.335 | 0.10 | 6 |
| LGN60 | 89175.2 | — | — | — | — | — | — | 0.325 | 0.14 | 3 |
| LGN60 | 89176.3 | — | — | — | 6.17 | 0.13 | 11 | 0.332 | 0.11 | 5 |
| CONT. | — | — | — | — | 5.54 | — | — | 0.324 | — | — |
| LGN49 | 89081.3 | — | — | — | 5.50 | 0.03 | 10 | — | — | — |
| LGN49 | 89081.6 | — | — | — | 5.95 | 0.10 | 18 | 0.321 | 0.25 | 4 |
| CONT. | — | — | — | — | 5.06 | — | — | 0.312 | — | — |

Table 236. "CONT."—Control; "Ave."—Average; "% Incr." = % increment; "p-val."—p-value, L—p < 0.01.

TABLE 237

Genes showing improved plant performance at Low Nitrogen growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGN36 | 89044.1 | 0.0942 | 0.19 | 30 | 3.38 | 0.13 | 10 | 3.01 | 0.24 | 4 |
| LGN36 | 89047.2 | 0.0979 | 0.16 | 35 | — | — | — | — | — | — |
| CONT. | — | 0.0725 | — | — | 3.06 | — | — | 2.90 | — | — |
| LGN5 | 88198.4 | — | — | — | 8.08 | 0.10 | 20 | 4.80 | 0.15 | 8 |
| LGN5 | 88201.1 | — | — | — | 6.51 | 0.23 | 3 | — | — | — |
| LGN5 | 88201.3 | — | — | — | 8.36 | 0.19 | 24 | 4.73 | 0.28 | 10 |
| CONT. | — | — | — | — | 6.75 | — | — | 4.44 | — | — |
| LGN60 | 89174.2 | 0.241 | 0.17 | 9 | — | — | — | — | — | — |
| LGN60 | 89175.1 | 0.252 | 0.21 | 8 | — | — | — | — | — | — |
| LGN60 | 89175.2 | — | — | — | 5.85 | 0.24 | 9 | — | — | — |
| LGN60 | 89176.1 | — | — | — | 6.07 | 0.13 | 13 | 4.27 | 0.11 | 8 |
| LGN60 | 89176.3 | — | — | — | 6.62 | 0.02 | 23 | 4.38 | 0.04 | 10 |
| CONT. | — | 0.233 | — | — | 5.37 | — | — | 3.97 | — | — |
| LGN49 | 89081.1 | — | — | — | 6.39 | 0.11 | 6 | 4.35 | 0.07 | 3 |
| LGN49 | 89081.3 | — | — | — | 7.48 | 0.09 | 14 | 4.61 | 0.24 | 5 |
| LGN49 | 89081.6 | — | — | — | 7.60 | 0.29 | 16 | 4.81 | 0.22 | 9 |
| LGN49 | 89082.1 | 0.211 | 0.08 | 28 | 7.12 | 0.22 | 8 | 4.56 | 0.08 | 8 |
| CONT. | — | 0.164 | — | — | 6.56 | — | — | 4.41 | — | — |
| LGN54 | 88206.1 | 0.188 | L | 48 | — | — | — | — | — | — |
| LGN54 | 88207.3 | 0.162 | 0.16 | 27 | — | — | — | — | — | — |
| CONT. | — | 0.128 | — | — | — | — | — | — | — | — |
| LGN2 | 89029.2 | 0.148 | 0.12 | 15 | 7.28 | 0.03 | 21 | 4.52 | 0.01 | 11 |
| CONT. | — | 0.129 | — | — | 6.03 | — | — | 4.09 | — | — |
| LGN5 | 88198.4 | — | — | — | 7.66 | L | 26 | 4.82 | L | 14 |
| LGN5 | 88203.2 | — | — | — | 6.29 | 0.22 | 7 | 4.54 | 0.07 | 8 |
| CONT. | — | — | — | — | 6.06 | — | — | 4.22 | — | — |
| LGN24 | 89094.2 | — | — | — | 4.71 | L | 35 | 3.48 | 0.02 | 16 |
| LGN24 | 89094.3 | — | — | — | 3.98 | 0.13 | 14 | 3.20 | 0.17 | 6 |
| LGN24 | 89096.1 | — | — | — | 3.85 | 0.21 | 10 | 3.15 | 0.26 | 5 |
| LGN24 | 89096.2 | — | — | — | 3.86 | 0.30 | 10 | — | — | — |
| CONT. | — | — | — | — | 3.50 | — | — | 3.01 | — | — |
| LGN54 | 88206.4 | 0.306 | 0.06 | 15 | — | — | — | — | — | — |
| LGN54 | 88207.2 | 0.317 | L | 19 | — | — | — | — | — | — |
| LGN54 | 88207.3 | 0.291 | 0.13 | 9 | 6.91 | 0.27 | 6 | — | — | — |
| LGN54 | 88208.2 | 0.297 | 0.20 | 12 | — | — | — | — | — | — |
| CONT. | — | 0.266 | — | — | 6.53 | — | — | — | — | — |
| LGN36 | 89044.1 | — | — | — | 3.82 | 0.22 | 5 | — | — | — |
| CONT. | — | — | — | — | 3.65 | — | — | — | — | — |
| LGN6 | 89170.1 | 0.176 | 0.25 | 17 | — | — | — | — | — | — |
| CONT. | — | 0.150 | — | — | — | — | — | — | — | — |
| LGN24 | 89094.2 | — | — | — | 5.34 | L | 21 | 3.73 | L | 9 |
| LGN24 | 89094.3 | — | — | — | — | — | — | 3.49 | 0.24 | 2 |
| LGN24 | 89096.1 | 0.154 | 0.08 | 13 | — | — | — | — | — | — |
| CONT. | — | 0.136 | — | — | 4.42 | — | — | 3.41 | — | — |
| NUE102 | 90003.5 | — | — | — | 4.32 | 0.10 | 6 | — | — | — |
| NUE102 | 90004.1 | 0.212 | 0.22 | 24 | 4.82 | 0.07 | 19 | 3.88 | 0.03 | 10 |
| CONT. | — | 0.172 | — | — | 4.06 | — | — | 3.53 | — | — |
| LGN2 | 89029.2 | 0.210 | 0.14 | 17 | 6.09 | L | 25 | 4.48 | L | 15 |
| CONT. | — | 0.179 | — | — | 4.86 | — | — | 3.88 | — | — |
| LGN60 | 89174.2 | 0.315 | 0.26 | 16 | — | — | — | — | — | — |
| LGN60 | 89175.1 | — | — | — | — | — | — | 4.38 | 0.03 | 3 |
| LGN60 | 89175.2 | — | — | — | 6.46 | 0.28 | 12 | 4.45 | 0.25 | 5 |
| LGN60 | 89176.3 | — | — | — | 6.70 | 0.10 | 13 | 4.47 | 0.12 | 5 |
| CONT. | — | 0.286 | — | — | 5.93 | — | — | 4.25 | — | — |
| LGN49 | 89079.3 | 0.209 | 0.11 | 17 | — | — | — | — | — | — |
| LGN49 | 89081.1 | 0.207 | 0.23 | 16 | — | — | — | — | — | — |
| LGN49 | 89081.3 | — | — | — | 6.14 | 0.27 | 9 | 4.34 | 0.23 | 4 |
| LGN49 | 89081.6 | — | — | — | 6.69 | 0.06 | 19 | 4.61 | 0.05 | 10 |
| CONT. | — | 0.179 | — | — | 5.61 | — | — | 4.19 | — | — |

Table 237. "CONT."—Control; "Ave."—Average; "% Incr." = % increment; "p-val."—p-value, L—p < 0.01.

TABLE 238

Genes showing improved plant performance at Low Nitrogen growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LGN36 | 89044.1 | 62.9 | 0.19 | 36 | — | — | — |
| LGN36 | 89047.2 | 59.7 | 0.26 | 29 | — | — | — |
| CONT. | — | 46.4 | — | — | — | — | — |
| LGN5 | 88198.1 | — | — | — | 19.3 | 0.02 | 6 |
| LGN5 | 88198.4 | — | — | — | 18.4 | 0.12 | 7 |
| LGN5 | 88201.3 | — | — | — | 19.5 | 0.20 | 8 |
| CONT. | — | — | — | — | 18.2 | — | — |
| LGN60 | 89174.2 | — | — | — | 17.4 | 0.26 | 4 |
| LGN60 | 89175.1 | 213.2 | 0.03 | 12 | 18.3 | 0.02 | 10 |
| LGN60 | 89175.2 | — | — | — | 18.8 | 0.13 | 13 |
| LGN60 | 89176.3 | — | — | — | 22.3 | L | 34 |
| CONT. | — | 189.9 | — | — | 16.7 | — | — |
| LGN49 | 89079.3 | 159.1 | 0.21 | 18 | — | — | — |
| LGN49 | 89081.3 | 162.5 | 0.23 | 20 | 21.1 | 0.05 | 12 |
| LGN49 | 89081.6 | — | — | — | 19.7 | 0.28 | 5 |
| LGN49 | 89082.1 | 168.7 | 0.05 | 25 | — | — | — |
| CONT. | — | 135.0 | — | — | 18.8 | — | — |
| LGN54 | 88206.1 | 160.7 | 0.08 | 27 | — | — | — |
| CONT. | — | 126.7 | — | — | — | — | — |
| LGN2 | 89029.2 | 126.4 | L | 26 | — | — | — |
| CONT. | — | 100.5 | — | — | — | — | — |
| LGN5 | 88198.1 | — | — | — | 21.0 | L | 8 |
| LGN5 | 88201.3 | — | — | — | 21.5 | 0.03 | 11 |
| CONT. | — | — | — | — | 19.4 | — | — |
| LGN24 | 89094.2 | — | — | — | 19.1 | L | 15 |
| CONT. | — | — | — | — | 16.5 | — | — |
| LGN54 | 88206.1 | — | — | — | 20.9 | 0.18 | 3 |
| CONT. | — | — | — | — | 21.0 | — | — |
| LGN6 | 89169.2 | — | — | — | 19.5 | L | 12 |
| CONT. | — | — | — | — | 17.4 | — | — |
| LGN3 | 89069.5 | — | — | — | 15.9 | 0.19 | 7 |
| LGN3 | 89072.3 | — | — | — | 16.0 | 0.19 | 8 |
| LGN3 | 89072.4 | — | — | — | 15.5 | 0.09 | 4 |
| LGN3 | 89073.1 | — | — | — | 16.6 | 0.11 | 12 |
| CONT. | — | — | — | — | 14.9 | — | — |
| LGN24 | 89094.2 | 80.6 | 0.17 | 15 | 19.6 | 0.01 | 13 |
| CONT. | — | 70.2 | — | — | 17.3 | — | — |
| NUE102 | 90004.1 | 158.1 | 0.20 | 22 | — | — | — |
| CONT. | — | 130.0 | — | — | — | — | — |
| LGN2 | 89029.2 | 164.6 | 0.21 | 25 | — | — | — |
| CONT. | — | 131.9 | — | — | — | — | — |
| LGN26 | 89037.3 | — | — | — | 18.7 | L | 12 |
| CONT. | — | — | — | — | 16.7 | — | — |
| LGN60 | 89174.2 | 266.1 | 0.24 | 21 | — | — | — |
| LGN60 | 89176.3 | 249.7 | 0.17 | 14 | 22.9 | 0.02 | 16 |
| CONT. | — | 237.7 | — | — | 19.6 | — | — |
| LGN26 | 89036.1 | — | — | — | 17.1 | 0.13 | 2 |
| LGN26 | 89037.3 | — | — | — | 18.2 | 0.02 | 9 |
| CONT. | — | — | — | — | 16.7 | — | — |
| LGN49 | 89079.3 | 148.3 | 0.11 | 27 | — | — | — |
| LGN49 | 89081.3 | — | — | — | 20.0 | 0.02 | 10 |
| LGN49 | 89081.6 | — | — | — | 20.8 | 0.01 | 14 |
| CONT. | — | 117.0 | — | — | 18.3 | — | — |

Table 238. "CONT."—Control; "Ave."—Average; "% Incr." = % increment; "p-val."—p-value, L—p < 0.01.

TABLE 239

Genes showing improved plant performance at Low Nitrogen growth conditions under regulation of At6669 promoter

| Gene Name | Event # | 1000 Seed Weight [mg] Ave. | P-Val. | % Incr. |
|---|---|---|---|---|
| LGN5 | 88198.1 | 19.3 | 0.02 | 6 |
| LGN5 | 88198.4 | 18.4 | 0.12 | 7 |
| LGN5 | 88201.3 | 19.5 | 0.20 | 8 |
| CONT. | — | 18.2 | — | — |
| LGN60 | 89174.2 | 17.4 | 0.26 | 4 |
| LGN60 | 89175.1 | 18.3 | 0.02 | 10 |
| LGN60 | 89175.2 | 18.8 | 0.13 | 13 |
| LGN60 | 89176.3 | 22.3 | L | 34 |
| CONT. | — | 16.7 | — | — |
| LGN49 | 89081.3 | 21.1 | 0.05 | 12 |
| LGN49 | 89081.6 | 19.7 | 0.28 | 5 |
| CONT. | — | 18.8 | — | — |
| LGN5 | 88198.1 | 21.0 | L | 8 |
| LGN5 | 88201.3 | 21.5 | 0.03 | 11 |
| CONT. | — | 19.4 | — | — |
| LGN24 | 89094.2 | 19.1 | L | 15 |
| CONT. | — | 16.5 | — | — |
| LGN54 | 88206.1 | 20.9 | 0.18 | 3 |
| CONT. | — | 21.0 | — | — |
| LGN6 | 89169.2 | 19.5 | L | 12 |
| CONT. | — | 17.4 | — | — |
| LGN3 | 89069.5 | 15.9 | 0.19 | 7 |
| LGN3 | 89072.3 | 16.0 | 0.19 | 8 |
| LGN3 | 89072.4 | 15.5 | 0.09 | 4 |
| LGN3 | 89073.1 | 16.6 | 0.11 | 12 |
| CONT. | — | 14.9 | — | — |
| LGN24 | 89094.2 | 19.6 | 0.01 | 13 |
| CONT. | — | 17.3 | — | — |
| LGN26 | 89037.3 | 18.7 | L | 12 |
| CONT. | — | 16.7 | — | — |
| LGN60 | 89176.3 | 22.9 | 0.02 | 16 |
| CONT. | — | 19.6 | — | — |
| LGN26 | 89036.1 | 17.1 | 0.13 | 2 |
| LGN26 | 89037.3 | 18.2 | 0.02 | 9 |
| CONT. | — | 16.7 | — | — |
| LGN49 | 89081.3 | 20.0 | 0.02 | 10 |
| LGN49 | 89081.6 | 20.8 | 0.01 | 14 |
| CONT. | — | 18.3 | — | — |

Table 239. "CONT."—Control; "Ave."—Average; "% Incr." = % increment; "p-val."—p-value, L—p < 0.01.

TABLE 240

Genes showing improved plant performance at Low Nitrogen growth conditions under regulation of At6669 promoter

| Gene Name | Event # | Harvest Index Ave. | P-Val. | % Incr. |
|---|---|---|---|---|
| LGN36 | 89044.1 | 0.0942 | 0.19 | 30 |
| LGN36 | 89047.2 | 0.0979 | 0.16 | 35 |
| CONT. | — | 0.0725 | — | — |
| LGN60 | 89174.2 | 0.241 | 0.17 | 9 |
| LGN60 | 89175.1 | 0.252 | 0.21 | 8 |
| CONT. | — | 0.233 | — | — |
| LGN49 | 89082.1 | 0.211 | 0.08 | 28 |
| CONT. | — | 0.164 | — | — |
| LGN54 | 88206.1 | 0.188 | L | 48 |
| LGN54 | 88207.3 | 0.162 | 0.16 | 27 |
| CONT. | — | 0.128 | — | — |
| LGN2 | 89029.2 | 0.148 | 0.12 | 15 |
| CONT. | — | 0.129 | — | — |
| LGN54 | 88206.4 | 0.306 | 0.06 | 15 |
| LGN54 | 88207.2 | 0.317 | L | 19 |
| LGN54 | 88207.3 | 0.291 | 0.13 | 9 |
| LGN54 | 88208.2 | 0.297 | 0.20 | 12 |
| CONT. | — | 0.266 | — | — |

TABLE 240-continued

Genes showing improved plant performance at Low Nitrogen growth conditions under regulation of At6669 promoter

| | | Harvest Index | | |
|---|---|---|---|---|
| Gene Name | Event # | Ave. | P-Val. | % Incr. |
| LGN6 | 89170.1 | 0.176 | 0.25 | 17 |
| CONT. | — | 0.150 | — | — |
| LGN24 | 89096.1 | 0.154 | 0.08 | 13 |
| CONT. | — | 0.136 | — | — |
| NUE102 | 90004.1 | 0.212 | 0.22 | 24 |
| CONT. | — | 0.172 | — | — |
| LGN2 | 89029.2 | 0.210 | 0.14 | 17 |
| CONT. | — | 0.179 | — | — |
| LGN60 | 89174.2 | 0.315 | 0.26 | 16 |
| CONT. | — | 0.286 | — | — |
| LGN49 | 89079.3 | 0.209 | 0.11 | 17 |
| LGN49 | 89081.1 | 0.207 | 0.23 | 16 |
| CONT. | — | 0.179 | — | — |

Table 240. "CONT."—Control; "Ave."—Average; "% Incr." = % increment; "p-val."—p-value, L—p < 0.01.

Tables 241-247 summarize the observed phenotypes of transgenic plants exogenously expressing the gene constructs using the seed maturation (GH-SM) assays under normal conditions. The evaluation of each gene was performed by testing the performance of different number of events. Event with p-value <0.1 was considered statistically significant.

TABLE 241

Genes showing improved plant performance at Normal growth conditions under regulation of At6669 promoter

| | | Dry Weight [mg] | | | Flowering | | | Inflorescence Emergence | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LGN36 | 89047.1 | 961.2 | 0.24 | 7 | — | — | — | — | — | — |
| CONT. | — | 900.0 | — | — | — | — | — | — | — | — |
| LBY96 | 92428.4 | 1608.1 | L | 21 | — | — | — | — | — | — |
| LBY87 | 92256.1 | 1412.5 | 0.08 | 6 | — | — | — | — | — | — |
| LBY30 | 92324.4 | 1400.0 | 0.13 | 5 | 35.6 | 0.02 | -4 | 28.2 | 0.11 | -2 |
| LBY225 | 91605.3 | — | — | — | — | — | — | 28.2 | 0.09 | -2 |
| LBY225 | 91607.3 | — | — | — | — | — | — | 28.4 | 0.25 | -2 |
| LBY225 | 91607.5 | — | — | — | — | — | — | 27.9 | 0.09 | -3 |
| LBY213 | 92030.2 | 1424.4 | 0.08 | 7 | — | — | — | — | — | — |
| LBY213 | 92032.1 | 1378.8 | 0.27 | 4 | — | — | — | — | — | — |
| LBY213 | 92032.4 | 1384.4 | 0.21 | 4 | — | — | — | — | — | — |
| LBY212 | 92026.4 | — | — | — | — | — | — | 27.9 | 0.21 | -3 |
| LBY212 | 92028.3 | 1395.1 | 0.20 | 5 | — | — | — | — | — | — |
| LBY202 | 92021.1 | — | — | — | — | — | — | 28.4 | 0.28 | -2 |
| LBY202 | 92022.3 | 1528.1 | 0.15 | 15 | — | — | — | — | — | — |
| LBY193 | 91660.2 | 1409.4 | 0.08 | 6 | — | — | — | 27.7 | 0.28 | -4 |
| LBY193 | 91662.1 | — | — | — | — | — | — | 28.3 | 0.14 | -2 |
| LBY182 | 92396.1 | — | — | — | — | — | — | 28.3 | 0.18 | -2 |
| LBY174 | 92080.1 | 1435.6 | 0.14 | 8 | — | — | — | — | — | — |
| LBY158 | 91649.1 | — | — | — | 35.9 | 0.04 | -3 | — | — | — |
| LBY154 | 92432.3 | 1569.4 | 0.07 | 18 | — | — | — | — | — | — |
| LBY146 | 91590.2 | — | — | — | 35.0 | L | -5 | 27.2 | L | -6 |
| LBY146 | 91590.4 | — | — | — | — | — | — | 27.9 | 0.03 | -3 |
| LBY146 | 91593.3 | — | — | — | 34.2 | L | -7 | 27.6 | 0.21 | -4 |
| LBY146 | 91594.1 | — | — | — | 35.9 | 0.04 | -3 | — | — | — |
| LBY139 | 92241.2 | — | — | — | — | — | — | 28.2 | 0.11 | -2 |
| LBY135 | 92321.6 | — | — | — | 35.8 | 0.05 | -3 | 28.1 | 0.06 | -3 |
| LBY135 | 92322.1 | 1497.5 | 0.13 | 13 | 35.6 | 0.02 | -3 | 28.2 | 0.11 | -2 |
| LBY113 | 92234.1 | — | — | — | 36.0 | 0.05 | -2 | 28.3 | 0.18 | -2 |
| LBY113 | 92234.2 | 1429.4 | 0.04 | 7 | 35.9 | 0.04 | -3 | — | — | — |
| LBY113 | 92234.5 | — | — | — | 35.7 | 0.02 | -3 | 28.2 | 0.13 | -2 |
| CONT. | — | 1331.1 | — | — | 36.9 | — | — | 28.9 | — | — |
| LGN5 | 88198.1 | — | — | — | 45.1 | L | -2 | 38.0 | 0.07 | -1 |
| LGN5 | 88198.4 | — | — | — | 44.8 | L | -3 | 38.0 | 0.07 | -1 |
| LGN5 | 88201.3 | — | — | — | — | — | — | 38.0 | 0.07 | -1 |
| CONT. | — | — | — | — | 45.1 | — | — | 38.1 | — | — |
| LBY97 | 92034.3 | — | — | — | 29.8 | 0.23 | -1 | 22.0 | 0.14 | -2 |
| LBY87 | 92255.1 | — | — | — | 29.3 | 0.14 | -3 | 21.8 | 0.10 | -3 |
| LBY81 | 92009.1 | — | — | — | 28.9 | 0.30 | -4 | 21.6 | 0.21 | -4 |
| LBY81 | 92013.1 | — | — | — | 30.0 | 0.29 | -1 | 22.0 | 0.14 | -2 |
| LBY25 | 91335.3 | — | — | — | 29.1 | 0.24 | -4 | 21.8 | 0.10 | -3 |
| LBY25 | 91338.2 | — | — | — | 29.6 | 0.01 | -2 | 21.8 | 0.10 | -3 |
| LBY230 | 91667.1 | — | — | — | 30.0 | 0.29 | -1 | — | — | — |
| LBY230 | 91669.3 | — | — | — | — | — | — | 21.6 | 0.02 | -4 |
| LBY217 | 92359.2 | — | — | — | 29.3 | 0.14 | -3 | — | — | — |
| LBY217 | 92362.1 | — | — | — | 29.8 | 0.23 | -1 | — | — | — |
| LBY138 | 92075.2 | — | — | — | 28.8 | 0.02 | -5 | 21.3 | L | -5 |
| LBY138 | 92076.1 | — | — | — | 29.8 | 0.23 | -1 | — | — | — |

TABLE 241-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LBY138 | 92078.4 | — | — | — | 28.2 | L | −7 | 21.2 | L | −6 |
| LBY136 | 91442.9 | — | — | — | — | — | — | 21.2 | L | −6 |
| LBY135 | 92321.6 | — | — | — | — | — | — | 21.5 | 0.24 | −4 |
| LBY135 | 92322.1 | — | — | — | — | — | — | 21.7 | 0.16 | −4 |
| LBY135 | 92323.1 | — | — | — | 30.0 | 0.29 | −1 | — | — | — |
| LBY120 | 91211.2 | — | — | — | 29.1 | 0.24 | −4 | 21.8 | 0.10 | −3 |
| LBY118 | 91432.3 | — | — | — | 28.2 | L | −7 | 21.4 | 0.03 | −5 |
| LBY117 | 91366.1 | — | — | — | — | — | — | 21.5 | 0.02 | −5 |
| LBY117 | 91366.3 | — | — | — | 26.5 | L | −12 | 21.1 | L | −6 |
| LBY112 | 92051.1 | — | — | — | 28.1 | L | −7 | 21.0 | L | −7 |
| LBY112 | 92051.3 | — | — | — | 28.3 | L | −6 | 21.2 | L | −6 |
| LBY112 | 92053.2 | — | — | — | — | — | — | 21.7 | 0.16 | −4 |
| LBY112 | 92053.6 | — | — | — | — | — | — | 21.8 | 0.10 | −3 |
| LBY108 | 91422.2 | — | — | — | 29.8 | 0.23 | −1 | — | — | — |
| LBY108 | 91423.1 | — | — | — | 28.2 | 0.05 | −7 | 21.1 | L | −6 |
| LBY103 | 91381.11 | — | — | — | — | — | — | 21.8 | 0.10 | −3 |
| LBY103 | 91381.6 | — | — | — | 28.7 | 0.08 | −5 | 21.7 | 0.16 | −4 |
| LBY103 | 91381.9 | — | — | — | 28.1 | 0.11 | −7 | 21.1 | L | −6 |
| CONT. | — | — | — | — | 30.2 | — | — | 22.5 | — | — |
| LBY79 | 92223.3 | — | — | — | — | — | — | 18.7 | 0.14 | −4 |
| LBY72 | 92764.1 | — | — | — | 25.2 | 0.14 | −2 | — | — | — |
| LBY72 | 92766.4 | — | — | — | — | — | — | 18.4 | 0.03 | −6 |
| LBY36 | 92526.1 | — | — | — | 23.9 | 0.14 | −7 | 18.2 | L | −7 |
| LBY36 | 92526.2 | — | — | — | — | — | — | 19.0 | 0.10 | −3 |
| LBY32 | 92830.3 | — | — | — | 24.9 | 0.03 | −3 | 18.3 | L | −6 |
| LBY32 | 92830.4 | — | — | — | — | — | — | 19.0 | 0.10 | −3 |
| LBY32 | 92832.1 | — | — | — | — | — | — | 18.8 | 0.08 | −4 |
| LBY30 | 92326.1 | — | — | — | 25.0 | 0.25 | −2 | 18.4 | 0.03 | −6 |
| LBY233 | 92474.3 | — | — | — | 24.9 | 0.15 | −3 | — | — | — |
| LBY233 | 92477.1 | — | — | — | 24.6 | 0.04 | −4 | 18.3 | 0.06 | −6 |
| LBY233 | 92477.2 | — | — | — | 24.7 | 0.11 | −4 | — | — | — |
| LBY233 | 92477.3 | — | — | — | — | — | — | 18.2 | L | −7 |
| LBY214 | 92760.3 | — | — | — | 25.2 | 0.12 | −2 | 18.3 | L | −6 |
| LBY204 | 92827.1 | — | — | — | — | — | — | 18.6 | 0.01 | −5 |
| LBY204 | 92828.1 | — | — | — | 25.1 | 0.20 | −2 | — | — | — |
| LBY187 | 92810.1 | — | — | — | — | — | — | 18.5 | L | −5 |
| LBY187 | 92812.1 | — | — | — | 24.8 | 0.04 | −3 | 18.4 | 0.03 | −6 |
| LBY187 | 92812.3 | — | — | — | 25.3 | 0.28 | −1 | — | — | — |
| LBY165 | 92678.1 | — | — | — | 25.3 | 0.20 | −1 | — | — | — |
| LBY165 | 92678.3 | — | — | — | 24.2 | 0.02 | −5 | 18.3 | 0.06 | −6 |
| LBY137 | 92751.1 | — | — | — | — | — | — | 18.7 | 0.16 | −4 |
| LBY137 | 92752.1 | — | — | — | 25.0 | 0.11 | −2 | 18.6 | 0.21 | −5 |
| LBY127 | 92748.2 | — | — | — | 24.6 | 0.15 | −4 | 18.7 | 0.02 | −4 |
| LBY126 | 92834.3 | — | — | — | — | — | — | 19.0 | 0.10 | −3 |
| LBY107 | 92284.1 | — | — | — | — | — | — | 18.3 | 0.06 | −6 |
| CONT. | — | — | — | — | 25.6 | — | — | 19.5 | — | — |
| LGN60 | 89174.2 | 1195.7 | 0.12 | 8 | — | — | — | — | — | — |
| LGN60 | 89175.2 | — | — | — | 46.7 | 0.24 | −3 | 38.0 | 0.09 | −4 |
| LGN60 | 89176.1 | — | — | — | — | — | — | 38.4 | 0.18 | −3 |
| LGN60 | 89176.3 | — | — | — | 45.4 | 0.02 | −6 | 38.0 | 0.09 | −3 |
| CONT. | — | 1109.1 | — | — | 48.1 | — | — | 39.4 | — | — |
| LGN49 | 89079.3 | 1069.2 | 0.16 | 7 | — | — | — | — | — | — |
| LGN49 | 89081.3 | 1158.3 | 0.03 | 16 | — | — | — | 38.1 | 0.02 | −2 |
| LGN49 | 89081.6 | 1117.9 | 0.09 | 12 | 45.1 | 0.12 | −3 | 38.0 | 0.02 | −2 |
| LGN49 | 89082.1 | — | — | — | — | — | — | 38.0 | 0.01 | −2 |
| CONT. | — | 998.2 | — | — | 45.9 | — | — | 38.2 | — | — |
| LGN2 | 89029.2 | — | — | — | 46.9 | 0.08 | −3 | — | — | — |
| LGN2 | 89032.3 | 1180.4 | 0.10 | 8 | — | — | — | — | — | — |
| CONT. | — | 1090.4 | — | — | 48.6 | — | — | — | — | — |
| LGN5 | 88198.1 | — | — | — | 45.2 | 0.02 | −4 | — | — | — |
| LGN5 | 88198.4 | — | — | — | 44.6 | L | −6 | 38.0 | 0.19 | −0 |
| LGN5 | 88201.3 | — | — | — | 46.3 | 0.25 | −2 | 38.0 | 0.19 | −0 |
| CONT. | — | — | — | — | 47.3 | — | — | 38.1 | — | — |
| LGN54 | 88207.2 | 1233.8 | 0.12 | 14 | — | — | — | — | — | — |
| CONT. | — | 1082.6 | — | — | — | — | — | — | — | — |
| LGN6 | 89169.2 | — | — | — | — | — | — | 33.9 | 0.29 | −2 |
| CONT. | — | — | — | — | — | — | — | 34.7 | — | — |
| LGN36 | 89044.1 | 1027.9 | 0.10 | 16 | — | — | — | — | — | — |
| CONT. | — | 889.6 | — | — | — | — | — | — | — | — |
| LBY79 | 92221.2 | — | — | — | 24.8 | 0.19 | −6 | 19.0 | 0.04 | −2 |
| LBY72 | 92765.1 | — | — | — | 25.2 | 0.01 | −5 | 19.0 | 0.04 | −2 |
| LBY72 | 92766.2 | — | — | — | 25.0 | 0.10 | −6 | — | — | — |

TABLE 241-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LBY72 | 92766.4 | — | — | — | 26.0 | 0.14 | −2 | — | — | — |
| LBY36 | 92526.1 | — | — | — | — | — | — | 19.1 | 0.08 | −2 |
| LBY32 | 92830.1 | — | — | — | 25.1 | 0.20 | −5 | 19.0 | 0.04 | −2 |
| LBY32 | 92830.3 | — | — | — | 25.0 | L | −6 | 19.0 | 0.04 | −2 |
| LBY32 | 92830.4 | — | — | — | 25.7 | 0.16 | −3 | 19.1 | 0.08 | −2 |
| LBY32 | 92832.1 | — | — | — | 25.4 | L | −4 | 19.0 | 0.04 | −2 |
| LBY32 | 92833.2 | — | — | — | 25.6 | 0.07 | −3 | 19.1 | 0.08 | −2 |
| LBY26 | 92484.4 | — | — | — | 24.5 | L | −8 | 19.0 | 0.04 | −2 |
| LBY26 | 92484.5 | — | — | — | 24.7 | 0.04 | −7 | 19.1 | 0.08 | −2 |
| LBY233 | 92474.3 | — | — | — | 24.2 | L | −9 | 19.0 | 0.04 | −2 |
| LBY233 | 92477.3 | — | — | — | 25.6 | 0.01 | −3 | — | — | — |
| LBY233 | 92478.3 | — | — | — | 25.2 | 0.04 | −5 | — | — | — |
| LBY214 | 92760.3 | — | — | — | 24.5 | 0.11 | −7 | 19.0 | 0.04 | −2 |
| LBY214 | 92760.4 | — | — | — | 26.0 | 0.14 | −2 | — | — | — |
| LBY210 | 92845.2 | — | — | — | 25.2 | 0.01 | −5 | 19.0 | 0.04 | −2 |
| LBY210 | 92845.4 | — | — | — | 24.8 | L | −6 | 19.1 | 0.08 | −2 |
| LBY204 | 92826.1 | — | — | — | — | — | — | 19.0 | 0.04 | −2 |
| LBY204 | 92827.1 | — | — | — | 25.8 | 0.12 | −3 | — | — | — |
| LBY204 | 92828.1 | — | — | — | 25.2 | 0.25 | −5 | — | — | — |
| LBY204 | 92828.3 | — | — | — | 26.2 | 0.29 | −1 | — | — | — |
| LBY196 | 91300.1 | — | — | — | 25.6 | 0.07 | −3 | 19.0 | 0.04 | −2 |
| LBY196 | 91303.2 | — | — | — | 25.0 | L | −6 | 19.1 | 0.08 | −2 |
| LBY187 | 92810.1 | — | — | — | 26.0 | 0.09 | −2 | — | — | — |
| LBY187 | 92812.3 | — | — | — | 25.5 | 0.27 | −4 | — | — | — |
| LBY187 | 92813.2 | — | — | — | 25.4 | 0.17 | −4 | 19.1 | 0.08 | −2 |
| LBY154 | 92432.3 | — | — | — | 25.8 | 0.02 | −3 | — | — | — |
| LBY154 | 92433.4 | — | — | — | 26.0 | 0.20 | −2 | — | — | — |
| LBY137 | 92751.1 | — | — | — | 25.5 | 0.27 | −4 | — | — | — |
| LBY137 | 92751.2 | — | — | — | 25.8 | 0.07 | −2 | — | — | — |
| LBY137 | 92751.5 | — | — | — | 25.1 | 0.20 | −5 | — | — | — |
| LBY126 | 92834.3 | — | — | — | 26.0 | 0.19 | −2 | — | — | — |
| LBY126 | 92837.2 | — | — | — | 26.1 | 0.14 | −1 | — | — | — |
| LBY126 | 92837.3 | — | — | — | 25.4 | 0.19 | −4 | — | — | — |
| LBY126 | 92837.4 | — | — | — | 26.1 | 0.18 | −1 | — | — | — |
| LBY126 | 92838.1 | — | — | — | 24.6 | L | −7 | 19.0 | 0.04 | −2 |
| LBY120 | 91214.1 | — | — | — | 25.6 | 0.04 | −3 | — | — | — |
| LBY113 | 92234.2 | — | — | — | 26.1 | 0.20 | −1 | — | — | — |
| CONT. | — | — | — | — | 26.5 | — | — | 19.4 | — | — |
| LBY83 | 91332.2 | — | — | — | 47.2 | 0.11 | −2 | 39.2 | 0.21 | −2 |
| LBY63 | 91325.2 | 1548.1 | L | 13 | — | — | — | — | — | — |
| LBY51 | 90981.1 | — | — | — | 45.9 | 0.21 | −5 | 37.6 | L | −6 |
| LBY51 | 90981.4 | 1431.2 | 0.21 | 4 | — | — | — | — | — | — |
| LBY48 | 90967.3 | 1446.9 | 0.07 | 5 | 47.2 | 0.11 | −2 | — | — | — |
| LBY224 | 91528.4 | — | — | — | — | — | — | 39.2 | 0.21 | −2 |
| LBY224 | 91529.1 | — | — | — | — | — | — | 39.0 | 0.08 | −2 |
| LBY22 | 90962.4 | 1637.5 | L | 19 | — | — | — | — | — | — |
| LBY196 | 91303.2 | 1430.0 | 0.28 | 4 | — | — | — | — | — | — |
| LBY196 | 91304.2 | 1531.7 | 0.19 | 12 | — | — | — | — | — | — |
| LBY188 | 91557.3 | — | — | — | 47.2 | 0.18 | −3 | — | — | — |
| LBY150 | 91644.3 | — | — | — | — | — | — | 39.0 | 0.08 | −2 |
| LBY134 | 91282.1 | 1711.3 | L | 25 | 46.0 | 0.11 | −5 | 38.1 | 0.10 | −5 |
| LBY133 | 91138.1 | 1454.1 | 0.29 | 6 | — | — | — | — | — | — |
| LBY132 | 91277.1 | 1473.8 | 0.23 | 7 | — | — | — | — | — | — |
| LBY132 | 91279.3 | — | — | — | 46.7 | 0.03 | −4 | 38.1 | 0.02 | −5 |
| LBY125 | 91273.3 | — | — | — | 47.3 | 0.10 | −2 | 38.7 | 0.07 | −3 |
| LBY102 | 91262.1 | 1725.7 | 0.23 | 26 | — | — | — | — | — | — |
| CONT. | — | 1371.8 | — | — | 48.4 | — | — | 39.9 | — | — |
| NUE102 | 90003.5 | 1100.4 | 0.12 | 15 | — | — | — | — | — | — |
| NUE102 | 90004.1 | — | — | — | 44.5 | 0.26 | −3 | 34.8 | 0.02 | −10 |
| CONT. | — | 959.8 | — | — | 46.1 | — | — | 38.6 | — | — |
| LGN24 | 89094.2 | 968.8 | L | 9 | — | — | — | — | — | — |
| LGN24 | 89096.2 | 968.8 | 0.22 | 9 | — | — | — | — | — | — |
| CONT. | — | 891.6 | — | — | — | — | — | — | — | — |
| LBY91 | 91634.2 | 1431.9 | 0.20 | 12 | 34.5 | 0.16 | −6 | — | — | — |
| LBY91 | 91634.3 | — | — | — | 35.5 | 0.04 | −4 | 28.7 | 0.28 | −2 |
| LBY81 | 92009.1 | — | — | — | 35.5 | 0.04 | −4 | 28.2 | 0.03 | −4 |
| LBY81 | 92013.1 | — | — | — | — | — | — | 28.6 | 0.13 | −2 |
| LBY81 | 92013.2 | 1333.8 | 0.14 | 4 | 35.7 | 0.11 | −3 | 27.9 | 0.01 | −5 |
| LBY77 | 92061.2 | — | — | — | — | — | — | 28.6 | 0.30 | −2 |
| LBY77 | 92062.1 | 1360.6 | 0.04 | 6 | 35.5 | 0.04 | −4 | 28.3 | 0.05 | −3 |
| LBY77 | 92063.6 | 1340.6 | 0.21 | 4 | — | — | — | — | — | — |
| LBY54 | 92084.4 | 1389.4 | 0.28 | 8 | — | — | — | — | — | — |

TABLE 241-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LBY54 | 92087.3 | — | — | — | — | — | — | 28.5 | 0.09 | −3 |
| LBY49 | 92039.4 | — | — | — | — | — | — | 28.1 | 0.02 | −4 |
| LBY35 | 92123.1 | — | — | — | — | — | — | 28.8 | 0.30 | −2 |
| LBY29 | 91619.1 | — | — | — | — | — | — | 28.7 | 0.28 | −2 |
| LBY29 | 91619.2 | — | — | — | 35.8 | 0.10 | −3 | 28.7 | 0.28 | −2 |
| LBY29 | 91619.5 | — | — | — | 35.2 | 0.02 | −4 | 28.6 | 0.30 | −2 |
| LBY23 | 91396.3 | 1431.9 | 0.27 | 12 | — | — | — | 28.7 | 0.28 | −2 |
| LBY23 | 91397.2 | — | — | — | — | — | — | 28.6 | 0.30 | −2 |
| LBY23 | 91398.2 | 1523.8 | L | 19 | — | — | — | — | — | — |
| LBY174 | 92079.8 | 1411.2 | 0.29 | 10 | — | — | — | — | — | — |
| LBY158 | 91647.3 | — | — | — | — | — | — | 28.8 | 0.28 | −2 |
| LBY158 | 91649.1 | 1515.0 | 0.05 | 18 | — | — | — | — | — | — |
| LBY146 | 91590.2 | — | — | — | 34.9 | L | −5 | 27.3 | 0.15 | −7 |
| LBY146 | 91590.4 | — | — | — | — | — | — | 28.2 | 0.03 | −4 |
| LBY146 | 91593.3 | 1421.5 | 0.26 | 11 | 35.0 | 0.01 | −5 | 26.9 | 0.13 | −8 |
| LBY138 | 92075.2 | 1474.4 | L | 15 | — | — | — | — | — | — |
| LBY138 | 92076.1 | — | — | — | — | — | — | 28.6 | 0.30 | −2 |
| LBY117 | 91366.3 | 1451.2 | 0.26 | 13 | 33.5 | L | −9 | 26.6 | 0.02 | −9 |
| LBY117 | 91367.1 | 1414.5 | 0.06 | 10 | — | — | — | — | — | — |
| LBY117 | 91367.2 | — | — | — | — | — | — | 28.6 | 0.13 | −2 |
| LBY115 | 92073.1 | — | — | — | 35.8 | 0.10 | −3 | 28.5 | 0.09 | −3 |
| LBY112 | 92053.6 | 1483.1 | 0.03 | 16 | — | — | — | — | — | — |
| LBY108 | 91422.2 | — | — | — | — | — | — | 28.7 | 0.28 | −2 |
| LBY108 | 91423.1 | — | — | — | 34.7 | L | −6 | 28.1 | 0.02 | −4 |
| LBY108 | 91423.4 | — | — | — | — | — | — | 28.3 | 0.10 | −3 |
| LBY108 | 91423.6 | 1372.5 | 0.25 | 7 | — | — | — | — | — | — |
| LBY104 | 91269.5 | 1600.6 | 0.07 | 25 | — | — | — | — | — | — |
| LBY103 | 91381.9 | 1390.0 | 0.27 | 8 | — | — | — | 28.8 | 0.30 | −2 |
| CONT. | — | 1283.2 | — | — | 36.8 | — | — | 29.3 | — | — |
| LGN2 | 89029.2 | — | — | — | 41.8 | 0.03 | −5 | 32.9 | 0.02 | −4 |
| CONT. | — | — | — | — | 44.0 | — | — | 34.3 | — | — |
| LGN26 | 89037.4 | 1229.1 | 0.01 | 26 | — | — | — | — | — | — |
| CONT. | — | 973.8 | — | — | — | — | — | — | — | — |
| NUE102 | 90005.2 | — | — | — | 46.6 | 0.18 | −2 | 36.8 | 0.19 | −3 |
| CONT. | — | — | — | — | 47.7 | — | — | 38.0 | — | — |
| LGN60 | 89174.2 | — | — | — | 45.5 | 0.06 | −2 | 38.2 | 0.11 | −1 |
| LGN60 | 89175.1 | — | — | — | 46.1 | 0.16 | −3 | 38.0 | L | −2 |
| LGN60 | 89175.2 | 1125.7 | 0.21 | 8 | 46.5 | 0.19 | −2 | — | — | — |
| LGN60 | 89176.3 | 1192.9 | 0.05 | 14 | 45.1 | 0.01 | −3 | 38.2 | 0.10 | −1 |
| CONT. | — | 1044.1 | — | — | 46.5 | — | — | 38.3 | — | — |
| LBY91 | 91630.1 | — | — | — | 36.5 | 0.29 | −2 | — | — | — |
| LBY91 | 91633.1 | — | — | — | 36.5 | 0.16 | −2 | — | — | — |
| LBY77 | 92062.1 | — | — | — | 36.6 | 0.23 | −2 | — | — | — |
| LBY54 | 92084.4 | — | — | — | 36.5 | 0.20 | −2 | — | — | — |
| LBY54 | 92086.1 | — | — | — | 36.4 | 0.11 | −3 | — | — | — |
| LBY35 | 92120.2 | — | — | — | 36.7 | 0.25 | −2 | — | — | — |
| LBY29 | 91617.1 | — | — | — | 35.9 | 0.27 | −4 | 27.6 | 0.13 | −5 |
| LBY25 | 91335.2 | — | — | — | — | — | — | 28.6 | 0.23 | −1 |
| LBY230 | 91665.1 | — | — | — | 36.4 | 0.12 | −3 | — | — | — |
| LBY230 | 91667.2 | — | — | — | 36.6 | 0.20 | −2 | — | — | — |
| LBY230 | 91669.2 | — | — | — | 35.3 | 0.12 | −6 | — | — | — |
| LBY225 | 91605.3 | — | — | — | 35.8 | 0.03 | −4 | — | — | — |
| LBY225 | 91607.3 | — | — | — | 35.3 | 0.22 | −6 | — | — | — |
| LBY225 | 91607.5 | — | — | — | 35.5 | 0.06 | −5 | 27.1 | 0.10 | −6 |
| LBY225 | 91607.6 | — | — | — | 36.0 | 0.12 | −4 | 28.0 | L | −3 |
| LBY217 | 92363.1 | — | — | — | 36.5 | 0.20 | −2 | — | — | — |
| LBY213 | 92033.1 | — | — | — | 35.8 | 0.20 | −4 | — | — | — |
| LBY212 | 92024.3 | — | — | — | 36.2 | 0.10 | −3 | — | — | — |
| LBY202 | 92022.1 | — | — | — | 36.1 | 0.06 | −3 | — | — | — |
| LBY202 | 92022.2 | — | — | — | 36.6 | 0.20 | −2 | — | — | — |
| LBY193 | 91660.2 | — | — | — | — | — | — | 28.6 | 0.23 | −1 |
| LBY193 | 91664.5 | — | — | — | 36.6 | 0.21 | −2 | — | — | — |
| LBY182 | 92398.3 | — | — | — | 36.5 | 0.17 | −2 | — | — | — |
| LBY136 | 91442.9 | — | — | — | 36.5 | 0.15 | −2 | — | — | — |
| LBY118 | 91432.5 | — | — | — | 36.4 | 0.12 | −3 | — | — | — |
| LBY118 | 91434.4 | — | — | — | 36.7 | 0.25 | −2 | — | — | — |
| CONT. | — | — | — | — | 37.4 | — | — | 28.9 | — | — |
| LGN49 | 89081.1 | 1065.0 | 0.09 | 8 | — | — | — | — | — | — |

TABLE 241-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LGN49 | 89081.3 | 1162.9 | 0.20 | 9 | — | — | — | — | — | — |
| LGN49 | 89081.6 | 1095.8 | 0.05 | 11 | — | — | — | — | — | — |
| CONT. | — | 1065.3 | — | — | — | — | — | — | — | — |

Table 241. "CONT." = Control; "Ave." = Average; "% Incr." = % increment; "p-val." = p-value, L = p < 0.01. It should be noted that a negative increment (in percentages) when found in flowering or inflorescence emergence indicates drought avoidance of the plant.

TABLE 242

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LBY30 | 92324.4 | 1.06 | L | 17 | 11.5 | 0.13 | 10 | 68.6 | L | 29 |
| LBY30 | 92326.2 | 0.962 | 0.18 | 7 | — | — | — | — | — | — |
| LBY225 | 91607.5 | 0.971 | 0.12 | 8 | — | — | — | 60.3 | 0.22 | 14 |
| LBY225 | 91607.6 | — | — | — | 11.1 | 0.11 | 6 | — | — | — |
| LBY193 | 91662.1 | 0.969 | 0.25 | 8 | — | — | — | 58.9 | 0.08 | 11 |
| LBY174 | 92079.1 | 0.973 | 0.16 | 8 | — | — | — | — | — | — |
| LBY158 | 91649.1 | 1.04 | 0.15 | 16 | — | — | — | 63.3 | 0.05 | 19 |
| LBY146 | 91590.4 | 0.985 | 0.14 | 9 | — | — | — | — | — | — |
| LBY139 | 92241.2 | 1.04 | L | 15 | — | — | — | 64.0 | 0.02 | 21 |
| LBY135 | 92321.1 | — | — | — | 11.1 | 0.11 | 6 | 58.9 | 0.28 | 11 |
| LBY135 | 92321.6 | 1.08 | 0.19 | 20 | 11.1 | 0.11 | 6 | 68.3 | 0.27 | 29 |
| LBY113 | 92234.1 | 0.963 | 0.14 | 7 | — | — | — | — | — | — |
| LBY113 | 92234.5 | 1.01 | 0.22 | 13 | — | — | — | — | — | — |
| LBY113 | 92234.6 | — | — | — | — | — | — | 57.3 | 0.29 | 8 |
| CONT. | — | 0.900 | — | — | 10.4 | — | — | 53.0 | — | — |
| LGN5 | 88198.1 | 1.00 | 0.05 | 9 | — | — | — | — | — | — |
| LGN5 | 88198.4 | 1.08 | 0.09 | 7 | 11.8 | 0.02 | 6 | 65.2 | 0.07 | 10 |
| LGN5 | 88201.3 | 1.07 | 0.09 | 16 | 12.2 | 0.18 | 9 | 69.2 | 0.15 | 17 |
| CONT. | — | 1.01 | — | — | 11.1 | — | — | 59.3 | — | — |
| LBY97 | 92034.3 | 1.03 | 0.04 | 11 | 11.1 | 0.24 | 12 | 66.5 | 0.01 | 26 |
| LBY97 | 92038.2 | — | — | — | 10.6 | L | 7 | — | — | — |
| LBY87 | 92255.1 | 1.16 | L | 25 | 11.1 | 0.10 | 12 | 73.2 | L | 38 |
| LBY87 | 92257.1 | — | — | — | 10.6 | 0.30 | 7 | — | — | — |
| LBY81 | 92009.1 | 1.15 | L | 24 | — | — | — | 68.3 | 0.15 | 29 |
| LBY55 | 92419.1 | — | — | — | 10.2 | 0.16 | 3 | — | — | — |
| LBY25 | 91337.1 | — | — | — | 10.1 | 0.20 | 2 | — | — | — |
| LBY230 | 91669.3 | 0.991 | 0.16 | 7 | — | — | — | — | — | — |
| LBY217 | 92362.1 | 0.985 | 0.21 | 6 | 10.5 | 0.23 | 6 | 58.1 | 0.10 | 10 |
| LBY138 | 92076.1 | — | — | — | 10.4 | 0.10 | 5 | — | — | — |
| LBY138 | 92078.1 | 0.987 | 0.18 | 6 | 10.1 | 0.29 | 2 | 56.9 | 0.17 | 8 |
| LBY138 | 92078.4 | 1.12 | L | 21 | 10.9 | 0.03 | 10 | 70.5 | L | 34 |
| LBY136 | 91442.9 | 1.10 | L | 18 | 10.4 | L | 5 | 63.9 | 0.02 | 21 |
| LBY135 | 92321.6 | 1.15 | 0.15 | 24 | 10.2 | 0.04 | 3 | 67.7 | 0.09 | 28 |
| LBY120 | 91210.2 | 1.04 | 0.18 | 13 | — | — | — | — | — | — |
| LBY120 | 91211.2 | — | — | — | 10.8 | 0.09 | 9 | — | — | — |
| LBY118 | 91432.3 | 1.19 | L | 28 | 11.4 | 0.11 | 15 | 71.7 | L | 36 |
| LBY118 | 91433.1 | — | — | — | 10.8 | 0.16 | 8 | — | — | — |
| LBY118 | 91434.5 | 1.13 | 0.03 | 22 | — | — | — | 64.5 | 0.01 | 22 |
| LBY117 | 91366.3 | — | — | — | 10.6 | 0.14 | 7 | 58.9 | 0.20 | 11 |
| LBY115 | 92073.5 | 1.07 | 0.01 | 16 | 10.6 | L | 7 | 64.3 | 0.03 | 22 |
| LBY112 | 92051.1 | 1.29 | L | 39 | 11.4 | 0.15 | 15 | 79.1 | 0.09 | 50 |
| LBY112 | 92051.3 | 1.08 | L | 16 | 11.4 | 0.01 | 15 | 67.9 | L | 29 |
| LBY112 | 92053.2 | — | — | — | 10.2 | 0.16 | 3 | — | — | — |
| LBY112 | 92053.6 | 1.10 | L | 19 | — | — | — | 62.5 | 0.04 | 18 |
| LBY108 | 91422.2 | — | — | — | 10.1 | 0.19 | 2 | — | — | — |
| LBY108 | 91423.1 | — | — | — | 10.1 | 0.29 | 2 | 57.2 | 0.15 | 8 |
| LBY108 | 91423.4 | 1.27 | L | 37 | 11.2 | 0.27 | 14 | 78.0 | 0.10 | 48 |
| LBY103 | 91381.11 | 1.03 | 0.05 | 12 | — | — | — | — | — | — |
| LBY103 | 91381.3 | 0.994 | 0.14 | 7 | 10.1 | 0.29 | 2 | 59.4 | 0.08 | 13 |
| LBY103 | 91381.6 | 1.07 | 0.29 | 15 | — | — | — | — | — | — |
| LBY103 | 91381.9 | 1.08 | L | 16 | 11.4 | 0.15 | 15 | 69.8 | L | 32 |
| CONT. | — | 0.927 | — | — | 9.91 | — | — | 52.8 | — | — |
| LBY96 | 92428.4 | — | — | — | 11.8 | 0.12 | 4 | — | — | — |

TABLE 242-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LBY79 | 92221.2 | — | — | — | — | — | — | 87.8 | 0.22 | 12 |
| LBY72 | 92764.1 | 1.46 | 0.04 | 8 | 12.7 | 0.08 | 12 | 88.8 | 0.19 | 13 |
| LBY72 | 92765.3 | — | — | — | 12.3 | 0.13 | 9 | 84.0 | 0.06 | 7 |
| LBY72 | 92766.4 | — | — | — | 12.4 | 0.07 | 9 | 88.2 | 0.09 | 12 |
| LBY36 | 92526.1 | 1.56 | 0.20 | 15 | 12.2 | 0.08 | 8 | 97.9 | L | 24 |
| LBY32 | 92830.3 | 1.59 | 0.21 | 17 | — | — | — | — | — | — |
| LBY30 | 92326.1 | 1.48 | L | 9 | 11.6 | 0.18 | 3 | 88.2 | L | 12 |
| LBY233 | 92477.1 | 1.49 | 0.06 | 10 | 12.1 | 0.11 | 7 | 93.5 | 0.20 | 19 |
| LBY233 | 92477.2 | 1.55 | L | 14 | 11.8 | 0.07 | 4 | 93.7 | L | 19 |
| LBY214 | 92760.1 | — | — | — | 11.8 | 0.16 | 4 | — | — | — |
| LBY214 | 92760.3 | — | — | — | 12.0 | 0.15 | 6 | 83.6 | 0.07 | 6 |
| LBY214 | 92760.4 | 1.50 | 0.11 | 10 | — | — | — | — | — | — |
| LBY210 | 92845.2 | — | — | — | 11.9 | 0.03 | 5 | — | — | — |
| LBY210 | 92846.2 | 1.44 | 0.17 | 6 | 12.0 | 0.03 | 6 | — | — | — |
| LBY204 | 92827.1 | 1.66 | 0.17 | 22 | — | — | — | 102.6 | 0.26 | 30 |
| LBY204 | 92828.3 | 1.65 | L | 22 | 12.6 | 0.01 | 11 | 101.7 | 0.02 | 29 |
| LBY165 | 92677.7 | 1.42 | 0.08 | 5 | — | — | — | — | — | — |
| LBY165 | 92678.3 | 1.53 | 0.19 | 13 | — | — | — | 89.7 | L | 14 |
| LBY137 | 92750.1 | 1.49 | 0.26 | 10 | — | — | — | — | — | — |
| LBY137 | 92752.1 | 1.60 | 0.12 | 18 | — | — | — | 92.6 | L | 18 |
| LBY126 | 92834.3 | — | — | — | — | — | — | 88.2 | L | 12 |
| LBY126 | 92837.4 | — | — | — | 12.0 | 0.29 | 6 | — | — | — |
| LBY126 | 92838.1 | — | — | — | 11.8 | 0.16 | 4 | — | — | — |
| LBY110 | 91176.6 | 1.41 | 0.29 | 4 | — | — | — | — | — | — |
| LBY110 | 91179.2 | 1.50 | L | 10 | 11.9 | 0.03 | 5 | 90.0 | L | 14 |
| LBY107 | 92285.2 | 1.41 | 0.15 | 4 | 11.7 | 0.27 | 3 | 85.0 | 0.07 | 8 |
| CONT. | — | 1.36 | — | — | 11.3 | — | — | 78.6 | — | — |
| LGN60 | 89175.1 | 0.844 | 0.09 | 7 | 10.2 | 0.25 | 1 | 49.5 | 0.02 | 15 |
| LGN60 | 89175.2 | 0.869 | 0.18 | 10 | — | — | — | 50.0 | 0.12 | 16 |
| LGN60 | 89176.1 | 0.834 | 0.14 | 6 | — | — | — | 46.7 | 0.12 | 8 |
| LGN60 | 89176.3 | 0.896 | 0.07 | 13 | 10.8 | 0.12 | 5 | 55.1 | 0.04 | 28 |
| CONT. | — | 0.790 | — | — | 10.2 | — | — | 43.2 | — | — |
| LGN49 | 89081.1 | 0.959 | 0.29 | 10 | 11.1 | 0.26 | 5 | 58.9 | 0.23 | 18 |
| LGN49 | 89081.3 | 0.980 | 0.21 | 13 | 11.4 | 0.29 | 8 | 61.6 | 0.17 | 23 |
| LGN49 | 89081.6 | 1.05 | 0.27 | 10 | 12.2 | L | 15 | 66.4 | 0.12 | 22 |
| CONT. | — | 0.953 | — | — | 10.6 | — | — | 54.4 | — | — |
| LGN2 | 89029.2 | 1.04 | 0.22 | 5 | 11.8 | 0.02 | 7 | 68.1 | 0.04 | 13 |
| CONT. | — | 0.986 | — | — | 11.0 | — | — | 60.1 | — | — |
| LGN5 | 88198.4 | 1.11 | L | 18 | 10.9 | 0.03 | 8 | 67.2 | L | 28 |
| LGN5 | 88201.3 | 1.02 | 0.09 | 9 | 11.0 | 0.10 | 9 | 63.0 | 0.03 | 20 |
| LGN5 | 88203.2 | — | — | — | — | — | — | 57.8 | 0.25 | 10 |
| CONT. | — | 0.935 | — | — | 10.1 | — | — | 52.4 | — | — |
| LGN24 | 89094.2 | 0.967 | L | 26 | 10.4 | 0.24 | 5 | 58.2 | L | 26 |
| CONT. | — | 0.769 | — | — | 9.91 | — | — | 46.2 | — | — |
| LGN6 | 89169.2 | — | — | — | 11.5 | 0.01 | 10 | — | — | — |
| CONT. | — | — | — | — | 10.5 | — | — | — | — | — |
| LBY79 | 92221.3 | — | — | — | 11.9 | 0.17 | 5 | 87.7 | 0.29 | 15 |
| LBY72 | 92764.1 | 1.64 | L | 27 | 12.2 | 0.25 | 7 | 97.2 | 0.10 | 27 |
| LBY72 | 92765.1 | 1.67 | L | 30 | — | — | — | 102.8 | 0.15 | 34 |
| LBY72 | 92766.4 | 1.44 | 0.06 | 12 | 11.8 | 0.20 | 4 | 88.3 | 0.09 | 15 |
| LBY36 | 92526.1 | 1.40 | L | 8 | — | — | — | 85.6 | 0.22 | 12 |
| LBY32 | 92830.1 | 1.56 | L | 21 | 12.1 | 0.20 | 6 | 98.1 | 0.11 | 28 |
| LBY32 | 92830.3 | 1.48 | L | 15 | 11.8 | 0.26 | 4 | 93.1 | 0.09 | 22 |
| LBY32 | 92832.1 | 1.39 | 0.24 | 8 | — | — | — | 85.4 | 0.10 | 12 |
| LBY32 | 92833.2 | 1.42 | 0.05 | 10 | — | — | — | — | — | — |
| LBY26 | 92484.4 | 1.67 | 0.10 | 29 | 12.2 | 0.03 | 8 | 102.0 | 0.04 | 33 |
| LBY26 | 92484.5 | 1.37 | 0.07 | 7 | — | — | — | 81.0 | 0.01 | 6 |
| LBY26 | 92488.1 | 1.41 | 0.20 | 10 | — | — | — | 86.4 | 0.02 | 13 |
| LBY233 | 92477.1 | 1.35 | 0.01 | 5 | 12.0 | 0.17 | 6 | 81.4 | 0.30 | 6 |
| LBY233 | 92478.3 | — | — | — | 12.2 | 0.15 | 7 | — | — | — |
| LBY214 | 92760.1 | 1.44 | 0.11 | 11 | — | — | — | 90.0 | 0.01 | 18 |
| LBY214 | 92760.3 | 1.47 | 0.27 | 14 | — | — | — | — | — | — |
| LBY210 | 92845.2 | 1.47 | 0.17 | 14 | — | — | — | — | — | — |
| LBY210 | 92845.4 | 1.43 | 0.14 | 11 | — | — | — | 82.8 | L | 8 |
| LBY210 | 92846.2 | 1.41 | 0.03 | 10 | — | — | — | 80.4 | 0.20 | 5 |
| LBY204 | 92826.1 | — | — | — | 12.1 | 0.10 | 6 | — | — | — |
| LBY204 | 92827.1 | — | — | — | — | — | — | 86.5 | L | 13 |
| LBY204 | 92828.1 | 1.41 | 0.03 | 10 | — | — | — | — | — | — |
| LBY204 | 92828.3 | — | — | — | — | — | — | 85.2 | 0.27 | 11 |
| LBY196 | 91303.2 | 1.60 | 0.02 | 24 | — | — | — | 100.2 | 0.21 | 31 |
| LBY187 | 92809.2 | 1.49 | 0.27 | 16 | 12.7 | 0.01 | 12 | 92.5 | 0.20 | 21 |
| LBY187 | 92812.3 | 1.42 | 0.19 | 10 | 12.2 | 0.28 | 8 | 88.2 | 0.23 | 15 |

TABLE 242-continued

Genes showing improved plant performance at Normal growth conditions under regulation of At6669 promoter

| | | Leaf Blade Area [cm²] | | | Leaf Number | | | Plot Coverage [cm²] | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LBY154 | 92432.1 | — | — | — | 11.8 | 0.20 | 4 | — | — | — |
| LBY154 | 92432.3 | — | — | — | 12.1 | 0.10 | 6 | — | — | — |
| LBY126 | 92837.3 | 1.37 | 0.17 | 7 | — | — | — | 82.6 | 0.17 | 8 |
| LBY126 | 92837.4 | — | — | — | 12.6 | 0.02 | 11 | 79.9 | 0.11 | 4 |
| LBY126 | 92838.1 | — | — | — | 12.5 | 0.01 | 10 | 83.6 | 0.23 | 9 |
| LBY120 | 91210.2 | 1.34 | 0.24 | 4 | — | — | — | 77.9 | 0.29 | 2 |
| LBY120 | 91214.1 | — | — | — | 12.5 | 0.01 | 10 | 84.8 | 0.24 | 11 |
| LBY113 | 92234.2 | — | — | — | 11.8 | 0.26 | 4 | — | — | — |
| LBY113 | 92235.2 | 1.33 | L | 3 | — | — | — | — | — | — |
| LBY107 | 92284.3 | 1.38 | 0.28 | 7 | — | — | — | — | — | — |
| CONT. | — | 1.29 | — | — | 11.4 | — | — | 76.4 | — | — |
| LBY83 | 91330.1 | 0.730 | 0.03 | 13 | — | — | — | 42.7 | 0.10 | 12 |
| LBY83 | 91330.2 | 0.816 | 0.15 | 26 | — | — | — | 51.8 | 0.06 | 36 |
| LBY83 | 91332.1 | 0.726 | 0.10 | 12 | — | — | — | 44.0 | 0.03 | 15 |
| LBY83 | 91332.2 | 0.706 | 0.09 | 9 | — | — | — | — | — | — |
| LBY63 | 91326.1 | — | — | — | 10.2 | 0.17 | 2 | — | — | — |
| LBY51 | 90981.1 | — | — | — | — | — | — | 42.2 | 0.09 | 11 |
| LBY48 | 90968.1 | 0.764 | 0.01 | 18 | — | — | — | 45.2 | 0.01 | 19 |
| LBY48 | 90968.2 | 0.750 | 0.10 | 16 | — | — | — | 43.5 | 0.07 | 14 |
| LBY224 | 91527.4 | — | — | — | — | — | — | 43.4 | 0.29 | 14 |
| LBY224 | 91528.3 | 0.686 | 0.22 | 6 | — | — | — | — | — | — |
| LBY224 | 91529.1 | 0.725 | 0.25 | 12 | 10.4 | 0.15 | 3 | 43.8 | 0.11 | 15 |
| LBY22 | 90961.2 | — | — | — | — | — | — | 43.3 | 0.17 | 14 |
| LBY22 | 90965.5 | 0.734 | 0.29 | 14 | — | — | — | 43.6 | 0.10 | 14 |
| LBY196 | 91300.1 | 0.708 | 0.07 | 9 | — | — | — | 43.3 | 0.04 | 14 |
| LBY196 | 91303.2 | 0.774 | 0.02 | 20 | — | — | — | 45.2 | 0.29 | 19 |
| LBY150 | 91644.3 | 0.787 | L | 22 | 10.7 | 0.09 | 6 | 47.9 | L | 26 |
| LBY133 | 91139.4 | 0.788 | 0.10 | 22 | 11.1 | 0.23 | 10 | 49.3 | 0.05 | 29 |
| LBY132 | 91277.1 | 0.847 | L | 31 | — | — | — | 52.6 | 0.20 | 38 |
| LBY132 | 91279.3 | 0.881 | L | 36 | 11.0 | L | 9 | 54.9 | 0.03 | 44 |
| LBY125 | 91273.2 | — | — | — | 10.2 | 0.17 | 2 | — | — | — |
| LBY125 | 91273.3 | 0.826 | 0.08 | 28 | — | — | — | 51.3 | 0.10 | 35 |
| LBY102 | 91262.1 | 0.699 | 0.21 | 8 | — | — | — | 42.6 | 0.17 | 12 |
| CONT. | — | 0.647 | — | — | 10.0 | — | — | 38.1 | — | — |
| NUE102 | 90003.5 | 0.824 | 0.05 | 11 | — | — | — | 49.1 | 0.15 | 15 |
| NUE102 | 90004.1 | 0.785 | 0.21 | 6 | — | — | — | 47.2 | 0.27 | 11 |
| CONT. | — | 0.741 | — | — | — | — | — | 42.7 | — | — |
| LGN24 | 89094.2 | 0.991 | 0.02 | 14 | 11.0 | 0.14 | 5 | 64.8 | 0.04 | 19 |
| LGN24 | 89094.3 | 0.922 | 0.18 | 6 | 11.1 | 0.10 | 7 | 60.2 | 0.16 | 11 |
| LGN24 | 89096.2 | — | — | — | 11.0 | 0.19 | 5 | — | — | — |
| CONT. | — | 0.867 | — | — | 10.4 | — | — | 54.4 | — | — |
| LBY91 | 91634.2 | 1.53 | 0.27 | 9 | — | — | — | — | — | — |
| LBY91 | 91634.3 | 1.59 | 0.06 | 14 | — | — | — | 99.8 | 0.16 | 13 |
| LBY81 | 92013.1 | 1.60 | 0.28 | 14 | — | — | — | — | — | — |
| LBY81 | 92013.2 | 1.68 | 0.21 | 20 | — | — | — | 108.0 | 0.06 | 22 |
| LBY77 | 92061.2 | 1.70 | 0.01 | 21 | 12.6 | 0.20 | 4 | 113.9 | 0.01 | 29 |
| LBY77 | 92062.1 | 1.87 | L | 33 | — | — | — | 116.5 | L | 32 |
| LBY49 | 92039.4 | 1.59 | 0.20 | 14 | — | — | — | 98.2 | 0.25 | 11 |
| LBY35 | 92119.2 | 1.50 | 0.29 | 7 | — | — | — | — | — | — |
| LBY35 | 92123.2 | 1.55 | 0.12 | 11 | — | — | — | — | — | — |
| LBY29 | 91619.1 | 1.53 | 0.17 | 9 | — | — | — | 99.6 | 0.17 | 13 |
| LBY29 | 91619.5 | 1.64 | 0.02 | 17 | — | — | — | 102.5 | 0.14 | 16 |
| LBY23 | 91396.3 | 1.61 | 0.09 | 15 | — | — | — | 103.4 | 0.22 | 17 |
| LBY23 | 91397.2 | 1.50 | 0.29 | 7 | — | — | — | — | — | — |
| LBY23 | 91398.2 | 1.53 | 0.29 | 9 | — | — | — | — | — | — |
| LBY174 | 92079.1 | 1.56 | 0.11 | 11 | — | — | — | 101.6 | 0.19 | 15 |
| LBY174 | 92080.1 | 1.54 | 0.14 | 10 | — | — | — | 97.2 | 0.30 | 10 |
| LBY158 | 91647.3 | — | — | — | 13.2 | 0.04 | 9 | 100.9 | 0.24 | 14 |
| LBY158 | 91649.1 | 1.60 | 0.08 | 14 | — | — | — | 104.8 | 0.26 | 19 |
| LBY146 | 91593.3 | 1.59 | 0.06 | 13 | — | — | — | 107.4 | 0.05 | 21 |
| LBY138 | 92075.2 | — | — | — | — | — | — | 97.2 | 0.28 | 10 |
| LBY138 | 92076.1 | 1.54 | 0.16 | 10 | — | — | — | — | — | — |
| LBY117 | 91366.3 | 1.55 | 0.11 | 11 | — | — | — | — | — | — |
| LBY115 | 92071.2 | 1.53 | 0.18 | 9 | — | — | — | — | — | — |
| LBY115 | 92071.3 | 1.53 | 0.30 | 9 | — | — | — | — | — | — |
| LBY115 | 92073.1 | 1.58 | 0.07 | 13 | — | — | — | 101.3 | 0.12 | 15 |
| LBY112 | 92051.3 | 1.70 | 0.27 | 22 | — | — | — | — | — | — |
| LBY108 | 91422.2 | 1.58 | 0.07 | 13 | — | — | — | 100.1 | 0.15 | 13 |
| LBY108 | 91423.1 | 1.73 | 0.19 | 24 | — | — | — | 107.3 | 0.05 | 21 |
| LBY104 | 91267.4 | — | — | — | 12.6 | 0.20 | 4 | — | — | — |
| LBY104 | 91269.2 | 1.61 | 0.30 | 15 | — | — | — | 100.8 | 0.28 | 14 |
| LBY103 | 91381.8 | — | — | — | 12.6 | 0.24 | 3 | — | — | — |

TABLE 242-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 1.40 | — | — | 12.1 | — | — | 88.4 | — | — |
| LGN2 | 89029.2 | 1.05 | L | 31 | 11.0 | 0.05 | 13 | 67.7 | L | 46 |
| LGN2 | 89032.3 | 0.891 | 0.06 | 11 | — | — | — | — | — | — |
| CONT. | — | 0.799 | — | — | 9.72 | — | — | 46.4 | — | — |
| LGN26 | 89037.4 | — | — | — | 9.83 | 0.16 | 5 | — | — | — |
| CONT. | — | — | — | — | 9.38 | — | — | — | — | — |
| LGN60 | 89175.2 | 0.923 | 0.23 | 6 | 10.5 | 0.04 | 4 | 52.7 | 0.05 | 8 |
| LGN60 | 89176.3 | 0.999 | 0.01 | 15 | 11.0 | L | 9 | 60.3 | 0.08 | 11 |
| CONT. | — | 0.956 | — | — | 10.7 | — | — | 48.7 | — | — |
| LBY77 | 92062.1 | 1.04 | 0.24 | 11 | — | — | — | 65.4 | 0.19 | 11 |
| LBY54 | 92084.4 | 1.19 | L | 28 | 12.7 | 0.02 | 16 | 84.4 | L | 43 |
| LBY54 | 92086.1 | 1.03 | 0.17 | 10 | 11.4 | 0.30 | 4 | 66.7 | 0.11 | 13 |
| LBY29 | 91617.1 | 1.13 | 0.01 | 21 | 11.8 | 0.07 | 7 | 75.6 | L | 28 |
| LBY29 | 91619.1 | 1.02 | 0.19 | 9 | — | — | — | — | — | — |
| LBY25 | 91335.2 | 1.09 | L | 17 | 12.6 | L | 15 | 82.1 | L | 39 |
| LBY230 | 91669.2 | — | — | — | 12.1 | 0.27 | 11 | — | — | — |
| LBY23 | 91397.3 | 1.09 | 0.06 | 16 | 12.1 | 0.16 | 10 | 76.8 | 0.07 | 30 |
| LBY225 | 91605.3 | 1.05 | 0.02 | 13 | 12.2 | L | 12 | 74.2 | 0.03 | 26 |
| LBY225 | 91607.3 | — | — | — | 12.4 | L | 13 | 82.9 | 0.30 | 41 |
| LBY225 | 91607.5 | 1.15 | 0.25 | 24 | 11.8 | 0.05 | 8 | 77.2 | L | 31 |
| LBY217 | 92363.1 | 1.02 | 0.07 | 9 | 11.5 | 0.19 | 5 | 64.5 | 0.23 | 9 |
| LBY213 | 92033.1 | 1.15 | 0.03 | 23 | 12.4 | L | 13 | 79.3 | 0.06 | 35 |
| LBY212 | 92024.2 | 1.03 | 0.19 | 10 | — | — | — | — | — | — |
| LBY212 | 92024.3 | 1.08 | 0.03 | 16 | 12.1 | 0.02 | 11 | 71.6 | 0.03 | 21 |
| LBY202 | 92022.1 | 0.997 | 0.17 | 7 | 12.2 | 0.03 | 12 | 69.6 | 0.04 | 18 |
| LBY182 | 92396.1 | — | — | — | 12.2 | 0.06 | 11 | 70.5 | 0.28 | 20 |
| LBY136 | 91442.6 | 1.08 | 0.04 | 16 | 12.1 | 0.03 | 10 | 71.9 | 0.03 | 22 |
| LBY136 | 91442.9 | 1.09 | 0.14 | 17 | 11.8 | 0.14 | 8 | 74.2 | 0.13 | 26 |
| CONT. | — | 0.933 | — | — | 11.0 | — | — | 59.0 | — | — |
| LGN49 | 89081.3 | — | — | — | 10.6 | 0.13 | 8 | — | — | — |
| LGN49 | 89081.6 | 1.05 | 0.27 | 12 | 10.7 | 0.12 | 9 | 61.2 | 0.08 | 19 |
| CONT. | — | 0.967 | — | — | 9.78 | — | — | 51.4 | — | — |

Table 242. "CONT." = Control; "Ave." = Average; "% Incr." = % increment; "p-val." = p-value, L = p < 0.01.

TABLE 243

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LGN36 | 89046.1 | — | — | — | — | — | — | 0.279 | 0.23 | 6 |
| CONT. | — | — | — | — | — | — | — | 0.262 | — | — |
| LBY30 | 92324.4 | — | — | — | 7.84 | 0.14 | 26 | — | — | — |
| LBY158 | 91649.1 | — | — | — | 7.43 | 0.26 | 19 | — | — | — |
| LBY139 | 92241.2 | — | — | — | 7.52 | 0.22 | 20 | — | — | — |
| LBY135 | 92321.6 | — | — | — | 7.91 | 0.14 | 27 | 0.407 | 0.28 | 14 |
| CONT. | — | — | — | — | 6.24 | — | — | 0.357 | — | — |
| LGN5 | 88198.4 | — | — | — | 7.27 | 0.06 | 9 | 0.376 | L | 9 |
| LGN5 | 88201.3 | — | — | — | 7.60 | 0.24 | 14 | — | — | — |
| CONT. | — | — | — | — | 6.67 | — | — | 0.346 | — | — |
| LBY97 | 92034.3 | — | — | — | 8.74 | 0.05 | 27 | 0.463 | 0.26 | 10 |
| LBY87 | 92255.1 | — | — | — | 9.54 | L | 38 | 0.472 | 0.16 | 12 |
| LBY81 | 92009.1 | — | — | — | 8.84 | 0.05 | 28 | 0.474 | 0.14 | 12 |
| LBY138 | 92078.4 | — | — | — | 9.22 | 0.02 | 34 | 0.468 | 0.19 | 11 |
| LBY136 | 91442.9 | — | — | — | 8.31 | 0.12 | 21 | 0.466 | 0.22 | 10 |
| LBY135 | 92321.6 | — | — | — | 8.87 | 0.04 | 29 | 0.478 | 0.13 | 13 |
| LBY135 | 92323.1 | — | — | — | — | — | — | 0.492 | 0.10 | 16 |
| LBY118 | 91432.3 | 0.814 | 0.10 | 25 | 9.37 | 0.01 | 36 | 0.478 | 0.11 | 13 |
| LBY118 | 91434.5 | — | — | — | 8.32 | 0.12 | 21 | — | — | — |
| LBY151 | 92073.5 | — | — | — | 8.35 | 0.12 | 21 | — | — | — |
| LBY112 | 92051.1 | 0.797 | 0.13 | 22 | 10.3 | L | 50 | 0.513 | 0.02 | 21 |
| LBY112 | 92051.3 | 0.808 | 0.10 | 24 | 8.79 | 0.05 | 28 | 0.469 | 0.19 | 11 |
| LBY112 | 92053.6 | — | — | — | 8.16 | 0.18 | 18 | — | — | — |
| LBY108 | 91423.4 | — | — | — | 10.2 | L | 48 | 0.512 | 0.02 | 21 |

TABLE 243-continued

Genes showing improved plant performance at
Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY103 | 91381.9 | — | — | — | 9.08 | 0.02 | 32 | 0.460 | 0.28 | 9 |
| CONT. | — | 0.651 | — | — | 6.89 | — | — | 0.423 | — | — |
| LBY72 | 92766.4 | — | — | — | — | — | — | 0.485 | 0.28 | 6 |
| LBY36 | 92526.1 | — | — | — | 9.97 | 0.05 | 24 | 0.513 | 0.03 | 12 |
| LBY32 | 92830.3 | — | — | — | 9.26 | 0.22 | 15 | 0.510 | 0.04 | 11 |
| LBY32 | 92833.2 | — | — | — | 9.30 | 0.20 | 16 | 0.508 | 0.09 | 11 |
| LBY30 | 92326.1 | — | — | — | 9.06 | 0.29 | 13 | 0.497 | 0.13 | 9 |
| LBY233 | 92477.1 | — | — | — | 9.56 | 0.12 | 19 | 0.497 | 0.12 | 8 |
| LBY233 | 92477.2 | — | — | — | 9.47 | 0.16 | 18 | 0.510 | 0.05 | 11 |
| LBY214 | 92760.3 | — | — | — | — | — | — | 0.485 | 0.29 | 6 |
| LBY210 | 92846.2 | 0.700 | 0.13 | 14 | — | — | — | — | — | — |
| LBY204 | 92827.1 | — | — | — | 10.6 | 0.02 | 32 | 0.522 | 0.02 | 14 |
| LBY204 | 92828.1 | — | — | — | — | — | — | 0.491 | 0.18 | 7 |
| LBY204 | 92828.3 | — | — | — | 10.2 | 0.04 | 27 | 0.499 | 0.10 | 9 |
| LBY187 | 92809.2 | — | — | — | 9.65 | 0.12 | 20 | 0.494 | 0.24 | 8 |
| LBY165 | 92678.3 | — | — | — | 9.09 | 0.27 | 13 | 0.493 | 0.16 | 8 |
| LBY137 | 92752.1 | — | — | — | 9.58 | 0.11 | 19 | 0.504 | 0.07 | 10 |
| LBY110 | 91177.3 | — | — | — | 9.19 | 0.26 | 15 | 0.502 | 0.12 | 10 |
| LBY110 | 91179.2 | — | — | — | 9.10 | 0.27 | 13 | 0.495 | 0.16 | 8 |
| CONT. | — | 0.614 | — | — | 8.02 | — | — | 0.458 | — | — |
| LGN60 | 89175.1 | — | — | — | 5.76 | L | 18 | 0.331 | L | 10 |
| LGN60 | 89175.2 | — | — | — | 5.70 | 0.10 | 17 | 0.315 | 0.28 | 4 |
| LGN60 | 89176.1 | — | — | — | 5.37 | 0.06 | 10 | — | — | — |
| LGN60 | 89176.3 | — | — | — | 6.20 | 0.06 | 27 | 0.330 | 0.17 | 9 |
| CONT. | — | — | — | — | 4.89 | — | — | 0.302 | — | — |
| LGN49 | 89079.3 | 0.553 | 0.13 | 8 | — | — | — | — | — | — |
| LGN49 | 89081.1 | — | — | — | 6.49 | 0.19 | 20 | 0.325 | 0.18 | 6 |
| LGN49 | 89081.3 | — | — | — | 6.74 | 0.19 | 24 | — | — | — |
| LGN49 | 89081.6 | 0.619 | 0.14 | 28 | 7.32 | 0.14 | 24 | 0.369 | 0.20 | 15 |
| CONT. | — | 0.485 | — | — | 5.93 | — | — | 0.321 | — | — |
| LGN54 | 88207.3 | 0.597 | 0.21 | 10 | — | — | — | — | — | — |
| LGN54 | 88208.2 | 0.567 | 0.07 | 8 | — | — | — | — | — | — |
| CONT. | — | 0.542 | — | — | — | — | — | — | — | — |
| LGN2 | 89029.2 | 0.709 | 0.25 | 8 | 7.96 | 0.03 | 13 | 0.407 | L | 10 |
| CONT. | — | 0.659 | — | — | 7.04 | — | — | 0.369 | — | — |
| LGN5 | 88198.4 | — | — | — | 7.61 | 0.01 | 25 | 0.386 | 0.12 | 6 |
| LGN5 | 88201.3 | — | — | — | 7.22 | 0.05 | 19 | 0.363 | 0.29 | 4 |
| LGN5 | 88203.2 | — | — | — | 6.60 | 0.29 | 9 | — | — | — |
| CONT. | — | — | — | — | 6.07 | — | — | 0.365 | — | — |
| LGN24 | 89094.2 | — | — | — | 6.80 | 0.02 | 26 | 0.328 | 0.03 | 14 |
| LGN24 | 89096.1 | — | — | — | — | — | — | 0.311 | 0.10 | 8 |
| CONT. | — | — | — | — | 5.40 | — | — | 0.288 | — | — |
| LGN54 | 88206.4 | 0.568 | 0.29 | 10 | — | — | — | — | — | — |
| CONT. | — | 0.514 | — | — | — | — | — | — | — | — |
| LGN6 | 89170.1 | 0.686 | 0.27 | 6 | — | — | — | — | — | — |
| CONT. | — | 0.647 | — | — | — | — | — | — | — | — |
| LBY79 | 92221.3 | — | — | — | 10.9 | 0.18 | 15 | — | — | — |
| LBY72 | 92764.1 | — | — | — | 11.9 | 0.03 | 24 | 0.540 | 0.05 | 11 |
| LBY72 | 92765.1 | — | — | — | 12.7 | L | 33 | 0.551 | 0.03 | 13 |
| LBY72 | 92766.4 | — | — | — | 10.9 | 0.18 | 14 | 0.521 | 0.21 | 7 |
| LBY32 | 92830.1 | — | — | — | 12.1 | 0.02 | 27 | 0.543 | 0.04 | 12 |
| LBY32 | 92830.3 | — | — | — | 11.3 | 0.11 | 18 | 0.548 | 0.03 | 13 |
| LBY26 | 92484.4 | — | — | — | 12.5 | L | 31 | 0.567 | 0.02 | 17 |
| LBY26 | 92488.1 | — | — | — | 10.8 | 0.20 | 13 | — | — | — |
| LBY233 | 92474.3 | — | — | — | 11.1 | 0.19 | 16 | — | — | — |
| LBY233 | 92477.1 | — | — | — | — | — | — | 0.522 | 0.20 | 7 |
| LBY233 | 92478.3 | — | — | — | 11.0 | 0.19 | 15 | 0.525 | 0.25 | 8 |
| LBY214 | 92760.1 | — | — | — | 11.2 | 0.10 | 17 | 0.531 | 0.10 | 9 |
| LBY214 | 92760.3 | — | — | — | 10.8 | 0.29 | 13 | 0.545 | 0.11 | 12 |
| LBY214 | 92760.4 | — | — | — | — | — | — | 0.525 | 0.30 | 8 |
| LBY210 | 92845.2 | — | — | — | 10.7 | 0.28 | 12 | 0.542 | 0.05 | 12 |
| LBY210 | 92845.4 | — | — | — | — | — | — | 0.538 | 0.07 | 11 |
| LBY204 | 92826.1 | — | — | — | 10.7 | 0.30 | 12 | — | — | — |
| LBY204 | 92827.1 | — | — | — | — | — | — | 0.539 | 0.06 | 11 |
| LBY204 | 92828.3 | — | — | — | — | — | — | 0.518 | 0.27 | 7 |
| LBY196 | 91303.2 | — | — | — | 12.3 | 0.01 | 29 | 0.561 | 0.01 | 15 |
| LBY187 | 92809.2 | — | — | — | 11.4 | 0.09 | 19 | 0.539 | 0.07 | 11 |
| LBY187 | 92812.3 | — | — | — | 10.9 | 0.17 | 15 | — | — | — |
| LBY154 | 92432.1 | 0.845 | 0.20 | 15 | — | — | — | — | — | — |
| LBY137 | 92751.2 | — | — | — | — | — | — | 0.519 | 0.23 | 7 |
| LBY120 | 91214.1 | 0.874 | 0.10 | 19 | 10.7 | 0.24 | 12 | 0.537 | 0.08 | 10 |

TABLE 243-continued

Genes showing improved plant performance at
Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 0.736 | — | — | 9.54 | — | — | 0.486 | — | — |
| LBY83 | 91330.2 | — | — | — | 5.41 | 0.05 | 35 | 0.342 | 0.14 | 22 |
| LBY48 | 90968.1 | — | — | — | 4.74 | 0.27 | 19 | — | — | — |
| LBY224 | 91529.2 | 0.635 | 0.20 | 15 | — | — | — | — | — | — |
| LBY196 | 91303.2 | — | — | — | 4.73 | 0.28 | 19 | — | — | — |
| LBY196 | 91304.2 | 0.656 | 0.10 | 19 | — | — | — | — | — | — |
| LBY150 | 91644.3 | 0.667 | 0.06 | 21 | 4.94 | 0.18 | 24 | 0.331 | 0.23 | 18 |
| LBY133 | 91139.4 | 0.648 | 0.12 | 17 | 5.16 | 0.10 | 29 | — | — | — |
| LBY132 | 91277.1 | — | — | — | 5.38 | 0.05 | 35 | — | — | — |
| LBY132 | 91279.3 | 0.648 | 0.13 | 17 | 5.77 | 0.01 | 45 | 0.346 | 0.11 | 24 |
| LBY125 | 91273.3 | — | — | — | 5.31 | 0.06 | 33 | — | — | — |
| CONT. | — | 0.552 | — | — | 3.99 | — | — | 0.280 | — | — |
| LGN3 | 89069.4 | 0.689 | 0.20 | 16 | — | — | — | — | — | — |
| LGN3 | 89072.3 | 0.638 | 0.25 | 7 | — | — | — | — | — | — |
| LGN3 | 89072.4 | 0.687 | 0.15 | 15 | — | — | — | — | — | — |
| LGN3 | 89073.1 | 0.644 | 0.16 | 8 | — | — | — | — | — | — |
| CONT. | — | 0.596 | — | — | — | — | — | — | — | — |
| NUE102 | 90003.5 | — | — | — | 6.78 | 0.12 | 16 | — | — | — |
| NUE102 | 90004.1 | — | — | — | 6.56 | 0.21 | 12 | — | — | — |
| NUE102 | 90005.2 | 0.769 | 0.10 | 15 | — | — | — | — | — | — |
| CONT. | — | 0.671 | — | — | 5.84 | — | — | — | — | — |
| LGN24 | 89094.2 | — | — | — | 7.75 | 0.05 | 19 | 0.364 | 0.17 | 6 |
| LGN24 | 89094.3 | 0.734 | 0.09 | 9 | 7.24 | 0.18 | 11 | 0.360 | 0.25 | 5 |
| LGN24 | 89096.2 | 0.719 | 0.28 | 7 | — | — | — | — | — | — |
| CONT. | — | 0.671 | — | — | 6.53 | — | — | 0.343 | — | — |
| LBY77 | 92061.2 | — | — | — | 13.2 | 0.19 | 29 | — | — | — |
| LBY77 | 92062.1 | — | — | — | 13.5 | 0.15 | 31 | — | — | — |
| CONT. | — | — | — | — | 10.3 | — | — | — | — | — |
| LGN2 | 89029.2 | — | — | — | 9.37 | L | 46 | 0.469 | 0.13 | 7 |
| CONT. | — | — | — | — | 6.40 | — | — | 0.437 | — | — |
| LGN26 | 89037.3 | 0.647 | 0.24 | 7 | — | — | — | — | — | — |
| LGN26 | 89037.4 | 0.651 | 0.23 | 8 | — | — | — | — | — | — |
| CONT. | — | 0.602 | — | — | — | — | — | — | — | — |
| NUE102 | 90005.2 | 0.810 | 0.07 | 17 | — | — | — | — | — | — |
| CONT. | — | 0.693 | — | — | — | — | — | — | — | — |
| LGN60 | 89175.2 | — | — | — | 6.32 | 0.01 | 12 | 0.371 | 0.22 | 9 |
| LGN60 | 89176.3 | 0.604 | 0.03 | 11 | 7.00 | 0.10 | 11 | 0.365 | 0.28 | 7 |
| CONT. | — | 0.635 | — | — | 6.31 | — | — | 0.351 | — | — |
| LBY54 | 92084.4 | — | — | — | 10.1 | 0.01 | 42 | 0.445 | 0.16 | 16 |
| LBY29 | 91617.1 | — | — | — | 9.20 | 0.06 | 30 | 0.434 | 0.24 | 13 |
| LBY25 | 91335.2 | — | — | — | 9.80 | 0.02 | 38 | 0.440 | 0.18 | 15 |
| LBY230 | 91669.2 | — | — | — | 8.98 | 0.11 | 27 | 0.443 | 0.19 | 15 |
| LBY23 | 91397.3 | — | — | — | 9.27 | 0.06 | 31 | 0.456 | 0.10 | 19 |
| LBY225 | 91605.3 | — | — | — | 8.94 | 0.11 | 26 | — | — | — |
| LBY225 | 91607.3 | — | — | — | 10.0 | 0.02 | 41 | 0.441 | 0.23 | 15 |
| LBY225 | 91607.5 | — | — | — | 9.34 | 0.05 | 32 | — | — | — |
| LBY213 | 92033.1 | 0.756 | 0.18 | 26 | 9.55 | 0.03 | 35 | 0.442 | 0.18 | 15 |
| LBY212 | 92024.3 | — | — | — | 8.56 | 0.19 | 21 | — | — | — |
| LBY182 | 92396.1 | — | — | — | 8.48 | 0.23 | 20 | — | — | — |
| LBY136 | 91442.6 | — | — | — | 8.71 | 0.15 | 23 | — | — | — |
| LBY136 | 91442.9 | — | — | — | 9.06 | 0.09 | 28 | — | — | — |
| CONT. | — | 0.599 | — | — | 7.08 | — | — | 0.384 | — | — |
| LGN49 | 89081.6 | — | — | — | 6.86 | 0.09 | 18 | — | — | — |
| CONT. | — | — | — | — | 5.80 | — | — | — | — | — |

Table 243. "CONT." = Control; "Ave." = Average; "% Incr." = % increment; "p-val." = p-value, L = p < 0.01.
RGR = relative growth rate.

TABLE 244

Genes showing improved plant performance at
Normal growth conditions under regulation of At6669 promoter

| Gene Name | Event # | Harvest Index Ave. | Harvest Index P-Val. | Harvest Index % Incr. | Rosette Area [cm²] Ave. | Rosette Area [cm²] P-Val. | Rosette Area [cm²] % Incr. | Rosette Diameter [cm] Ave. | Rosette Diameter [cm] P-Val. | Rosette Diameter [cm] % Incr. |
|---|---|---|---|---|---|---|---|---|---|---|
| LBY87 | 92256.1 | 0.237 | 0.20 | 14 | — | — | — | — | — | — |
| LBY30 | 92324.4 | — | — | — | 8.58 | L | 29 | 5.05 | L | 10 |
| LBY30 | 92326.2 | — | — | — | — | — | — | 4.91 | 0.06 | 7 |
| LBY225 | 91605.3 | 0.241 | 0.06 | 16 | — | — | — | — | — | — |
| LBY225 | 91607.3 | 0.245 | 0.05 | 18 | — | — | — | — | — | — |
| LBY225 | 91607.5 | — | — | — | 7.54 | 0.22 | 14 | 4.71 | 0.29 | 3 |
| LBY212 | 92026.4 | 0.246 | 0.29 | 19 | — | — | — | — | — | — |
| LBY202 | 92022.1 | 0.224 | 0.29 | 8 | — | — | — | — | — | — |
| LBY193 | 91660.2 | 0.254 | 0.06 | 23 | — | — | — | — | — | — |
| LBY193 | 91662.1 | 0.229 | 0.30 | 10 | 7.36 | 0.08 | 11 | 4.90 | 0.15 | 7 |
| LBY174 | 92079.1 | — | — | — | — | — | — | 4.72 | 0.20 | 3 |
| LBY158 | 91648.1 | — | — | — | — | — | — | 4.82 | 0.17 | 5 |
| LBY158 | 91649.1 | — | — | — | 7.92 | 0.05 | 19 | 5.09 | 0.03 | 11 |
| LBY139 | 92241.2 | — | — | — | 8.00 | 0.02 | 21 | 5.03 | L | 10 |
| LBY135 | 92321.1 | — | — | — | 7.36 | 0.28 | 11 | — | — | — |
| LBY135 | 92321.6 | — | — | — | 8.54 | 0.27 | 29 | 5.15 | 0.28 | 13 |
| LBY135 | 92322.1 | 0.243 | 0.05 | 17 | — | — | — | — | — | — |
| LBY113 | 92234.1 | — | — | — | — | — | — | 4.74 | 0.22 | 4 |
| LBY113 | 92234.6 | — | — | — | 7.17 | 0.29 | 8 | — | — | — |
| CONT. | — | 0.207 | — | — | 6.63 | — | — | 4.57 | — | — |
| LGN5 | 88198.1 | 0.268 | L | 10 | — | — | — | — | — | — |
| LGN5 | 88198.4 | 0.278 | 0.27 | 14 | 8.14 | 0.07 | 10 | 5.05 | 0.02 | 7 |
| LGN5 | 88201.3 | — | — | — | 8.65 | 0.15 | 17 | 5.00 | 0.11 | 11 |
| CONT. | — | 0.260 | — | — | 7.41 | — | — | 4.74 | — | — |
| LBY97 | 92034.3 | — | — | — | 8.31 | 0.01 | 26 | 4.94 | 0.07 | 9 |
| LBY87 | 92255.1 | — | — | — | 9.14 | L | 38 | 5.26 | L | 16 |
| LBY87 | 92256.1 | — | — | — | — | — | — | 4.80 | 0.08 | 6 |
| LBY81 | 92009.1 | — | — | — | 8.54 | 0.15 | 29 | 5.19 | L | 14 |
| LBY230 | 91669.3 | — | — | — | — | — | — | 4.68 | 0.20 | 3 |
| LBY217 | 92362.1 | — | — | — | 7.26 | 0.10 | 10 | 4.74 | 0.21 | 4 |
| LBY138 | 92078.1 | — | — | — | 7.11 | 0.17 | 8 | 4.75 | 0.08 | 5 |
| LBY138 | 92078.4 | — | — | — | 8.82 | L | 34 | 5.10 | 0.03 | 13 |
| LBY136 | 91442.6 | — | — | — | — | — | — | 4.75 | 0.09 | 5 |
| LBY136 | 91442.8 | — | — | — | — | — | — | 4.71 | 0.12 | 4 |
| LBY136 | 91442.9 | — | — | — | 7.98 | 0.02 | 21 | 5.00 | L | 10 |
| LBY135 | 92321.1 | — | — | — | — | — | — | 4.66 | 0.29 | 3 |
| LBY135 | 92321.6 | — | — | — | 8.46 | 0.09 | 28 | 5.10 | 0.09 | 12 |
| LBY120 | 91210.2 | — | — | — | — | — | — | 4.85 | 0.10 | 7 |
| LBY118 | 91432.3 | — | — | — | 8.96 | L | 36 | 5.14 | 0.02 | 13 |
| LBY118 | 91434.5 | — | — | — | 8.06 | 0.01 | 22 | 5.02 | L | 11 |
| LBY117 | 91366.3 | — | — | — | 7.36 | 0.20 | 11 | — | — | — |
| LBY115 | 92073.3 | — | — | — | — | — | — | 4.72 | 0.15 | 4 |
| LBY115 | 92073.5 | — | — | — | 8.04 | 0.03 | 22 | 5.09 | L | 12 |
| LBY112 | 92051.1 | — | — | — | 9.89 | 0.09 | 50 | 5.57 | 0.11 | 23 |
| LBY112 | 92051.3 | — | — | — | 8.49 | L | 29 | 5.10 | L | 12 |
| LBY112 | 92053.6 | — | — | — | 7.82 | 0.04 | 18 | 4.85 | 0.02 | 7 |
| LBY108 | 91423.1 | — | — | — | 7.15 | 0.15 | 8 | 4.89 | 0.01 | 8 |
| LBY108 | 91423.4 | — | — | — | 9.75 | 0.10 | 48 | 5.52 | 0.01 | 22 |
| LBY103 | 91381.11 | — | — | — | — | — | — | 4.82 | 0.16 | 6 |
| LBY103 | 91381.3 | — | — | — | 7.43 | 0.08 | 13 | 4.84 | 0.02 | 7 |
| LBY103 | 91381.9 | — | — | — | 8.72 | L | 32 | 5.14 | L | 13 |
| CONT. | — | — | — | — | 6.60 | — | — | 4.54 | — | — |
| LBY79 | 92221.2 | — | — | — | 11.0 | 0.22 | 12 | 5.92 | 0.18 | 9 |
| LBY72 | 92764.1 | — | — | — | 11.1 | 0.19 | 13 | 5.56 | 0.24 | 2 |
| LBY72 | 92765.3 | — | — | — | 10.5 | 0.06 | 7 | — | — | — |
| LBY72 | 92766.4 | — | — | — | 11.0 | 0.09 | 12 | 5.85 | L | 7 |
| LBY36 | 92526.1 | — | — | — | 12.2 | L | 24 | 6.16 | L | 13 |
| LBY32 | 92830.3 | — | — | — | — | — | — | 6.14 | L | 13 |
| LBY30 | 92326.1 | — | — | — | 11.0 | L | 12 | 5.77 | L | 6 |
| LBY233 | 92477.1 | — | — | — | 11.7 | 0.20 | 19 | 5.95 | L | 9 |
| LBY233 | 92477.2 | — | — | — | 11.7 | L | 19 | 6.10 | L | 12 |
| LBY214 | 92760.3 | — | — | — | 10.5 | 0.07 | 6 | 5.76 | 0.23 | 6 |
| LBY204 | 92827.1 | — | — | — | 12.8 | 0.26 | 30 | 6.13 | 0.25 | 12 |
| LBY204 | 92828.1 | — | — | — | — | — | — | 5.80 | 0.07 | 6 |
| LBY204 | 92828.3 | — | — | — | 12.7 | 0.02 | 29 | 5.98 | 0.04 | 10 |
| LBY165 | 92678.3 | — | — | — | 11.2 | L | 14 | 5.88 | 0.03 | 8 |
| LBY137 | 92752.1 | — | — | — | 11.6 | L | 18 | 5.88 | L | 8 |
| LBY126 | 92834.3 | — | — | — | 11.0 | L | 12 | — | — | — |
| LBY110 | 91179.2 | — | — | — | 11.2 | L | 14 | 6.01 | L | 10 |
| LBY107 | 92285.2 | — | — | — | 10.6 | 0.07 | 8 | — | — | — |
| CONT. | — | — | — | — | 9.83 | — | — | 5.45 | — | — |

TABLE 244-continued

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGN60 | 89175.1 | 0.269 | 0.08 | 26 | 6.19 | 0.02 | 15 | 4.33 | 0.02 | 7 |
| LGN60 | 89175.2 | 0.294 | L | 38 | 6.26 | 0.12 | 16 | 4.30 | 0.14 | 6 |
| LGN60 | 89176.1 | 0.260 | 0.02 | 22 | 5.84 | 0.12 | 8 | 4.17 | 0.16 | 3 |
| LGN60 | 89176.3 | — | — | — | 6.89 | 0.04 | 28 | 4.60 | 0.04 | 14 |
| CONT. | — | 0.213 | — | — | 5.40 | — | — | 4.04 | — | — |
| LGN49 | 89081.1 | — | — | — | 7.36 | 0.24 | 17 | 4.68 | 0.21 | 7 |
| LGN49 | 89081.3 | — | — | — | 7.71 | 0.18 | 22 | 4.77 | 0.21 | 8 |
| LGN49 | 89081.6 | — | — | — | 8.30 | 0.12 | 22 | 5.13 | 0.12 | 11 |
| CONT. | — | — | — | — | 6.80 | — | — | 4.64 | — | — |
| LGN54 | 88206.1 | 0.268 | 0.22 | 12 | — | — | — | — | — | — |
| LGN54 | 88206.4 | 0.274 | 0.23 | 10 | — | — | — | — | — | — |
| CONT. | — | 0.250 | — | — | — | — | — | — | — | — |
| LGN2 | 89029.2 | — | — | — | 8.51 | 0.04 | 13 | 5.06 | L | 8 |
| CONT. | — | — | — | — | 7.51 | — | — | 4.69 | — | — |
| LGN5 | 88198.4 | — | — | — | 8.40 | L | 28 | 5.17 | L | 11 |
| LGN5 | 88201.1 | 0.277 | 0.06 | 28 | — | — | — | — | — | — |
| LGN5 | 88201.3 | — | — | — | 7.87 | 0.03 | 20 | 4.91 | 0.12 | 6 |
| LGN5 | 88203.2 | — | — | — | 7.23 | 0.25 | 10 | — | — | — |
| CONT. | — | 0.216 | — | — | 6.55 | — | — | 4.64 | — | — |
| LGN24 | 89094.2 | — | — | — | 7.28 | L | 26 | 4.68 | 0.01 | 12 |
| CONT. | — | — | — | — | 5.77 | — | — | 4.18 | — | — |
| LGN54 | 88206.1 | 0.268 | 0.06 | 15 | — | — | — | — | — | — |
| LGN54 | 88208.2 | 0.264 | 0.15 | 14 | — | — | — | — | — | — |
| CONT. | — | 0.263 | — | — | — | — | — | — | — | — |
| LGN6 | 89173.1 | 0.238 | 0.14 | 27 | — | — | — | — | — | — |
| CONT. | — | 0.188 | — | — | — | — | — | — | — | — |
| LBY79 | 92221.3 | — | — | — | 11.0 | 0.29 | 15 | 5.55 | 0.27 | 5 |
| LBY72 | 92764.1 | — | — | — | 12.2 | 0.10 | 27 | 5.92 | 0.06 | 12 |
| LBY72 | 92765.1 | — | — | — | 12.9 | 0.15 | 34 | 6.18 | L | 17 |
| LBY72 | 92766.2 | — | — | — | — | — | — | 5.40 | 0.07 | 3 |
| LBY72 | 92766.4 | — | — | — | 11.0 | 0.09 | 15 | 5.75 | L | 9 |
| LBY36 | 92526.1 | — | — | — | 10.7 | 0.22 | 12 | 5.70 | 0.07 | 8 |
| LBY32 | 92830.1 | — | — | — | 12.3 | 0.11 | 28 | 6.01 | 0.03 | 14 |
| LBY32 | 92830.3 | — | — | — | 11.6 | 0.09 | 22 | 6.00 | L | 14 |
| LBY32 | 92832.1 | — | — | — | 10.7 | 0.10 | 12 | 5.48 | 0.11 | 4 |
| LBY32 | 92833.2 | — | — | — | — | — | — | 5.63 | 0.13 | 7 |
| LBY26 | 92484.4 | — | — | — | 12.7 | 0.04 | 33 | 6.34 | 0.19 | 20 |
| LBY26 | 92484.5 | — | — | — | 10.1 | 0.01 | 6 | 5.34 | 0.30 | 1 |
| LBY26 | 92488.1 | — | — | — | 10.8 | 0.02 | 13 | 5.49 | 0.03 | 4 |
| LBY233 | 92477.1 | — | — | — | 10.2 | 0.30 | 6 | 5.58 | 0.07 | 6 |
| LBY214 | 92760.1 | — | — | — | 11.3 | 0.01 | 18 | 5.76 | L | 9 |
| LBY210 | 92845.2 | — | — | — | — | — | — | 5.81 | L | 10 |
| LBY210 | 92845.4 | — | — | — | 10.3 | L | 8 | 5.67 | 0.22 | 8 |
| LBY210 | 92846.2 | — | — | — | 10.0 | 0.20 | 5 | — | — | — |
| LBY204 | 92827.1 | — | — | — | 10.8 | L | 13 | 5.84 | 0.07 | 11 |
| LBY204 | 92828.3 | — | — | — | 10.7 | 0.27 | 11 | — | — | — |
| LBY196 | 91303.2 | — | — | — | 12.5 | 0.21 | 31 | 6.14 | 0.04 | 17 |
| LBY187 | 92809.2 | — | — | — | 11.6 | 0.20 | 21 | 5.90 | 0.21 | 12 |
| LBY187 | 92812.3 | — | — | — | 11.0 | 0.23 | 15 | 5.65 | 0.24 | 7 |
| LBY187 | 92813.2 | — | — | — | — | — | — | 5.38 | 0.11 | 2 |
| LBY137 | 92751.2 | — | — | — | — | — | — | 5.45 | 0.02 | 4 |
| LBY126 | 92837.3 | — | — | — | 10.3 | 0.17 | 8 | 5.46 | 0.03 | 4 |
| LBY126 | 92837.4 | — | — | — | 9.98 | 0.11 | 4 | 5.41 | 0.08 | 3 |
| LBY126 | 92838.1 | — | — | — | 10.5 | 0.23 | 9 | — | — | — |
| LBY120 | 91210.2 | — | — | — | 9.74 | 0.29 | 2 | — | — | — |
| LBY120 | 91214.1 | — | — | — | 10.6 | 0.24 | 11 | 5.58 | 0.29 | 6 |
| CONT. | — | — | — | — | 9.56 | — | — | 5.26 | — | — |
| LBY83 | 91330.1 | — | — | — | 5.34 | 0.10 | 12 | 4.21 | 0.05 | 7 |
| LBY83 | 91330.2 | — | — | — | 6.47 | 0.06 | 36 | 4.89 | L | 25 |
| LBY83 | 91332.1 | — | — | — | 5.50 | 0.03 | 15 | 4.24 | 0.02 | 8 |
| LBY83 | 91332.2 | — | — | — | — | — | — | 4.16 | 0.18 | 6 |
| LBY63 | 91326.1 | 0.222 | 0.02 | 18 | — | — | — | 4.23 | 0.07 | 8 |
| LBY51 | 90981.1 | — | — | — | 5.28 | 0.09 | 11 | — | — | — |
| LBY51 | 90981.4 | 0.202 | 0.28 | 7 | — | — | — | — | — | — |
| LBY48 | 90968.1 | — | — | — | 5.66 | 0.01 | 19 | 4.36 | L | 11 |
| LBY48 | 90968.2 | — | — | — | 5.44 | 0.07 | 14 | 4.26 | 0.01 | 9 |
| LBY48 | 90970.2 | 0.218 | 0.03 | 16 | — | — | — | — | — | — |
| LBY224 | 91527.4 | 0.214 | 0.18 | 14 | 5.43 | 0.29 | 14 | 4.29 | 0.23 | 9 |
| LBY224 | 91529.1 | — | — | — | 5.47 | 0.11 | 15 | 4.29 | 0.01 | 9 |
| LBY22 | 90961.1 | 0.213 | 0.06 | 13 | — | — | — | — | — | — |
| LBY22 | 90961.2 | — | — | — | 5.41 | 0.17 | 14 | 4.19 | 0.16 | 7 |

TABLE 244-continued

Genes showing improved plant performance at
Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY22 | 90965.5 | — | — | — | 5.45 | 0.10 | 14 | 4.23 | 0.12 | 8 |
| LBY196 | 91300.1 | 0.212 | 0.18 | 13 | 5.42 | 0.04 | 14 | 4.30 | 0.04 | 10 |
| LBY196 | 91303.2 | — | — | — | 5.65 | 0.29 | 19 | 4.34 | 0.24 | 11 |
| LBY188 | 91557.3 | 0.225 | 0.01 | 20 | — | — | — | — | — | — |
| LBY150 | 91642.1 | 0.237 | 0.15 | 26 | — | — | — | — | — | — |
| LBY150 | 91644.2 | 0.220 | 0.14 | 17 | — | — | — | — | — | — |
| LBY150 | 91644.3 | — | — | — | 5.98 | L | 26 | 4.47 | L | 14 |
| LBY134 | 91281.5 | — | — | — | — | — | — | 4.26 | 0.08 | 9 |
| LBY134 | 91284.1 | 0.241 | 0.21 | 28 | — | — | — | — | — | — |
| LBY133 | 91139.2 | — | — | — | — | — | — | 4.15 | 0.16 | 6 |
| LBY133 | 91139.4 | — | — | — | 6.17 | 0.05 | 29 | 4.42 | 0.02 | 13 |
| LBY132 | 91277.1 | — | — | — | 6.57 | 0.20 | 38 | 4.71 | 0.04 | 20 |
| LBY132 | 91279.3 | 0.205 | 0.20 | 9 | 6.87 | 0.03 | 44 | 4.84 | L | 23 |
| LBY125 | 91273.2 | 0.211 | 0.23 | 12 | — | — | — | — | — | — |
| LBY125 | 91273.3 | — | — | — | 6.41 | 0.10 | 35 | 4.62 | 0.08 | 18 |
| LBY125 | 91273.4 | 0.224 | 0.26 | 19 | — | — | — | — | — | — |
| LBY102 | 91262.1 | — | — | — | 5.32 | 0.17 | 12 | 4.18 | 0.14 | 6 |
| CONT. | — | 0.188 | — | — | 4.77 | — | — | 3.92 | — | — |
| NUE102 | 90003.5 | 0.262 | 0.25 | 13 | 6.13 | 0.15 | 15 | 4.57 | 0.25 | v5 |
| NUE102 | 90004.1 | 0.292 | 0.12 | 26 | 5.90 | 0.27 | 11 | 4.60 | 0.18 | 6 |
| CONT. | — | 0.232 | — | — | 5.33 | — | — | 4.35 | — | — |
| LGN24 | 89094.2 | — | — | — | 8.10 | 0.04 | 19 | 4.96 | 0.06 | 8 |
| LGN24 | 89094.3 | — | — | — | 7.53 | 0.16 | 11 | 4.88 | 0.15 | 6 |
| CONT. | — | — | — | — | 6.79 | — | — | 4.61 | — | — |
| LBY91 | 91630.1 | — | — | — | — | — | — | 6.29 | 0.27 | 12 |
| LBY91 | 91633.2 | 0.252 | 0.15 | 12 | — | — | — | 6.02 | 0.19 | 7 |
| LBY91 | 91634.3 | 0.258 | 0.27 | 14 | 12.5 | 0.16 | 13 | 6.01 | 0.13 | 7 |
| LBY81 | 92013.2 | — | — | — | 13.5 | 0.06 | 22 | 6.18 | 0.19 | 10 |
| LBY77 | 92061.2 | — | — | — | 14.2 | 0.01 | 29 | 6.34 | 0.01 | 13 |
| LBY77 | 92062.1 | 0.253 | 0.20 | 12 | 14.6 | L | 32 | 6.67 | L | 18 |
| LBY49 | 92039.4 | — | — | — | 12.3 | 0.25 | 11 | 5.99 | 0.17 | 6 |
| LBY49 | 92043.1 | 0.270 | 0.03 | 19 | — | — | — | — | — | — |
| LBY29 | 91617.1 | 0.253 | 0.14 | 12 | — | — | — | — | — | — |
| LBY29 | 91619.1 | 0.270 | 0.04 | 19 | 12.5 | 0.17 | 13 | 5.94 | 0.20 | 5 |
| LBY29 | 91619.5 | 0.268 | 0.10 | 19 | 12.8 | 0.14 | 16 | 6.08 | 0.08 | 8 |
| LBY23 | 91396.3 | — | — | — | 12.9 | 0.22 | 17 | — | — | — |
| LBY23 | 91397.4 | 0.264 | 0.05 | 17 | — | — | — | — | — | — |
| LBY174 | 92079.1 | — | — | — | 12.7 | 0.19 | 15 | 6.04 | 0.15 | 7 |
| LBY174 | 92080.1 | — | — | — | 12.1 | 0.30 | 10 | — | — | — |
| LBY158 | 91647.3 | — | — | — | 12.6 | 0.24 | 14 | 5.95 | 0.22 | 6 |
| LBY158 | 91649.1 | — | — | — | 13.1 | 0.26 | 19 | 6.14 | 0.15 | 9 |
| LBY146 | 91590.1 | 0.255 | 0.22 | 13 | — | — | — | — | — | — |
| LBY146 | 91593.3 | 0.256 | 0.15 | 13 | 13.4 | 0.05 | 21 | 6.06 | 0.13 | 8 |
| LBY138 | 92075.2 | — | — | — | 12.2 | 0.28 | 10 | — | — | — |
| LBY138 | 92076.1 | — | — | — | — | — | — | 5.97 | 0.20 | 6 |
| LBY115 | 92073.1 | — | — | — | 12.7 | 0.12 | 15 | 6.05 | 0.09 | 7 |
| LBY112 | 92053.2 | 0.270 | 0.04 | 19 | — | — | — | — | — | — |
| LBY108 | 91422.2 | — | — | — | 12.5 | 0.15 | 13 | 6.04 | 0.11 | 7 |
| LBY108 | 91423.1 | — | — | — | 13.4 | 0.05 | 21 | 6.33 | 0.10 | 12 |
| LBY104 | 91269.2 | — | — | — | 12.6 | 0.28 | 14 | 6.14 | 0.13 | 9 |
| CONT. | — | 0.226 | — | — | 11.0 | — | — | 5.63 | — | — |
| LGN2 | 89029.2 | 0.257 | 0.10 | 16 | 8.47 | L | 46 | 5.25 | 0.01 | 15 |
| CONT. | — | 0.221 | — | — | 5.80 | — | — | 4.56 | — | — |
| NUE102 | 90004.1 | 0.199 | 0.15 | 18 | — | — | — | — | — | — |
| CONT. | — | 0.168 | — | — | — | — | — | — | — | — |
| LGN60 | 89174.2 | 0.334 | L | 23 | — | — | — | — | — | — |
| LGN60 | 89175.1 | 0.321 | L | 18 | — | — | — | — | — | — |
| LGN60 | 89175.2 | 0.296 | 0.03 | 9 | 6.59 | 0.05 | 8 | 4.56 | 0.19 | 3 |
| LGN60 | 89176.1 | 0.323 | L | 19 | — | — | — | — | — | — |
| LGN60 | 89176.3 | — | — | — | 7.54 | 0.08 | 11 | 4.83 | 0.13 | 6 |
| CONT. | — | 0.305 | — | — | 6.82 | — | — | 4.58 | — | — |
| LBY77 | 92061.2 | 0.221 | 0.15 | 30 | — | — | — | — | — | — |
| LBY77 | 92062.1 | — | — | — | 8.18 | 0.19 | 11 | 5.03 | 0.06 | 8 |
| LBY77 | 92063.4 | 0.205 | 0.21 | 21 | — | — | — | — | — | — |
| LBY54 | 92084.4 | — | — | — | 10.5 | L | 43 | 5.54 | 0.04 | 19 |
| LBY54 | 92086.1 | — | — | — | 8.33 | 0.11 | 13 | 4.96 | 0.11 | 6 |
| LBY49 | 92043.2 | 0.232 | 0.23 | 37 | — | — | — | — | — | — |
| LBY29 | 91617.1 | 0.206 | 0.18 | 21 | 9.45 | L | 28 | 5.25 | L | 12 |
| LBY29 | 91619.1 | 0.202 | 0.12 | 19 | — | — | — | 4.90 | 0.19 | 5 |
| LBY25 | 91335.2 | — | — | — | 10.3 | L | 39 | 5.50 | L | 18 |
| LBY230 | 91667.1 | 0.193 | 0.24 | 14 | — | — | — | — | — | — |

TABLE 244-continued

Genes showing improved plant performance at
Normal growth conditions under regulation of At6669 promoter

| Gene Name | Event # | Harvest Index Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| LBY230 | 91669.2 | — | — | — | — | — | — | 5.20 | 0.19 | 11 |
| LBY23 | 91397.3 | — | — | — | 9.60 | 0.07 | 30 | 5.41 | 0.05 | 16 |
| LBY225 | 91605.3 | — | — | — | 9.27 | 0.03 | 26 | 5.12 | 0.09 | 10 |
| LBY225 | 91607.3 | 0.269 | L | 58 | 10.4 | 0.30 | 41 | 5.51 | 0.29 | 18 |
| LBY225 | 91607.5 | 0.233 | 0.01 | 37 | 9.65 | L | 31 | 5.25 | 0.09 | 12 |
| LBY217 | 92363.1 | — | — | — | 8.06 | 0.23 | 9 | 4.97 | 0.08 | 6 |
| LBY213 | 92032.1 | 0.201 | 0.14 | 18 | — | — | — | — | — | — |
| LBY213 | 92033.1 | — | — | — | 9.92 | 0.06 | 35 | 5.46 | 0.02 | 17 |
| LBY212 | 92024.2 | — | — | — | — | — | — | 4.99 | 0.16 | 7 |
| LBY212 | 92024.3 | — | — | — | 8.95 | 0.03 | 21 | 5.23 | 0.01 | 12 |
| LBY202 | 92022.1 | 0.205 | 0.21 | 21 | 8.70 | 0.04 | 18 | 5.07 | 0.05 | 9 |
| LBY182 | 92396.1 | 0.225 | 0.16 | 33 | 8.81 | 0.28 | 20 | 5.10 | 0.15 | 9 |
| LBY182 | 92398.2 | 0.223 | 0.23 | 31 | — | — | — | — | — | — |
| LBY182 | 92398.3 | 0.204 | 0.11 | 20 | — | — | — | — | — | — |
| LBY136 | 91442.6 | — | — | — | 8.98 | 0.03 | 22 | 5.19 | 0.01 | 11 |
| LBY136 | 91442.9 | — | — | — | 9.27 | 0.13 | 26 | 5.15 | 0.18 | 10 |
| CONT. | — | 0.170 | — | — | 7.37 | — | — | 4.67 | — | — |
| LGN49 | 89079.3 | 0.200 | 0.22 | 7 | — | — | — | — | — | — |
| LGN49 | 89081.6 | — | — | — | 7.66 | 0.08 | 19 | 5.01 | 0.18 | 9 |
| LGN49 | 89082.1 | 0.208 | 0.13 | 11 | — | — | — | — | — | — |
| CONT. | — | 0.190 | — | — | 6.42 | — | — | 4.61 | — | — |

Table 244. "CONT." = Control; "Ave." = Average; "% Incr." = % increment; "p-val." = p-value, L = p < 0.01.

TABLE 245

Genes showing improved plant performance at
Normal growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LBY96 | 92428.4 | — | — | — | 20.1 | 0.09 | 13 |
| LBY89 | 92259.1 | — | — | — | 22.3 | 0.11 | 25 |
| LBY87 | 92255.2 | — | — | — | 19.1 | 0.04 | 7 |
| LBY87 | 92256.1 | 334.1 | 0.07 | 21 | — | — | — |
| LBY55 | 92422.6 | — | — | — | 20.1 | L | 13 |
| LBY30 | 92326.2 | — | — | — | 19.9 | 0.01 | 12 |
| LBY225 | 91605.3 | 300.9 | 0.26 | 9 | — | — | — |
| LBY225 | 91607.2 | — | — | — | 18.6 | 0.19 | 4 |
| LBY225 | 91607.3 | 323.9 | 0.06 | 17 | — | — | — |
| LBY212 | 92028.3 | 310.9 | 0.13 | 13 | — | — | — |
| LBY202 | 92021.1 | 319.5 | 0.16 | 16 | — | — | — |
| LBY202 | 92022.1 | — | — | — | 18.8 | 0.21 | 5 |
| LBY193 | 91660.2 | 358.4 | 0.04 | 30 | 21.1 | L | 18 |
| LBY182 | 92398.3 | — | — | — | 19.6 | L | 10 |
| LBY174 | 92079.8 | — | — | — | 21.3 | 0.07 | 19 |
| LBY139 | 92239.1 | — | — | — | 20.5 | 0.03 | 15 |
| LBY135 | 92321.1 | — | — | — | 19.1 | L | 7 |
| LBY135 | 92321.6 | — | — | — | 19.8 | 0.04 | 11 |
| LBY135 | 92322.1 | 363.2 | 0.01 | 32 | — | — | — |
| LBY135 | 92323.1 | — | — | — | 18.2 | 0.19 | 2 |
| LBY135 | 92323.3 | 298.7 | 0.30 | 8 | — | — | — |
| CONT. | — | 275.8 | — | — | 17.9 | — | — |
| LGN5 | 88198.1 | 273.6 | 0.08 | 11 | 19.5 | 0.02 | 8 |
| LGN5 | 88198.4 | 279.4 | 0.21 | 14 | 18.4 | 0.21 | 2 |
| LGN5 | 88201.3 | — | — | — | 21.4 | 0.22 | 12 |
| CONT. | — | 245.7 | — | — | 19.2 | — | — |
| LGN60 | 89175.1 | 279.8 | 0.13 | 18 | — | — | — |
| LGN60 | 89175.2 | 301.9 | 0.02 | 28 | — | — | — |
| LGN60 | 89176.1 | 283.5 | 0.06 | 20 | — | — | — |
| LGN60 | 89176.3 | — | — | — | 22.7 | L | 22 |
| CONT. | — | 236.5 | — | — | 18.7 | — | — |
| LGN49 | 89081.3 | — | — | — | 22.3 | L | 19 |
| LGN49 | 89081.6 | — | — | — | 20.9 | 0.03 | 12 |
| CONT. | — | — | — | — | 18.7 | — | — |
| LGN5 | 88198.1 | — | — | — | 21.0 | 0.07 | 9 |
| LGN5 | 88198.4 | — | — | — | 19.1 | 0.25 | 4 |
| LGN5 | 88201.1 | 267.2 | 0.29 | 11 | — | — | — |
| LGN5 | 88201.3 | — | — | — | 22.0 | 0.05 | 14 |
| CONT. | — | 241.2 | — | — | 19.3 | — | — |
| LGN24 | 89094.2 | — | — | — | 21.7 | 0.08 | 17 |
| CONT. | — | — | — | — | 18.5 | — | — |
| LGN54 | 88206.1 | 282.8 | 0.28 | 8 | — | — | — |
| CONT. | — | 284.5 | — | — | — | — | — |
| LGN6 | 89169.2 | — | — | — | 19.5 | 0.12 | 6 |
| LGN6 | 89173.1 | 206.9 | 0.29 | 18 | — | — | — |
| CONT. | — | 175.5 | — | — | 18.3 | — | — |
| LGN36 | 89044.1 | 128.6 | 0.23 | 39 | — | — | — |
| CONT. | — | 92.6 | — | — | — | — | — |
| LGN6 | 89169.2 | — | — | — | 17.9 | L | 14 |
| LGN6 | 89171.4 | — | — | — | 16.5 | 0.22 | 5 |
| CONT. | — | — | — | — | 15.7 | — | — |
| LBY83 | 91330.1 | 288.6 | 0.30 | 11 | — | — | — |
| LBY63 | 91325.2 | — | — | — | 19.5 | L | 7 |
| LBY63 | 91326.1 | 289.0 | 0.21 | 11 | — | — | — |
| LBY51 | 90981.4 | 288.9 | 0.25 | 11 | 19.6 | 0.05 | 8 |
| LBY22 | 90961.1 | 299.6 | 0.09 | 15 | — | — | — |
| LBY22 | 90961.2 | — | — | — | 19.9 | 0.28 | 10 |
| LBY196 | 91300.1 | 308.0 | 0.05 | 18 | — | — | — |
| LBY196 | 91303.2 | — | — | — | 21.3 | 0.03 | 17 |
| LBY188 | 91557.3 | 335.0 | 0.22 | 28 | — | — | — |
| LBY150 | 91642.1 | 332.3 | L | 27 | — | — | — |
| LBY150 | 91644.1 | 305.1 | 0.08 | 16 | — | — | — |
| LBY134 | 91282.1 | 304.3 | 0.23 | 17 | 21.3 | L | 17 |
| LBY134 | 91284.1 | 382.4 | L | 47 | — | — | — |
| LBY132 | 91279.3 | 289.8 | 0.28 | 11 | 20.3 | L | 12 |
| LBY125 | 91273.2 | — | — | — | 19.4 | L | 7 |
| LBY125 | 91273.4 | 305.3 | 0.06 | 17 | — | — | — |
| LBY102 | 91262.1 | — | — | — | 20.5 | 0.04 | 13 |
| CONT. | — | 261.0 | — | — | 18.2 | — | — |
| NUE102 | 90003.5 | 287.4 | 0.01 | 30 | — | — | — |
| NUE102 | 90004.1 | 294.7 | 0.01 | 33 | — | — | — |
| CONT. | — | 221.6 | — | — | — | — | — |

TABLE 245-continued

Genes showing improved plant performance at Normal growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LGN24 | 89094.2 | — | — | — | 19.6 | L | 18 |
| CONT. | — | — | — | — | 16.7 | — | — |
| LBY91 | 91630.1 | — | — | — | 20.0 | 0.04 | 30 |
| LBY91 | 91633.1 | — | — | — | 18.5 | 0.12 | 21 |
| LBY91 | 91633.2 | — | — | — | 19.0 | 0.08 | 24 |
| LBY81 | 92009.1 | — | — | — | 19.6 | 0.05 | 28 |
| LBY81 | 92009.3 | — | — | — | 17.6 | 0.25 | 15 |
| LBY81 | 92009.4 | — | — | — | 18.1 | 0.17 | 18 |
| LBY77 | 92061.1 | — | — | — | 17.9 | 0.20 | 17 |
| LBY77 | 92061.2 | — | — | — | 18.7 | 0.11 | 22 |
| LBY77 | 92062.1 | 344.8 | 0.10 | 18 | — | — | — |
| LBY77 | 92063.6 | — | — | — | 17.6 | 0.25 | 15 |
| LBY54 | 92084.7 | — | — | — | 17.7 | 0.25 | 15 |
| LBY54 | 92087.3 | — | — | — | 17.9 | 0.22 | 17 |
| LBY35 | 92119.2 | — | — | — | 18.0 | 0.18 | 17 |
| LBY29 | 91617.1 | — | — | — | 18.7 | 0.19 | 22 |
| LBY29 | 91617.4 | — | — | — | 18.5 | 0.12 | 21 |
| LBY29 | 91619.1 | — | — | — | 17.8 | 0.25 | 16 |
| LBY29 | 91619.5 | — | — | — | 18.9 | 0.09 | 23 |
| LBY23 | 91397.2 | 324.9 | 0.29 | 12 | — | — | — |
| LBY174 | 92079.7 | — | — | — | 17.7 | 0.26 | 15 |
| LBY158 | 91647.2 | — | — | — | 17.5 | 0.27 | 14 |
| LBY158 | 91647.5 | — | — | — | 18.4 | 0.13 | 20 |
| LBY158 | 91648.1 | — | — | — | 19.8 | 0.05 | 29 |
| LBY146 | 91593.3 | 364.5 | 0.18 | 25 | 20.8 | 0.02 | 36 |
| LBY138 | 92076.1 | — | — | — | 19.8 | 0.05 | 29 |
| LBY117 | 91365.1 | — | — | — | 18.4 | 0.25 | 20 |
| LBY117 | 91366.1 | — | — | — | 18.5 | 0.17 | 21 |
| LBY115 | 92071.2 | — | — | — | 17.6 | 0.25 | 15 |
| LBY112 | 92051.3 | — | — | — | 20.3 | 0.08 | 32 |
| LBY112 | 92052.2 | — | — | — | 17.7 | 0.23 | 16 |
| LBY112 | 92053.2 | 337.9 | 0.16 | 16 | — | — | — |
| LBY108 | 91423.4 | — | — | — | 19.4 | 0.06 | 27 |
| LBY103 | 91381.8 | — | — | — | 18.0 | 0.18 | 18 |
| LBY103 | 91381.9 | — | — | — | 18.8 | 0.11 | 22 |
| CONT. | — | 291.3 | — | — | 15.3 | — | — |
| LGN2 | 89029.2 | 268.5 | 0.01 | 20 | — | — | — |
| CONT. | — | 224.7 | — | — | — | — | — |
| LGN26 | 89036.1 | — | — | — | 20.2 | 0.18 | 13 |
| LGN26 | 89037.2 | — | — | — | 20.8 | 0.15 | 16 |
| LGN26 | 89037.3 | — | — | — | 20.4 | L | 14 |
| LGN26 | 89037.4 | — | — | — | 19.1 | 0.05 | 7 |
| CONT. | — | — | — | — | 17.9 | — | — |
| NUE102 | 90004.1 | 208.7 | 0.03 | 20 | — | — | — |
| CONT. | — | 174.1 | — | — | — | — | — |
| LGN60 | 89174.2 | 373.2 | 0.09 | 18 | — | — | — |
| LGN60 | 89175.1 | 328.5 | 0.13 | 11 | — | — | — |
| LGN60 | 89175.2 | 332.8 | L | 12 | — | — | — |
| LGN60 | 89176.1 | 342.8 | L | 16 | — | — | — |
| LGN60 | 89176.3 | 334.2 | 0.20 | 13 | 23.2 | 0.22 | 13 |
| CONT. | — | 316.5 | — | — | 21.3 | — | — |
| LBY91 | 91630.1 | — | — | — | 18.6 | L | 15 |
| LBY91 | 91633.1 | — | — | — | 17.7 | 0.03 | 10 |
| LBY77 | 92062.1 | — | — | — | 17.5 | 0.02 | 8 |
| LBY49 | 92039.4 | — | — | — | 18.2 | L | 12 |
| LBY49 | 92043.1 | — | — | — | 17.3 | 0.04 | 7 |
| LBY49 | 92043.2 | — | — | — | 16.8 | 0.15 | 4 |
| LBY35 | 92122.1 | — | — | — | 17.8 | 0.01 | 10 |
| LBY29 | 91617.1 | 275.7 | 0.23 | 19 | — | — | — |
| LBY25 | 91335.2 | — | — | — | 18.6 | L | 15 |
| LBY25 | 91338.2 | — | — | — | 17.4 | 0.03 | 7 |
| LBY25 | 91339.1 | — | — | — | 17.1 | 0.08 | 6 |
| LBY225 | 91607.3 | 318.7 | 0.03 | 38 | — | — | — |
| LBY225 | 91607.5 | 304.7 | 0.06 | 32 | — | — | — |
| LBY217 | 92363.1 | — | — | — | 18.7 | 0.13 | 16 |
| LBY202 | 92022.2 | — | — | — | 17.7 | 0.12 | 9 |
| LBY193 | 91660.2 | — | — | — | 18.7 | 0.26 | 16 |
| LBY182 | 92396.2 | — | — | — | 17.3 | 0.03 | 7 |
| LBY182 | 92398.2 | — | — | — | 17.0 | 0.19 | 5 |
| LBY182 | 92398.3 | — | — | — | 16.9 | 0.17 | 5 |
| LBY118 | 91434.4 | — | — | — | 17.1 | 0.30 | 6 |
| CONT. | — | 231.5 | — | — | 16.2 | — | — |
| LGN49 | 89081.3 | 202.2 | 0.20 | 11 | 22.1 | L | 14 |
| LGN49 | 89081.6 | — | — | — | 20.8 | 0.25 | 7 |
| CONT. | — | 201.5 | — | — | 19.5 | — | — |
| LGN26 | 89036.1 | — | — | — | 17.9 | L | 7 |
| LGN26 | 89036.4 | — | — | — | 17.9 | L | 6 |
| LGN26 | 89037.2 | — | — | — | 19.5 | 0.02 | 16 |
| LGN26 | 89037.3 | — | — | — | 20.6 | L | 23 |
| LGN26 | 89037.4 | — | — | — | 17.7 | 0.21 | 5 |
| CONT. | — | — | — | — | 16.8 | — | — |

Table 245. "CONT." = Control; "Ave." = Average; "% Incr." = % increment; "p-val." = p-value, L = p < 0.01.

TABLE 246

Genes showing improved plant performance at Normal growth conditions under regulation of At6669 promoter

| Gene Name | Event # | 1000 Seed Weight [mg] Ave. | P-Val. | % Incr. |
|---|---|---|---|---|
| LBY96 | 92428.4 | 20.1 | 0.09 | 13 |
| LBY89 | 92259.1 | 22.3 | 0.11 | 25 |
| LBY87 | 92255.2 | 19.1 | 0.04 | 7 |
| LBY55 | 92422.6 | 20.1 | L | 13 |
| LBY30 | 92326.2 | 19.9 | 0.01 | 12 |
| LBY225 | 91607.2 | 18.6 | 0.19 | 4 |
| LBY202 | 92022.1 | 18.8 | 0.21 | 5 |
| LBY193 | 91660.2 | 21.1 | L | 18 |
| LBY182 | 92398.3 | 19.6 | L | 10 |
| LBY174 | 92079.8 | 21.3 | 0.07 | 19 |
| LBY139 | 92239.1 | 20.5 | 0.03 | 15 |
| LBY135 | 92321.1 | 19.1 | L | 7 |
| LBY135 | 92321.6 | 19.8 | 0.04 | 11 |
| LBY135 | 92323.1 | 18.2 | 0.19 | 2 |
| CONT. | — | 17.9 | — | — |
| LGN5 | 88198.1 | 19.5 | 0.02 | 8 |
| LGN5 | 88198.4 | 18.4 | 0.21 | 2 |
| LGN5 | 88201.3 | 21.4 | 0.22 | 12 |
| CONT. | — | 19.2 | — | — |
| LGN60 | 89176.3 | 22.7 | L | 22 |
| CONT. | — | 18.7 | — | — |
| LGN49 | 89081.3 | 22.3 | L | 19 |
| LGN49 | 89081.6 | 20.9 | 0.03 | 12 |
| CONT. | — | 18.7 | — | — |
| LGN5 | 88198.1 | 21.0 | 0.07 | 9 |
| LGN5 | 88198.4 | 19.1 | 0.25 | 4 |
| LGN5 | 88201.3 | 22.0 | 0.05 | 14 |
| CONT. | — | 19.3 | — | — |
| LGN24 | 89094.2 | 21.7 | 0.08 | 17 |
| CONT. | — | 18.5 | — | — |
| LGN6 | 89169.2 | 19.5 | 0.12 | 6 |
| CONT. | — | 18.3 | — | — |
| LGN6 | 89169.2 | 17.9 | L | 14 |
| LGN6 | 89171.4 | 16.5 | 0.22 | 5 |
| CONT. | — | 15.7 | — | — |
| LBY63 | 91325.2 | 19.5 | L | 7 |
| LBY51 | 90981.4 | 19.6 | 0.05 | 8 |
| LBY22 | 90961.2 | 19.9 | 0.28 | 10 |
| LBY196 | 91303.2 | 21.3 | 0.03 | 17 |
| LBY134 | 91282.1 | 21.3 | L | 17 |
| LBY132 | 91279.3 | 20.3 | L | 12 |
| LBY125 | 91273.2 | 19.4 | L | 7 |
| LBY102 | 91262.2 | 20.5 | 0.04 | 13 |
| CONT. | — | 18.2 | — | — |
| LGN24 | 89094.2 | 19.6 | L | 18 |
| CONT. | — | 16.7 | — | — |
| LBY91 | 91630.1 | 20.0 | 0.04 | 30 |
| LBY91 | 91633.1 | 18.5 | 0.12 | 21 |
| LBY91 | 91633.2 | 19.0 | 0.08 | 24 |
| LBY81 | 92009.1 | 19.6 | 0.05 | 28 |
| LBY81 | 92009.3 | 17.6 | 0.25 | 15 |

TABLE 246-continued

Genes showing improved plant performance at Normal growth conditions under regulation of At6669 promoter

| Gene Name | Event # | 1000 Seed Weight [mg] | | |
|---|---|---|---|---|
| | | Ave. | P-Val. | % Incr. |
| LBY81 | 92009.4 | 18.1 | 0.17 | 18 |
| LBY77 | 92061.1 | 17.9 | 0.20 | 17 |
| LBY77 | 92061.2 | 18.7 | 0.11 | 22 |
| LBY77 | 92063.6 | 17.6 | 0.25 | 15 |
| LBY54 | 92084.7 | 17.7 | 0.25 | 15 |
| LBY54 | 92087.3 | 17.9 | 0.22 | 17 |
| LBY35 | 92119.2 | 18.0 | 0.18 | 17 |
| LBY29 | 91617.1 | 18.7 | 0.19 | 22 |
| LBY29 | 91617.4 | 18.5 | 0.12 | 21 |
| LBY29 | 91619.1 | 17.8 | 0.25 | 16 |
| LBY29 | 91619.5 | 18.9 | 0.09 | 23 |
| LBY174 | 92079.7 | 17.7 | 0.26 | 15 |
| LBY158 | 91647.2 | 17.5 | 0.27 | 14 |
| LBY158 | 91647.5 | 18.4 | 0.13 | 20 |
| LBY158 | 91648.1 | 19.8 | 0.05 | 29 |
| LBY146 | 91593.3 | 20.8 | 0.02 | 36 |
| LBY138 | 92076.1 | 19.8 | 0.05 | 29 |
| LBY117 | 91365.1 | 18.4 | 0.25 | 20 |
| LBY117 | 91366.1 | 18.5 | 0.17 | 21 |
| LBY115 | 92071.2 | 17.6 | 0.25 | 15 |
| LBY112 | 92051.3 | 20.3 | 0.08 | 32 |
| LBY112 | 92052.2 | 17.7 | 0.23 | 16 |
| LBY108 | 91423.4 | 19.4 | 0.06 | 27 |
| LBY103 | 91381.8 | 18.0 | 0.18 | 18 |
| LBY103 | 91381.9 | 18.8 | 0.11 | 22 |
| CONT. | — | 15.3 | — | — |
| LGN26 | 89036.1 | 20.2 | 0.18 | 13 |
| LGN26 | 89037.2 | 20.8 | 0.15 | 16 |
| LGN26 | 89037.3 | 20.4 | L | 14 |
| LGN26 | 89037.4 | 19.1 | 0.05 | 7 |
| CONT. | — | 17.9 | — | — |
| LGN60 | 89176.3 | 23.2 | 0.22 | 13 |
| CONT. | — | 21.3 | — | — |
| LBY91 | 91630.1 | 18.6 | L | 15 |
| LBY91 | 91633.1 | 17.7 | 0.03 | 10 |
| LBY77 | 92062.1 | 17.5 | 0.02 | 8 |
| LBY49 | 92039.4 | 18.2 | L | 12 |
| LBY49 | 92043.1 | 17.3 | 0.04 | 7 |
| LBY49 | 92043.2 | 16.8 | 0.15 | 4 |
| LBY35 | 92122.1 | 17.8 | 0.01 | 10 |
| LBY25 | 91335.2 | 18.6 | L | 15 |
| LBY25 | 91338.2 | 17.4 | 0.03 | 7 |
| LBY25 | 91339.1 | 17.1 | 0.08 | 6 |
| LBY217 | 92363.1 | 18.7 | 0.13 | 16 |
| LBY202 | 92022.2 | 17.7 | 0.12 | 9 |
| LBY193 | 91660.2 | 18.7 | 0.26 | 16 |
| LBY182 | 92396.2 | 17.3 | 0.03 | 7 |
| LBY182 | 92398.2 | 17.0 | 0.19 | 5 |
| LBY182 | 92398.3 | 16.9 | 0.17 | 5 |
| LBY118 | 91434.4 | 17.1 | 0.30 | 6 |
| CONT. | — | 16.2 | — | — |
| LGN49 | 89081.3 | 22.1 | L | 14 |
| LGN49 | 89081.6 | 20.8 | 0.25 | 7 |
| CONT. | — | 19.5 | — | — |
| LGN26 | 89036.1 | 17.9 | L | 7 |
| LGN26 | 89036.4 | 17.9 | L | 6 |
| LGN26 | 89037.2 | 19.5 | 0.02 | 16 |
| LGN26 | 89037.3 | 20.6 | L | 23 |
| LGN26 | 89037.4 | 17.7 | 0.21 | 5 |
| CONT. | — | 16.8 | — | — |

Table 246. "CONT."—Control; "Ave."—Average; "% Incr." = % increment; "p-val."—p-value, L—p < 0.01.

TABLE 247

Genes showing improved plant performance at Normal growth conditions under regulation of At6669 promoter

| Gene Name | Event # | Harvest Index | | |
|---|---|---|---|---|
| | | Ave. | P-Val. | % Incr. |
| LBY87 | 92256.1 | 0.237 | 0.20 | 14 |
| LBY225 | 91605.3 | 0.241 | 0.06 | 16 |
| LBY225 | 91607.3 | 0.245 | 0.05 | 18 |
| LBY212 | 92026.4 | 0.246 | 0.29 | 19 |
| LBY202 | 92022.1 | 0.224 | 0.29 | 8 |
| LBY193 | 91660.2 | 0.254 | 0.06 | 23 |
| LBY193 | 91662.1 | 0.229 | 0.30 | 10 |
| LBY135 | 92322.1 | 0.243 | 0.05 | 17 |
| CONT. | — | 0.207 | — | — |
| LGN5 | 88198.1 | 0.268 | L | 10 |
| LGN5 | 88198.4 | 0.278 | 0.27 | 14 |
| CONT. | — | 0.260 | — | — |
| LGN60 | 89175.1 | 0.269 | 0.08 | 26 |
| LGN60 | 89175.2 | 0.294 | L | 38 |
| LGN60 | 89176.1 | 0.260 | 0.02 | 22 |
| CONT. | — | 0.213 | — | — |
| LGN54 | 88206.1 | 0.268 | 0.22 | 12 |
| LGN54 | 88206.4 | 0.274 | 0.23 | 10 |
| CONT. | — | 0.250 | — | — |
| LGN5 | 88201.1 | 0.277 | 0.06 | 28 |
| CONT. | — | 0.216 | — | — |
| LGN54 | 88206.1 | 0.268 | 0.06 | 15 |
| LGN54 | 88208.2 | 0.264 | 0.15 | 14 |
| CONT. | — | 0.263 | — | — |
| LGN6 | 89173.1 | 0.238 | 0.14 | 27 |
| CONT. | — | 0.188 | — | — |
| LBY63 | 91326.1 | 0.222 | 0.02 | 18 |
| LBY51 | 90981.4 | 0.202 | 0.28 | 7 |
| LBY48 | 90970.2 | 0.218 | 0.03 | 16 |
| LBY224 | 91527.4 | 0.214 | 0.18 | 14 |
| LBY22 | 90961.1 | 0.213 | 0.06 | 13 |
| LBY196 | 91300.1 | 0.212 | 0.18 | 13 |
| LBY188 | 91557.3 | 0.225 | 0.01 | 20 |
| LBY150 | 91642.1 | 0.237 | 0.15 | 26 |
| LBY150 | 91644.2 | 0.220 | 0.14 | 17 |
| LBY134 | 91284.1 | 0.241 | 0.21 | 28 |
| LBY132 | 91279.3 | 0.205 | 0.20 | 9 |
| LBY125 | 91273.2 | 0.211 | 0.23 | 12 |
| LBY125 | 91273.4 | 0.224 | 0.26 | 19 |
| CONT. | — | 0.188 | — | — |
| NUE102 | 90003.5 | 0.262 | 0.25 | 13 |
| NUE102 | 90004.1 | 0.292 | 0.12 | 26 |
| CONT. | — | 0.232 | — | — |
| LBY91 | 91633.2 | 0.252 | 0.15 | 12 |
| LBY91 | 91634.3 | 0.258 | 0.27 | 14 |
| LBY77 | 92062.1 | 0.253 | 0.20 | 12 |
| LBY49 | 92043.1 | 0.270 | 0.03 | 19 |
| LBY29 | 91617.1 | 0.253 | 0.14 | 12 |
| LBY29 | 91619.1 | 0.270 | 0.04 | 19 |
| LBY29 | 91619.5 | 0.268 | 0.10 | 19 |
| LBY23 | 91397.4 | 0.264 | 0.05 | 17 |
| LBY146 | 91590.1 | 0.255 | 0.22 | 13 |
| LBY146 | 91593.3 | 0.256 | 0.15 | 13 |
| LBY112 | 92053.2 | 0.270 | 0.04 | 19 |
| CONT. | — | 0.226 | — | — |
| LGN2 | 89029.2 | 0.257 | 0.10 | 16 |
| CONT. | — | 0.221 | — | — |
| NUE102 | 90004.1 | 0.199 | 0.15 | 18 |
| CONT. | — | 0.168 | — | — |
| LGN60 | 89174.2 | 0.334 | L | 23 |
| LGN60 | 89175.1 | 0.321 | L | 18 |
| LGN60 | 89175.2 | 0.296 | 0.03 | 9 |
| LGN60 | 89176.1 | 0.323 | L | 19 |
| CONT. | — | 0.305 | — | — |
| LBY77 | 92061.2 | 0.221 | 0.15 | 30 |
| LBY77 | 92063.4 | 0.205 | 0.21 | 21 |
| LBY49 | 92043.2 | 0.232 | 0.23 | 37 |
| LBY29 | 91617.1 | 0.206 | 0.18 | 21 |
| LBY29 | 91619.1 | 0.202 | 0.12 | 19 |

TABLE 247-continued

Genes showing improved plant performance at Normal growth conditions under regulation of At6669 promoter

| | | Harvest Index | | |
|---|---|---|---|---|
| Gene Name | Event # | Ave. | P-Val. | % Incr. |
| LBY230 | 91667.1 | 0.193 | 0.24 | 14 |
| LBY225 | 91607.3 | 0.269 | L | 58 |
| LBY225 | 91607.5 | 0.233 | 0.01 | 37 |
| LBY213 | 92032.1 | 0.201 | 0.14 | 18 |
| LBY202 | 92022.1 | 0.205 | 0.21 | 21 |
| LBY182 | 92396.1 | 0.225 | 0.16 | 33 |
| LBY182 | 92398.2 | 0.223 | 0.23 | 31 |
| LBY182 | 92398.3 | 0.204 | 0.11 | 20 |
| CONT. | — | 0.170 | — | — |
| LGN49 | 89079.3 | 0.200 | 0.22 | 7 |
| LGN49 | 89082.1 | 0.208 | 0.13 | 11 |
| CONT. | — | 0.190 | — | — |

Table 247. "CONT."—Control; "Ave."—Average; "% Incr." = % increment; "p-val."—p-value, L—p < 0.01.

Tables 248-254 summarize the observed phenotypes of transgenic plants exogenously expressing the gene constructs using the seed maturation (GH-SM) assays under drought conditions. The evaluation of each gene was performed by testing the performance of different number of events. Event with p-value <0.1 was considered statistically significant.

TABLE 248

Genes showing improved plant performance at Drought growth conditions under regulation of At6669 promoter

| | | Dry Weight [mg] | | | Flowering | | | Inflorescence Emergence | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LBY83 | 91330.2 | 1126.9 | 0.26 | 6 | — | — | — | 40.2 | 0.06 | −2 |
| LBY83 | 91330.3 | — | — | — | — | — | — | 39.9 | 0.19 | −3 |
| LBY82 | 91184.3 | 1192.0 | 0.21 | 12 | — | — | — | — | — | — |
| LBY51 | 90984.2 | 1136.0 | 0.08 | 7 | — | — | — | — | — | — |
| LBY224 | 91527.4 | — | — | — | — | — | — | 40.3 | 0.24 | −2 |
| LBY224 | 91529.2 | 1103.8 | 0.17 | 4 | — | — | — | — | — | — |
| LBY22 | 90961.1 | 1126.2 | L | 6 | — | — | — | — | — | — |
| LBY22 | 90961.2 | 1252.1 | L | 18 | — | — | — | — | — | — |
| LBY196 | 91300.1 | 1101.9 | 0.07 | 4 | 47.8 | 0.29 | −1 | 40.1 | 0.20 | −2 |
| LBY196 | 91303.2 | 1162.1 | 0.28 | 9 | — | — | — | — | — | — |
| LBY196 | 91304.2 | 1181.0 | 0.06 | 11 | — | — | — | — | — | — |
| LBY188 | 91557.3 | 1142.5 | 0.18 | 8 | — | — | — | — | — | — |
| LBY150 | 91644.3 | 1142.1 | 0.28 | 8 | — | — | — | — | — | — |
| LBY134 | 91281.5 | — | — | — | — | — | — | 39.9 | 0.02 | −2 |
| LBY134 | 91282.1 | 1225.0 | 0.11 | 15 | — | — | — | — | — | — |
| LBY133 | 91139.1 | — | — | — | — | — | — | 40.2 | 0.09 | −2 |
| LBY133 | 91139.2 | 1092.5 | 0.11 | 3 | — | — | — | — | — | — |
| LBY132 | 91279.3 | 1106.9 | 0.11 | 4 | — | — | — | — | — | — |
| LBY102 | 91262.1 | 1142.5 | L | 8 | — | — | — | — | — | — |
| LBY102 | 91264.1 | — | — | — | 46.8 | L | −3 | 39.9 | 0.19 | −3 |
| CONT. | — | 1061.5 | — | — | 48.2 | — | — | 40.9 | — | — |
| LBY79 | 92221.2 | — | — | — | 23.8 | L | −6 | 19.1 | 0.01 | −3 |
| LBY79 | 92221.6 | — | — | — | — | — | — | 19.2 | 0.15 | −3 |
| LBY79 | 92223.3 | — | — | — | — | — | — | 19.3 | 0.09 | −2 |
| LBY72 | 92764.1 | — | — | — | — | — | — | 19.2 | 0.15 | −3 |
| LBY72 | 92765.1 | — | — | — | 24.4 | 0.05 | −4 | 19.1 | 0.01 | −3 |
| LBY72 | 92766.2 | — | — | — | 24.6 | 0.01 | −3 | 19.1 | 0.01 | −3 |
| LBY32 | 92830.1 | — | — | — | 24.7 | 0.23 | −3 | 19.0 | L | −4 |
| LBY32 | 92830.3 | — | — | — | 24.3 | L | −4 | 19.1 | 0.01 | −3 |
| LBY32 | 92833.2 | — | — | — | 24.2 | L | −4 | 19.2 | 0.09 | −3 |
| LBY26 | 92484.4 | — | — | — | 24.2 | L | −5 | 19.0 | L | −4 |
| LBY26 | 92484.5 | — | — | — | — | — | — | 19.2 | 0.09 | −3 |
| LBY233 | 92474.3 | — | — | — | 24.1 | L | −5 | 19.0 | L | −4 |
| LBY233 | 92477.2 | — | — | — | 24.8 | 0.14 | −2 | — | — | — |
| LBY233 | 92477.3 | — | — | — | 24.6 | 0.01 | −3 | 19.3 | 0.09 | −2 |
| LBY214 | 92760.3 | — | — | — | 24.1 | L | −5 | 19.0 | L | −4 |
| LBY210 | 92845.2 | — | — | — | 25.0 | 0.17 | −1 | 19.2 | 0.09 | −3 |
| LBY210 | 92845.3 | — | — | — | 24.8 | 0.17 | −2 | 19.2 | 0.26 | −2 |
| LBY210 | 92845.4 | — | — | — | 24.6 | 0.01 | −3 | 19.2 | 0.06 | −2 |
| LBY210 | 92846.1 | — | — | — | — | — | — | 19.2 | 0.06 | −2 |
| LBY204 | 92826.1 | — | — | — | 24.6 | 0.01 | −3 | — | — | — |
| LBY204 | 92827.1 | — | — | — | 24.8 | 0.14 | −2 | 19.1 | 0.01 | −3 |
| LBY204 | 92828.1 | — | — | — | 24.5 | 0.01 | −3 | 19.2 | 0.06 | −2 |
| LBY204 | 92828.3 | — | — | — | 25.0 | 0.17 | −1 | — | — | — |
| LBY196 | 91303.2 | — | — | — | 24.1 | L | −5 | 19.0 | L | −4 |
| LBY187 | 92809.2 | — | — | — | — | — | — | 19.2 | 0.09 | −3 |

TABLE 248-continued

Genes showing improved plant performance at Drought growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LBY187 | 92812.3 | — | — | — | 24.6 | 0.01 | −3 | 19.3 | 0.09 | −2 |
| LBY187 | 92813.2 | — | — | — | 25.0 | 0.17 | −1 | 19.0 | L | −4 |
| LBY154 | 92432.3 | — | — | — | — | — | — | 19.0 | L | −4 |
| LBY137 | 92751.2 | — | — | — | 24.6 | 0.02 | −3 | 19.2 | 0.02 | −3 |
| LBY126 | 92834.3 | — | — | — | 24.4 | L | −4 | 19.0 | L | −4 |
| LBY126 | 92837.3 | — | — | — | 25.0 | 0.17 | −1 | 19.1 | 0.01 | −3 |
| LBY126 | 92838.1 | — | — | — | 24.7 | 0.23 | −3 | — | — | — |
| LBY120 | 91211.2 | — | — | — | — | — | — | 19.1 | 0.02 | −3 |
| LBY120 | 91214.1 | — | — | — | 24.6 | 0.28 | −3 | 19.0 | L | −4 |
| LBY107 | 92284.1 | — | — | — | — | — | — | 19.2 | 0.09 | −3 |
| LBY107 | 92284.2 | — | — | — | 24.7 | 0.23 | −3 | 19.1 | 0.01 | −3 |
| CONT. | — | — | — | — | 25.4 | — | — | 19.7 | — | — |
| LBY96 | 92428.3 | 1027.5 | 0.14 | 11 | — | — | — | — | — | — |
| LBY89 | 92259.1 | 1135.0 | 0.09 | 23 | 37.0 | 0.02 | −1 | — | — | — |
| LBY87 | 92257.3 | 1034.4 | 0.09 | 12 | — | — | — | — | — | — |
| LBY55 | 92422.6 | 1055.6 | 0.15 | 14 | — | — | — | — | — | — |
| LBY30 | 92324.3 | 1052.5 | 0.26 | 14 | — | — | — | — | — | — |
| LBY30 | 92324.4 | — | — | — | 35.6 | L | −5 | 28.6 | 0.16 | −4 |
| LBY30 | 92326.1 | — | — | — | 35.7 | 0.07 | −5 | — | — | — |
| LBY30 | 92326.2 | 1171.7 | 0.05 | 26 | — | — | — | — | — | — |
| LBY225 | 91607.5 | — | — | — | 35.7 | L | −5 | — | — | — |
| LBY225 | 91607.6 | — | — | — | 36.0 | L | −4 | 28.2 | L | −5 |
| LBY213 | 92032.1 | 1023.7 | 0.01 | 11 | — | — | — | — | — | — |
| LBY213 | 92033.3 | 958.1 | 0.28 | 3 | 36.8 | 0.09 | −2 | 28.7 | 0.11 | −3 |
| LBY212 | 92024.3 | 990.6 | 0.15 | 7 | 34.6 | 0.18 | −8 | 28.5 | 0.19 | −4 |
| LBY212 | 92026.4 | — | — | — | 37.0 | 0.02 | −1 | — | — | — |
| LBY212 | 92028.3 | 1088.8 | L | 18 | 37.2 | 0.16 | −1 | — | — | — |
| LBY202 | 92019.2 | — | — | — | 36.1 | 0.20 | −4 | — | — | — |
| LBY202 | 92021.1 | — | — | — | 36.0 | L | −4 | — | — | — |
| LBY202 | 92022.2 | 1128.8 | 0.07 | 22 | 37.0 | 0.02 | −1 | 28.8 | 0.07 | −3 |
| LBY193 | 91660.2 | 1047.5 | 0.22 | 13 | 36.5 | 0.28 | −3 | — | — | — |
| LBY193 | 91662.1 | — | — | — | 36.8 | 0.09 | −2 | 28.2 | L | −5 |
| LBY193 | 91664.2 | 998.1 | 0.24 | 8 | — | — | — | — | — | — |
| LBY193 | 91664.5 | 1026.9 | L | 11 | 37.1 | 0.18 | −1 | — | — | — |
| LBY182 | 92396.1 | — | — | — | 37.1 | 0.18 | −1 | — | — | — |
| LBY182 | 92396.2 | 1061.9 | 0.20 | 15 | — | — | — | — | — | — |
| LBY182 | 92396.4 | — | — | — | — | — | — | 28.8 | 0.07 | −3 |
| LBY174 | 92079.1 | 1062.5 | 0.16 | 15 | — | — | — | 28.6 | 0.15 | −4 |
| LBY174 | 92079.7 | — | — | — | 37.3 | 0.23 | −1 | — | — | — |
| LBY174 | 92079.8 | 1035.6 | 0.11 | 12 | — | — | — | — | — | — |
| LBY174 | 92081.1 | 1024.4 | 0.20 | 11 | — | — | — | — | — | — |
| LBY158 | 91647.3 | — | — | — | 36.9 | 0.03 | −2 | — | — | — |
| LBY154 | 92433.4 | — | — | — | 35.6 | L | −5 | 28.4 | 0.22 | −4 |
| LBY154 | 92433.5 | — | — | — | 36.3 | 0.10 | −3 | — | — | — |
| LBY146 | 91590.2 | 960.0 | 0.28 | 4 | 34.8 | 0.16 | −7 | 28.0 | L | −6 |
| LBY146 | 91590.4 | 1020.6 | 0.02 | 10 | 35.5 | 0.01 | −5 | 28.1 | L | −5 |
| LBY146 | 91593.3 | — | — | — | 35.0 | 0.11 | −7 | 28.5 | 0.01 | −4 |
| LBY146 | 91594.1 | — | — | — | 36.9 | 0.03 | −2 | — | — | — |
| LBY139 | 92241.2 | 1013.1 | 0.28 | 9 | 35.1 | L | −6 | 27.5 | L | −7 |
| LBY135 | 92321.1 | 982.1 | 0.10 | 6 | — | — | — | — | — | — |
| LBY135 | 92321.6 | — | — | — | 35.8 | 0.03 | −5 | — | — | — |
| LBY135 | 92322.1 | — | — | — | 36.2 | 0.15 | −3 | 28.3 | L | −4 |
| LBY113 | 92234.2 | — | — | — | 37.3 | 0.23 | −1 | — | — | — |
| LBY113 | 92234.5 | — | — | — | 36.8 | 0.09 | −2 | — | — | — |
| LBY113 | 92234.6 | — | — | — | 37.2 | 0.16 | −1 | — | — | — |
| CONT. | — | 926.5 | — | — | 37.5 | — | — | 29.7 | — | — |
| LBY91 | 91633.1 | — | — | — | 35.5 | 0.27 | −5 | — | — | — |
| LBY91 | 91634.2 | — | — | — | 36.5 | 0.13 | −3 | 28.3 | 0.03 | −5 |
| LBY77 | 92062.1 | 1136.9 | 0.27 | 13 | 36.5 | 0.11 | −2 | — | — | — |
| LBY54 | 92084.4 | 1104.6 | 0.12 | 9 | 35.9 | 0.05 | −4 | 29.1 | 0.14 | −2 |
| LBY54 | 92084.7 | 1176.6 | 0.09 | 17 | — | — | — | — | — | — |
| LBY54 | 92084.8 | 1045.0 | 0.21 | 3 | — | — | — | — | — | — |
| LBY54 | 92086.1 | — | — | — | 36.4 | 0.08 | −3 | 29.1 | 0.14 | −2 |
| LBY49 | 92039.4 | 1155.0 | L | 14 | 36.5 | 0.11 | −2 | 29.4 | 0.29 | −2 |
| LBY49 | 92041.1 | 1072.5 | 0.16 | 6 | — | — | — | — | — | — |
| LBY35 | 92119.1 | 1091.2 | 0.29 | 8 | — | — | — | — | — | — |
| LBY29 | 91619.1 | 1080.6 | 0.01 | 7 | 36.4 | 0.08 | −3 | 29.1 | 0.11 | −2 |
| LBY29 | 91619.2 | 1038.1 | 0.25 | 3 | 36.2 | 0.20 | −3 | — | — | — |
| LBY25 | 91336.1 | 1086.9 | 0.06 | 8 | — | — | — | — | — | — |
| LBY25 | 91338.2 | — | — | — | 36.6 | 0.15 | −2 | — | — | — |
| LBY230 | 91665.1 | 1049.4 | 0.10 | 4 | — | — | — | 29.2 | 0.26 | −2 |

TABLE 248-continued

Genes showing improved plant performance at Drought growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LBY230 | 91667.2 | — | — | — | 36.5 | 0.11 | −2 | — | — | — |
| LBY230 | 91669.2 | — | — | — | 36.6 | 0.26 | −2 | — | — | — |
| LBY230 | 91669.3 | — | — | — | 35.9 | 0.02 | −4 | 28.3 | 0.22 | −5 |
| LBY23 | 91396.3 | — | — | — | 36.2 | 0.20 | −3 | — | — | — |
| LBY23 | 91397.4 | 1103.8 | L | 9 | 36.6 | 0.15 | −2 | — | — | — |
| LBY23 | 91398.2 | — | — | — | 36.8 | 0.27 | −2 | — | — | — |
| LBY225 | 91605.3 | — | — | — | 35.9 | 0.05 | −4 | 28.4 | 0.29 | −5 |
| LBY225 | 91607.3 | — | — | — | 36.6 | 0.15 | −2 | — | — | — |
| LBY225 | 91607.6 | — | — | — | 36.1 | 0.04 | −3 | 28.6 | 0.27 | −4 |
| LBY217 | 92363.1 | 1160.3 | L | 15 | 36.5 | 0.29 | −3 | — | — | — |
| LBY213 | 92033.1 | 1095.0 | 0.17 | 8 | 36.8 | 0.27 | −2 | — | — | — |
| LBY213 | 92033.3 | 1131.2 | 0.15 | 12 | 35.9 | 0.05 | −4 | — | — | — |
| LBY212 | 92024.3 | 1050.6 | 0.08 | 4 | — | — | — | — | — | — |
| LBY202 | 92019.2 | 1085.6 | L | 8 | — | — | — | — | — | — |
| LBY202 | 92021.1 | 1052.5 | 0.29 | 4 | — | — | — | — | — | — |
| LBY202 | 92022.2 | 1215.0 | L | 20 | 36.2 | 0.17 | −3 | 29.1 | 0.29 | −3 |
| LBY193 | 91660.2 | 1080.0 | 0.01 | 7 | — | — | — | — | — | — |
| LBY193 | 91662.1 | 1092.6 | 0.14 | 8 | — | — | — | — | — | — |
| LBY193 | 91664.5 | 1146.9 | L | 14 | 36.6 | 0.15 | −2 | — | — | — |
| LBY182 | 92396.1 | 1035.6 | 0.24 | 3 | 35.4 | 0.18 | −5 | 28.2 | 0.14 | −6 |
| LBY182 | 92396.2 | 1065.0 | 0.04 | 5 | — | — | — | — | — | — |
| LBY182 | 92398.2 | 1081.9 | 0.19 | 7 | 35.9 | 0.05 | −4 | 28.3 | 0.03 | −5 |
| LBY136 | 91442.1 | 1048.8 | 0.12 | 4 | — | — | — | — | — | — |
| LBY136 | 91442.2 | 1068.1 | 0.02 | 6 | — | — | — | — | — | — |
| LBY136 | 91442.6 | — | — | — | 36.7 | 0.20 | −2 | — | — | — |
| LBY136 | 91442.8 | 1098.8 | 0.02 | 9 | 35.8 | 0.02 | −4 | 28.8 | 0.05 | −3 |
| LBY136 | 91442.9 | — | — | — | 36.6 | 0.15 | −2 | — | — | — |
| LBY118 | 91434.4 | 1111.9 | L | 10 | — | — | — | — | — | — |
| CONT. | — | 1009.8 | — | — | 37.4 | — | — | 29.8 | — | — |
| LBY97 | 92038.2 | — | — | — | 28.4 | 0.05 | −4 | — | — | — |
| LBY87 | 92256.1 | — | — | — | 28.2 | 0.02 | −4 | 21.2 | L | −6 |
| LBY81 | 92009.1 | — | — | — | 28.3 | 0.07 | −4 | — | — | — |
| LBY81 | 92013.2 | — | — | — | 28.1 | L | −5 | 21.3 | 0.05 | −5 |
| LBY25 | 91338.2 | — | — | — | 28.8 | 0.18 | −2 | 22.0 | 0.18 | −2 |
| LBY230 | 91669.2 | — | — | — | 29.0 | 0.28 | −1 | — | — | — |
| LBY217 | 92362.2 | — | — | — | 28.2 | 0.02 | −4 | 21.5 | 0.23 | −5 |
| LBY138 | 92078.1 | — | — | — | 28.1 | 0.02 | −5 | 21.5 | 0.02 | −5 |
| LBY138 | 92078.4 | — | — | — | 28.6 | 0.23 | −3 | 21.4 | 0.03 | −5 |
| LBY136 | 91442.8 | — | — | — | 28.5 | 0.04 | −3 | 21.1 | L | −6 |
| LBY135 | 92322.1 | — | — | — | — | — | — | 21.8 | 0.12 | −3 |
| LBY120 | 91212.1 | — | — | — | — | — | — | 21.8 | 0.12 | −3 |
| LBY120 | 91214.1 | — | — | — | 28.7 | 0.19 | −3 | 21.7 | 0.14 | −4 |
| LBY118 | 91432.3 | — | — | — | 28.2 | 0.04 | −4 | 21.2 | L | −6 |
| LBY117 | 91366.1 | — | — | — | 28.3 | 0.07 | −4 | 21.5 | 0.23 | −5 |
| LBY117 | 91366.3 | — | — | — | 26.6 | 0.01 | −10 | 21.0 | L | −7 |
| LBY117 | 91367.1 | — | — | — | 28.3 | 0.07 | −4 | — | — | — |
| LBY115 | 92073.3 | — | — | — | 28.6 | 0.06 | −3 | — | — | — |
| LBY112 | 92051.1 | — | — | — | 28.1 | 0.01 | −4 | 21.4 | 0.03 | −5 |
| LBY112 | 92051.3 | — | — | — | 28.5 | 0.04 | −3 | 21.8 | 0.12 | −3 |
| LBY108 | 91422.2 | — | — | — | 28.2 | 0.02 | −4 | 21.8 | 0.12 | −3 |
| LBY108 | 91423.1 | — | — | — | 27.9 | L | −5 | 21.0 | L | −7 |
| LBY108 | 91423.4 | — | — | — | 28.2 | 0.02 | −4 | 21.6 | 0.20 | −4 |
| LBY104 | 91267.4 | — | — | — | 28.7 | 0.20 | −3 | — | — | — |
| LBY103 | 91381.11 | — | — | — | 28.3 | 0.02 | −4 | 21.3 | 0.01 | −5 |
| LBY103 | 91381.9 | — | — | — | 27.9 | 0.02 | −5 | 21.3 | 0.05 | −5 |
| CONT. | — | — | — | — | 29.4 | — | — | 22.5 | — | — |
| LBY96 | 92428.4 | — | — | — | 24.6 | 0.18 | −6 | 18.4 | L | −8 |
| LBY79 | 92221.2 | — | — | — | 24.9 | 0.09 | −5 | — | — | — |
| LBY79 | 92223.2 | — | — | — | 25.6 | 0.08 | −2 | 19.6 | 0.14 | −2 |
| LBY79 | 92223.3 | — | — | — | 25.5 | 0.06 | −3 | — | — | — |
| LBY72 | 92764.1 | — | — | — | 25.3 | 0.14 | −3 | — | — | — |
| LBY36 | 92526.1 | — | — | — | 24.3 | 0.28 | −7 | 18.6 | 0.12 | −7 |
| LBY36 | 92526.2 | — | — | — | 25.6 | 0.08 | −2 | — | — | — |
| LBY30 | 92326.1 | — | — | — | 25.1 | 0.02 | −4 | — | — | — |
| LBY233 | 92474.3 | — | — | — | — | — | — | 18.6 | 0.12 | −7 |
| LBY233 | 92477.3 | — | — | — | 25.1 | L | −4 | 19.3 | 0.18 | −4 |
| LBY214 | 92760.3 | — | — | — | 25.3 | 0.14 | −3 | — | — | — |
| LBY210 | 92845.2 | — | — | — | 25.0 | L | −4 | — | — | — |
| LBY204 | 92827.1 | — | — | — | — | — | — | 19.3 | 0.18 | −4 |
| LBY204 | 92828.1 | — | — | — | 25.2 | L | −4 | — | — | — |
| LBY187 | 92813.2 | — | — | — | 25.1 | 0.06 | −4 | — | — | — |

TABLE 248-continued

Genes showing improved plant performance at Drought growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LBY165 | 92678.1 | — | — | — | 25.1 | L | −4 | 19.1 | 0.28 | −5 |
| LBY165 | 92678.3 | — | — | — | 25.0 | L | −4 | 18.7 | 0.07 | −7 |
| LBY137 | 92751.5 | — | — | — | 24.7 | 0.04 | −5 | 18.5 | L | −8 |
| LBY127 | 92744.2 | — | — | — | — | — | — | 19.2 | 0.05 | −4 |
| LBY127 | 92748.2 | — | — | — | — | — | — | 19.3 | 0.18 | −4 |
| LBY126 | 92834.3 | — | — | — | 25.1 | L | −4 | — | — | — |
| LBY126 | 92838.1 | — | — | — | 24.9 | L | −5 | 18.5 | 0.15 | −8 |
| LBY110 | 91176.1 | — | — | — | 25.2 | 0.01 | −3 | — | — | — |
| LBY107 | 92284.3 | — | — | — | 25.5 | 0.06 | −3 | — | — | — |
| LBY107 | 92285.2 | — | — | — | — | — | — | 18.7 | 0.07 | −7 |
| CONT. | — | — | — | — | 26.1 | — | — | 20.0 | — | — |
| LBY91 | 91630.1 | 1156.9 | 0.19 | 16 | 35.8 | 0.19 | −2 | 28.3 | 0.18 | −2 |
| LBY81 | 92009.1 | — | — | — | — | — | — | 28.2 | 0.05 | −3 |
| LBY81 | 92013.2 | 1096.2 | 0.03 | 10 | 35.8 | 0.18 | −2 | 27.6 | 0.18 | −5 |
| LBY54 | 92084.7 | 1066.2 | 0.12 | 7 | — | — | — | — | — | — |
| LBY54 | 92084.8 | 1105.0 | 0.29 | 11 | 34.8 | 0.21 | −5 | 28.1 | 0.03 | −3 |
| LBY54 | 92087.3 | — | — | — | — | — | — | 28.4 | 0.16 | −2 |
| LBY49 | 92039.4 | 1093.8 | 0.20 | 10 | 35.1 | 0.09 | −4 | 28.0 | 0.02 | −3 |
| LBY49 | 92043.1 | — | — | — | 35.3 | 0.03 | −3 | 28.3 | 0.06 | −3 |
| LBY49 | 92043.2 | 1070.0 | 0.10 | 8 | — | — | — | — | — | — |
| LBY35 | 92122.1 | 1069.4 | 0.26 | 8 | — | — | — | — | — | — |
| LBY29 | 91619.1 | — | — | — | — | — | — | 28.3 | 0.18 | −2 |
| LBY29 | 91619.2 | — | — | — | 35.6 | 0.22 | −2 | 28.0 | 0.02 | −3 |
| LBY29 | 91619.5 | 1073.1 | 0.16 | 8 | — | — | — | — | — | — |
| LBY23 | 91397.2 | — | — | — | 35.1 | 0.02 | −4 | 28.6 | 0.24 | −1 |
| LBY174 | 92079.7 | 1065.0 | 0.12 | 7 | — | — | — | — | — | — |
| LBY146 | 91590.2 | — | — | — | 33.9 | 0.17 | −7 | 27.6 | 0.18 | −5 |
| LBY146 | 91590.4 | — | — | — | 34.2 | 0.15 | −6 | 27.8 | 0.01 | −4 |
| LBY146 | 91593.3 | — | — | — | — | — | — | 27.8 | 0.01 | −4 |
| LBY146 | 91594.1 | 1053.1 | 0.20 | 6 | — | — | — | — | — | — |
| LBY138 | 92076.2 | 1042.5 | 0.24 | 5 | — | — | — | — | — | — |
| LBY117 | 91366.1 | — | — | — | — | — | — | 28.3 | 0.18 | −2 |
| LBY117 | 91366.3 | 1127.5 | 0.23 | 14 | 31.9 | 0.08 | −12 | 25.0 | 0.13 | −14 |
| LBY115 | 92071.2 | — | — | — | — | — | — | 28.5 | 0.16 | −2 |
| LBY112 | 92053.2 | — | — | — | 35.8 | 0.19 | −2 | 28.5 | 0.16 | −2 |
| LBY112 | 92053.4 | — | — | — | 35.3 | 0.03 | −3 | 28.1 | 0.03 | −3 |
| LBY108 | 91423.1 | — | — | — | 33.0 | L | −10 | 27.7 | 0.04 | −5 |
| LBY108 | 91423.4 | 1091.9 | 0.29 | 10 | — | — | — | — | — | — |
| LBY108 | 91423.6 | — | — | — | 36.0 | 0.30 | −1 | — | — | — |
| LBY104 | 91269.2 | — | — | — | 35.5 | 0.06 | −3 | 28.2 | 0.21 | −3 |
| LBY103 | 91381.9 | — | — | — | 35.5 | 0.24 | −3 | — | — | — |
| CONT. | — | 993.3 | — | — | 36.5 | — | — | 29.0 | — | — |

Table 248. "CONT.—"Control; "Ave."—Average; "% Incr." = % increment; "p-val."-p-value, L-p < 0.01.

TABLE 249

Genes showing improved plant performance at Drought growth conditions under regulation of At6669 promoter

| Gene Name | Event # | Leaf Blade Area [cm$^2$] | | | Leaf Number | | | Plot Coverage [cm$^2$] | | |
|---|---|---|---|---|---|---|---|---|---|---|
| | | Ave. | P-Val. | % Incr. | Ave. | P-Val. | % Incr. | Ave. | P-Val. | % Incr. |
| LBY83 | 91330.2 | 0.741 | L | 21 | — | — | — | 44.5 | L | 22 |
| LBY83 | 91330.3 | 0.704 | 0.05 | 15 | — | — | — | 42.1 | 0.25 | 16 |
| LBY63 | 91325.4 | — | — | — | 10.3 | L | 5 | — | — | — |
| LBY63 | 91326.1 | — | — | — | 10.2 | 0.27 | 3 | — | — | — |
| LBY51 | 90981.1 | — | — | — | — | — | — | 39.1 | 0.29 | 8 |
| LBY48 | 90968.1 | 0.658 | 0.09 | 7 | 10.1 | 0.20 | 3 | 40.0 | 0.07 | 10 |
| LBY224 | 91527.4 | 0.666 | 0.17 | 9 | — | — | — | 40.9 | 0.04 | 13 |
| LBY224 | 91529.1 | 0.672 | 0.08 | 10 | 10.8 | 0.11 | 9 | 42.7 | L | 18 |
| LBY224 | 91529.2 | 0.679 | 0.15 | 11 | — | — | — | 39.6 | 0.15 | 9 |
| LBY196 | 91300.1 | 0.688 | 0.17 | 12 | — | — | — | 44.7 | 0.04 | 23 |
| LBY196 | 91303.2 | 0.726 | 0.26 | 19 | — | — | — | 43.8 | 0.26 | 21 |
| LBY196 | 91304.3 | 0.685 | 0.01 | 12 | 10.4 | 0.04 | 5 | 40.6 | 0.04 | 12 |
| LBY150 | 91644.3 | 0.714 | 0.25 | 16 | — | — | — | — | — | — |

TABLE 249-continued

Genes showing improved plant performance at Drought growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LBY134 | 91282.1 | 0.696 | 0.27 | 14 | — | — | — | — | — | — |
| LBY133 | 91139.4 | — | — | — | 10.3 | 0.17 | 5 | — | — | — |
| LBY132 | 91277.1 | 0.760 | 0.12 | 24 | 10.2 | 0.09 | 4 | 50.1 | 0.24 | 38 |
| LBY125 | 91273.3 | 0.763 | L | 24 | — | — | — | 45.8 | L | 26 |
| LBY102 | 91262.1 | — | — | — | 10.5 | 0.02 | 7 | — | — | — |
| CONT. | — | 0.613 | — | — | 9.85 | — | — | 36.3 | — | — |
| LBY79 | 92221.2 | 1.33 | L | 12 | 12.4 | 0.17 | 18 | 82.7 | 0.10 | 23 |
| LBY79 | 92221.3 | 1.37 | 0.20 | 16 | 11.1 | L | 5 | 79.5 | 0.06 | 18 |
| LBY79 | 92221.6 | 1.25 | 0.27 | 5 | — | — | — | — | — | — |
| LBY72 | 92764.1 | — | — | — | 11.2 | 0.29 | 6 | — | — | — |
| LBY72 | 92765.1 | 1.42 | 0.10 | 20 | 13.2 | 0.13 | 25 | 93.0 | 0.11 | 38 |
| LBY72 | 92765.3 | — | — | — | 11.1 | 0.04 | 5 | — | — | — |
| LBY72 | 92766.2 | 1.30 | 0.01 | 9 | 11.8 | L | 12 | 78.5 | L | 17 |
| LBY72 | 92766.4 | 1.28 | 0.03 | 8 | 11.8 | 0.07 | 11 | 74.1 | 0.03 | 10 |
| LBY36 | 92526.1 | — | — | — | 12.6 | 0.20 | 19 | — | — | — |
| LBY32 | 92830.1 | 1.49 | 0.25 | 26 | 11.4 | 0.12 | 8 | 88.0 | 0.13 | 31 |
| LBY32 | 92830.3 | — | — | — | 12.6 | L | 19 | 85.6 | 0.29 | 27 |
| LBY32 | 92830.4 | — | — | — | 11.4 | 0.01 | 8 | — | — | — |
| LBY26 | 92484.4 | 1.31 | L | 11 | 12.1 | L | 15 | 83.7 | L | 24 |
| LBY26 | 92484.5 | 1.31 | 0.27 | 10 | — | — | — | 74.8 | 0.17 | 11 |
| LBY26 | 92485.1 | 1.36 | 0.17 | 14 | 11.7 | L | 10 | 82.9 | 0.07 | 23 |
| LBY26 | 92488.1 | — | — | — | 12.1 | 0.01 | 14 | — | — | — |
| LBY233 | 92474.3 | — | — | — | 11.5 | L | 9 | — | — | — |
| LBY233 | 92477.2 | — | — | — | 11.8 | 0.30 | 11 | — | — | — |
| LBY233 | 92478.3 | — | — | — | 11.6 | 0.18 | 10 | 79.1 | 0.13 | 18 |
| LBY214 | 92760.1 | — | — | — | 11.2 | L | 6 | — | — | — |
| LBY214 | 92760.3 | — | — | — | 11.8 | 0.19 | 12 | — | — | — |
| LBY214 | 92760.4 | — | — | — | 11.6 | 0.24 | 9 | — | — | — |
| LBY214 | 92761.1 | — | — | — | 10.8 | 0.19 | 2 | — | — | — |
| LBY214 | 92763.2 | — | — | — | 11.2 | L | 6 | — | — | — |
| LBY210 | 92845.2 | 1.40 | L | 18 | 11.6 | L | 10 | 82.9 | 0.12 | 23 |
| LBY210 | 92845.3 | — | — | — | 11.5 | 0.15 | 8 | — | — | — |
| LBY210 | 92846.1 | — | — | — | 11.2 | 0.16 | 6 | 77.5 | 0.21 | 15 |
| LBY210 | 92846.2 | 1.28 | 0.21 | 8 | — | — | — | — | — | — |
| LBY204 | 92825.1 | — | — | — | 11.4 | L | 8 | — | — | — |
| LBY204 | 92826.1 | 1.33 | L | 12 | 12.5 | 0.14 | 18 | 80.8 | 0.03 | 20 |
| LBY204 | 92827.1 | 1.41 | L | 18 | 12.0 | 0.12 | 13 | 87.0 | L | 29 |
| LBY204 | 92828.1 | 1.42 | L | 19 | 12.6 | 0.17 | 19 | 91.7 | L | 36 |
| LBY196 | 91301.3 | — | — | — | 11.1 | 0.02 | 5 | — | — | — |
| LBY196 | 91303.2 | 1.44 | L | 21 | 11.8 | L | 11 | 88.2 | L | 31 |
| LBY187 | 92809.2 | 1.37 | L | 15 | 12.5 | L | 18 | 84.9 | L | 26 |
| LBY187 | 92813.2 | — | — | — | 12.0 | 0.25 | 13 | — | — | — |
| LBY154 | 92433.4 | — | — | — | 11.1 | 0.02 | 5 | — | — | — |
| LBY139 | 92239.1 | — | — | — | 11.3 | 0.07 | 7 | — | — | — |
| LBY137 | 92751.2 | 1.27 | 0.10 | 7 | 11.4 | 0.05 | 8 | 77.6 | 0.14 | 15 |
| LBY137 | 92753.1 | — | — | — | 11.2 | 0.16 | 6 | — | — | — |
| LBY126 | 92834.3 | — | — | — | 11.7 | L | 10 | — | — | — |
| LBY126 | 92837.3 | 1.32 | 0.03 | 11 | 11.4 | 0.27 | 8 | 76.2 | 0.23 | 13 |
| LBY120 | 91211.2 | 1.25 | 0.12 | 5 | 11.6 | L | 9 | 73.0 | 0.09 | 9 |
| LBY120 | 91212.1 | — | — | — | 11.1 | 0.21 | 5 | — | — | — |
| LBY120 | 91214.1 | 1.26 | 0.14 | 6 | — | — | — | 73.7 | 0.06 | 10 |
| LBY113 | 92234.2 | 1.34 | 0.02 | 13 | 11.9 | 0.17 | 13 | 80.8 | L | 20 |
| LBY107 | 92284.1 | — | — | — | 11.2 | 0.29 | 6 | — | — | — |
| LBY107 | 92284.2 | 1.26 | 0.07 | 6 | 10.9 | 0.19 | 3 | — | — | — |
| CONT. | — | 1.19 | — | — | 10.6 | — | — | 67.3 | — | — |
| LBY96 | 92428.4 | 0.851 | 0.19 | 13 | — | — | — | 47.8 | 0.04 | 11 |
| LBY89 | 92259.2 | 0.797 | 0.23 | 6 | — | — | — | 45.8 | 0.28 | 6 |
| LBY89 | 92261.6 | 0.976 | L | 29 | — | — | — | 58.4 | 0.02 | 36 |
| LBY89 | 92263.3 | — | — | — | 10.2 | 0.25 | 5 | — | — | — |
| LBY87 | 92256.1 | — | — | — | 10.1 | 0.19 | 4 | — | — | — |
| LBY87 | 92257.1 | 0.821 | 0.19 | 9 | — | — | — | 48.9 | 0.20 | 14 |
| LBY87 | 92257.3 | 0.933 | 0.02 | 23 | — | — | — | 53.5 | 0.07 | 24 |
| LBY55 | 92419.1 | — | — | — | 10.1 | 0.23 | 3 | — | — | — |
| LBY55 | 92419.2 | — | — | — | 10.1 | 0.23 | 3 | — | — | — |
| LBY55 | 92422.5 | 0.902 | 0.04 | 19 | — | — | — | 49.6 | 0.13 | 15 |
| LBY30 | 92324.2 | 0.817 | 0.20 | 8 | 10.2 | 0.21 | 4 | 47.8 | 0.08 | 11 |
| LBY30 | 92324.3 | — | — | — | 10.2 | 0.10 | 5 | — | — | — |
| LBY30 | 92324.4 | 1.03 | L | 36 | 11.0 | 0.04 | 13 | 67.9 | L | 58 |
| LBY30 | 92326.2 | 0.901 | L | 19 | — | — | — | 52.4 | L | 22 |
| LBY225 | 91605.3 | 0.872 | 0.04 | 15 | 10.2 | 0.21 | 4 | 48.0 | 0.10 | 12 |
| LBY225 | 91607.2 | 0.791 | 0.23 | 5 | 10.6 | 0.28 | 8 | 47.2 | 0.29 | 10 |

TABLE 249-continued

Genes showing improved plant performance at
Drought growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LBY225 | 91607.5 | 0.877 | 0.16 | 16 | — | — | — | — | — | — |
| LBY225 | 91607.6 | 0.804 | 0.21 | 7 | — | — | — | 46.2 | 0.16 | 7 |
| LBY213 | 92030.2 | 0.864 | 0.07 | 14 | — | — | — | — | — | — |
| LBY213 | 92033.1 | 0.934 | L | 24 | 10.6 | 0.01 | 9 | 53.6 | L | 25 |
| LBY213 | 92033.3 | 0.952 | L | 26 | 10.5 | 0.02 | 7 | 56.0 | L | 30 |
| LBY212 | 92024.3 | 0.906 | 0.20 | 20 | — | — | — | 53.2 | 0.27 | 24 |
| LBY212 | 92026.4 | 0.948 | 0.12 | 26 | — | — | — | 51.5 | 0.07 | 20 |
| LBY212 | 92028.3 | — | — | — | 10.1 | 0.14 | 4 | — | — | — |
| LBY202 | 92019.2 | 0.882 | 0.03 | 17 | — | — | — | 51.5 | 0.20 | 20 |
| LBY202 | 92021.1 | 0.893 | 0.17 | 18 | — | — | — | 49.9 | 0.15 | 16 |
| LBY202 | 92022.1 | 0.823 | 0.06 | 9 | — | — | — | 48.8 | 0.25 | 14 |
| LBY193 | 91660.2 | — | — | — | 10.4 | 0.05 | 6 | 48.5 | 0.21 | 13 |
| LBY193 | 91662.1 | 0.869 | 0.25 | 15 | — | — | — | 51.6 | 0.26 | 20 |
| LBY193 | 91664.2 | — | — | — | 10.1 | 0.14 | 4 | — | — | — |
| LBY182 | 92396.1 | — | — | — | 10.1 | 0.19 | 4 | 46.1 | 0.16 | 7 |
| LBY182 | 92396.2 | 0.866 | 0.03 | 15 | — | — | — | — | — | — |
| LBY182 | 92396.4 | 0.790 | 0.27 | 5 | 10.8 | 0.17 | 10 | 47.6 | 0.06 | 11 |
| LBY182 | 92398.3 | — | — | — | 10.1 | 0.14 | 4 | — | — | — |
| LBY174 | 92079.1 | 0.905 | L | 20 | — | — | — | — | — | — |
| LBY174 | 92079.7 | — | — | — | 10.2 | 0.10 | 5 | — | — | — |
| LBY174 | 92079.8 | 0.880 | 0.29 | 17 | 10.2 | 0.21 | 4 | — | — | — |
| LBY158 | 91647.3 | 0.870 | 0.07 | 15 | — | — | — | 49.2 | 0.04 | 14 |
| LBY158 | 91649.1 | 0.833 | 0.10 | 10 | — | — | — | 47.0 | 0.09 | 9 |
| LBY154 | 92433.4 | 1.01 | L | 34 | 10.6 | L | 9 | 54.7 | 0.16 | 27 |
| LBY154 | 92433.5 | — | — | — | 10.7 | 0.24 | 9 | 49.9 | 0.26 | 16 |
| LBY146 | 91590.4 | 0.833 | 0.04 | 10 | — | — | — | — | — | — |
| LBY146 | 91594.1 | 0.825 | 0.05 | 9 | — | — | — | 49.9 | 0.18 | 16 |
| LBY139 | 92239.2 | 0.853 | 0.07 | 13 | 10.4 | 0.17 | 6 | 51.0 | L | 19 |
| LBY139 | 92241.2 | 1.01 | L | 34 | 10.4 | 0.02 | 7 | 60.9 | L | 42 |
| LBY135 | 92321.6 | 1.04 | 0.06 | 38 | 11.1 | L | 13 | 66.7 | 0.08 | 55 |
| LBY135 | 92323.1 | 0.826 | 0.05 | 9 | — | — | — | 47.5 | 0.06 | 10 |
| LBY113 | 92234.1 | 0.872 | 0.10 | 15 | — | — | — | 48.5 | 0.23 | 13 |
| LBY113 | 92234.2 | 0.952 | L | 26 | 10.7 | 0.10 | 10 | 52.6 | 0.28 | 22 |
| LBY113 | 92234.5 | 0.829 | 0.03 | 10 | 10.2 | 0.10 | 4 | 49.0 | 0.02 | 14 |
| LBY113 | 92234.6 | 0.821 | 0.24 | 9 | — | — | — | 47.1 | 0.07 | 9 |
| CONT. | — | 0.755 | — | — | 9.77 | — | — | 43.0 | — | — |
| LBY91 | 91633.1 | 0.918 | 0.29 | 17 | — | — | — | 58.0 | 0.08 | 18 |
| LBY91 | 91634.2 | 0.861 | 0.16 | 10 | — | — | — | 53.8 | 0.18 | 10 |
| LBY77 | 92062.1 | 0.950 | 0.02 | 22 | 11.4 | 0.03 | 7 | 63.2 | L | 29 |
| LBY54 | 92086.1 | 0.942 | 0.08 | 21 | 11.7 | 0.21 | 9 | 63.6 | 0.17 | 30 |
| LBY35 | 92119.1 | 0.827 | 0.28 | 6 | — | — | — | 55.6 | 0.12 | 14 |
| LBY29 | 91619.1 | 0.912 | 0.09 | 17 | — | — | — | 60.6 | 0.12 | 24 |
| LBY29 | 91619.2 | 0.917 | 0.09 | 17 | 11.6 | 0.18 | 9 | 62.1 | 0.08 | 27 |
| LBY25 | 91335.2 | 0.918 | 0.11 | 17 | — | — | — | 60.7 | 0.18 | 24 |
| LBY230 | 91669.3 | 0.938 | 0.08 | 20 | 11.3 | 0.03 | 6 | 64.1 | 0.09 | 31 |
| LBY23 | 91397.3 | 0.956 | 0.16 | 22 | 11.4 | 0.01 | 7 | 64.8 | 0.04 | 32 |
| LBY225 | 91605.3 | 0.944 | L | 21 | 11.6 | 0.25 | 8 | 66.0 | L | 35 |
| LBY225 | 91607.3 | — | — | — | — | — | — | 53.8 | 0.21 | 10 |
| LBY225 | 91607.5 | 0.996 | 0.07 | 27 | 11.9 | 0.07 | 12 | 70.1 | L | 43 |
| LBY217 | 92363.1 | 0.903 | 0.10 | 16 | — | — | — | — | — | — |
| LBY202 | 92022.1 | — | — | — | 11.2 | 0.04 | 5 | 61.5 | 0.28 | 26 |
| LBY202 | 92022.2 | — | — | — | 12.0 | 0.03 | 12 | 60.1 | 0.29 | 23 |
| LBY193 | 91664.5 | 0.827 | 0.27 | 6 | — | — | — | 53.7 | 0.18 | 10 |
| LBY182 | 92396.1 | 0.963 | L | 23 | — | — | — | 63.3 | 0.02 | 29 |
| LBY182 | 92398.2 | 1.02 | L | 30 | 11.4 | 0.03 | 7 | 71.4 | L | 46 |
| LBY136 | 91442.1 | 0.844 | 0.28 | 8 | — | — | — | 57.6 | 0.19 | 18 |
| LBY136 | 91442.6 | 0.925 | L | 18 | — | — | — | — | — | — |
| LBY136 | 91442.8 | 1.02 | L | 30 | 11.4 | 0.05 | 7 | 69.1 | 0.01 | 41 |
| LBY136 | 91442.9 | 0.979 | 0.06 | 25 | 11.4 | 0.13 | 7 | 67.4 | 0.14 | 38 |
| LBY118 | 91434.5 | 0.883 | 0.04 | 13 | 11.4 | 0.03 | 7 | 58.8 | 0.02 | 20 |
| CONT. | — | 0.781 | — | — | 10.7 | — | — | 49.0 | — | — |
| LBY97 | 92034.3 | — | — | — | 10.1 | 0.16 | 4 | — | — | — |
| LBY97 | 92038.2 | 0.941 | 0.13 | 12 | 10.7 | 0.11 | 10 | 58.0 | 0.08 | 23 |
| LBY87 | 92255.1 | — | — | — | 10.2 | 0.16 | 5 | — | — | — |
| LBY87 | 92256.1 | 0.899 | 0.26 | 7 | 10.9 | L | 12 | — | — | — |
| LBY87 | 92258.1 | — | — | — | 10.2 | 0.07 | 6 | — | — | — |
| LBY81 | 92009.1 | 0.939 | 0.08 | 12 | — | — | — | — | — | — |
| LBY81 | 92013.1 | — | — | — | 10.1 | 0.16 | 4 | — | — | — |
| LBY25 | 91335.3 | 0.946 | 0.07 | 12 | 10.2 | 0.20 | 6 | 55.1 | 0.08 | 17 |
| LBY230 | 91665.1 | 0.892 | 0.28 | 6 | — | — | — | 50.3 | 0.29 | 6 |
| LBY230 | 91667.1 | 1.02 | L | 21 | — | — | — | 58.6 | 0.14 | 24 |

TABLE 249-continued

Genes showing improved plant performance at
Drought growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LBY217 | 92359.1 | — | — | — | 10.6 | 0.25 | 9 | — | — | — |
| LBY217 | 92362.2 | 1.13 | L | 35 | 10.6 | 0.07 | 10 | 69.0 | L | 46 |
| LBY138 | 92076.2 | — | — | — | 10.0 | 0.27 | 3 | — | — | — |
| LBY138 | 92078.4 | 0.938 | 0.27 | 11 | — | — | — | 56.4 | 0.24 | 19 |
| LBY136 | 91442.8 | — | — | — | 10.1 | 0.14 | 4 | — | — | — |
| LBY135 | 92321.1 | — | — | — | 10.4 | 0.27 | 7 | — | — | — |
| LBY135 | 92321.6 | 1.00 | L | 19 | 10.1 | 0.27 | 4 | 57.7 | L | 22 |
| LBY135 | 92322.1 | — | — | — | 10.0 | 0.27 | 3 | — | — | — |
| LBY120 | 91212.1 | — | — | — | 10.0 | 0.27 | 3 | — | — | — |
| LBY118 | 91432.3 | 1.13 | L | 34 | 10.9 | 0.28 | 12 | 65.3 | 0.02 | 38 |
| LBY118 | 91434.5 | — | — | — | 10.0 | 0.27 | 3 | 51.2 | 0.20 | 8 |
| LBY112 | 92051.1 | 0.942 | 0.06 | 12 | 10.4 | 0.02 | 7 | 54.4 | 0.09 | 15 |
| LBY112 | 92051.3 | 1.01 | L | 20 | 10.6 | L | 10 | 59.9 | L | 27 |
| LBY112 | 92053.2 | — | — | — | 10.0 | 0.27 | 3 | — | — | — |
| LBY108 | 91422.2 | — | — | — | 10.6 | L | 9 | 51.6 | 0.17 | 9 |
| LBY108 | 91423.1 | — | L | — | 10.6 | L | 10 | 55.2 | 0.06 | 17 |
| LBY108 | 91423.4 | 1.02 | 0.11 | 21 | 10.5 | 0.01 | 8 | 60.0 | 0.08 | 27 |
| LBY104 | 91267.4 | 0.944 | 0.05 | 12 | — | — | — | — | — | — |
| LBY104 | 91269.2 | — | — | — | 10.8 | 0.24 | 11 | 56.2 | 0.01 | 19 |
| LBY103 | 91381.11 | 0.950 | 0.07 | 13 | 10.2 | 0.07 | 5 | 54.2 | 0.21 | 15 |
| LBY103 | 91381.9 | — | — | — | — | — | — | 47.3 | — | — |
| CONT. | — | 0.841 | — | — | 9.70 | — | — | 59.2 | 0.22 | 5 |
| LBY96 | 92425.4 | — | — | — | — | — | — | 77.7 | 0.08 | 38 |
| LBY96 | 92428.4 | 1.28 | L | 30 | 11.4 | 0.14 | 9 | — | — | — |
| LBY89 | 92259.1 | 1.03 | 0.26 | 4 | 10.8 | 0.24 | 3 | 58.4 | 0.25 | 3 |
| LBY89 | 92259.2 | — | — | — | 10.9 | 0.10 | 4 | — | — | — |
| LBY89 | 92261.6 | — | — | — | 11.0 | 0.06 | 4 | 71.5 | 0.08 | 27 |
| LBY79 | 92221.2 | 1.28 | 0.16 | 29 | 11.2 | 0.13 | 7 | 64.9 | 0.30 | 15 |
| LBY72 | 92764.1 | 1.08 | 0.06 | 9 | — | — | — | 65.6 | 0.17 | 16 |
| LBY72 | 92765.1 | — | — | — | 10.9 | 0.20 | 3 | — | — | — |
| LBY72 | 92766.2 | — | — | — | 11.2 | 0.08 | 6 | 70.1 | 0.17 | 24 |
| LBY72 | 92766.4 | 1.15 | 0.20 | 16 | 11.4 | L | 9 | 74.1 | 0.26 | 31 |
| LBY36 | 92526.1 | 1.21 | 0.30 | 23 | 11.6 | 0.05 | 10 | 59.4 | 0.26 | 5 |
| LBY36 | 92526.2 | — | — | — | — | — | — | 66.8 | 0.14 | 18 |
| LBY32 | 92833.2 | 1.18 | 0.06 | 19 | 11.6 | 0.05 | 10 | 59.4 | 0.28 | 5 |
| LBY30 | 92324.2 | 1.13 | L | 15 | — | — | — | 66.7 | 0.19 | 18 |
| LBY30 | 92324.4 | 1.13 | 0.02 | 14 | — | — | — | 67.2 | 0.10 | 19 |
| LBY30 | 92326.2 | 1.14 | 0.25 | 15 | 11.0 | 0.10 | 4 | 61.2 | 0.11 | 8 |
| LBY233 | 92477.3 | — | — | — | 11.1 | 0.03 | 6 | 59.1 | 0.25 | 5 |
| LBY233 | 92478.3 | 1.05 | 0.11 | 6 | — | — | — | — | — | — |
| LBY214 | 92760.1 | 1.13 | 0.25 | 14 | — | — | — | — | — | — |
| LBY214 | 92760.3 | 1.06 | 0.10 | 7 | — | — | — | — | — | — |
| LBY214 | 92760.4 | — | — | — | 11.1 | 0.30 | 5 | 63.7 | 0.26 | 13 |
| LBY214 | 92761.1 | — | — | — | — | — | — | 71.4 | 0.30 | 27 |
| LBY210 | 92845.2 | — | — | — | 11.6 | 0.29 | 10 | 66.5 | 0.27 | 18 |
| LBY210 | 92846.2 | 1.21 | 0.15 | 23 | — | — | — | — | — | — |
| LBY210 | 92846.3 | — | — | — | 11.1 | 0.18 | 6 | 60.8 | 0.02 | 8 |
| LBY204 | 92826.1 | 1.07 | 0.09 | 8 | — | — | — | — | — | — |
| LBY204 | 92827.1 | — | — | — | 11.2 | 0.02 | 6 | — | — | — |
| LBY204 | 92828.1 | 1.10 | 0.05 | 11 | — | — | — | 62.2 | L | 10 |
| LBY187 | 92809.2 | — | — | — | 11.0 | 0.10 | 4 | 61.5 | 0.18 | 9 |
| LBY187 | 92813.2 | — | — | — | 11.3 | L | 7 | — | — | — |
| LBY165 | 92677.7 | — | — | — | 11.1 | 0.30 | 5 | 59.1 | 0.11 | 5 |
| LBY165 | 92678.1 | 1.05 | 0.17 | 6 | — | — | — | 70.6 | 0.03 | 25 |
| LBY165 | 92678.3 | 1.27 | 0.08 | 28 | — | — | — | 74.1 | 0.21 | 31 |
| LBY137 | 92751.5 | — | — | — | 12.0 | 0.03 | 14 | — | — | — |
| LBY137 | 92752.1 | — | — | — | 11.4 | L | 8 | — | — | — |
| LBY137 | 92753.1 | — | — | — | 10.9 | 0.20 | 3 | — | — | — |
| LBY127 | 92744.1 | — | — | — | 10.8 | 0.24 | 3 | 62.3 | 0.27 | 11 |
| LBY127 | 92744.2 | — | — | — | — | — | — | 59.9 | 0.05 | 6 |
| LBY127 | 92745.4 | 1.04 | 0.22 | 5 | — | — | — | 65.5 | 0.23 | 16 |
| LBY126 | 92834.3 | 1.12 | 0.05 | 13 | — | — | — | — | — | — |
| LBY126 | 92838.1 | — | — | — | 11.0 | 0.26 | 4 | — | — | — |
| LBY110 | 91176.1 | 1.08 | 0.28 | 9 | 10.9 | 0.22 | 4 | 72.0 | 0.22 | 28 |
| LBY110 | 91177.3 | 1.23 | 0.05 | 24 | 10.8 | 0.24 | 3 | 64.1 | 0.08 | 14 |
| LBY110 | 91179.3 | 1.09 | 0.02 | 10 | 11.4 | 0.25 | 9 | 82.6 | L | 46 |
| LBY107 | 92284.3 | 1.13 | 0.28 | 14 | — | — | — | 56.4 | — | — |
| LBY107 | 92285.2 | 1.39 | L | 40 | — | — | — | 109.8 | L | 23 |
| CONT. | — | 0.991 | — | — | 10.5 | — | — | 94.6 | 0.28 | 6 |
| LBY91 | 91633.2 | 1.65 | 0.11 | 15 | — | — | — | | | |
| LBY91 | 91634.3 | — | — | — | 12.6 | 0.03 | 7 | | | |

TABLE 249-continued

Genes showing improved plant performance at Drought growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LBY81 | 92009.1 | — | — | — | 13.0 | 0.03 | 10 | — | — | — |
| LBY81 | 92009.4 | — | — | — | 12.6 | 0.20 | 7 | 95.0 | 0.30 | 7 |
| LBY81 | 92013.2 | — | — | — | 12.9 | 0.07 | 10 | — | — | — |
| LBY77 | 92062.1 | 1.61 | 0.09 | 12 | 12.5 | 0.14 | 6 | 106.4 | L | 20 |
| LBY54 | 92084.8 | 1.66 | 0.25 | 16 | 12.6 | 0.03 | 7 | 109.1 | 0.19 | 23 |
| LBY54 | 92087.3 | — | — | — | 12.9 | L | 9 | — | — | — |
| LBY49 | 92039.4 | — | — | — | — | — | — | 101.9 | 0.11 | 15 |
| LBY49 | 92043.1 | 1.52 | 0.27 | 6 | 12.5 | 0.06 | 6 | 101.5 | 0.30 | 14 |
| LBY35 | 92122.1 | — | — | — | — | — | — | 97.2 | 0.26 | 9 |
| LBY29 | 91619.1 | 1.57 | 0.11 | 10 | — | — | — | — | — | — |
| LBY29 | 91619.5 | 1.60 | 0.07 | 12 | — | — | — | 99.8 | 0.07 | 12 |
| LBY23 | 91397.2 | 1.56 | 0.10 | 9 | — | — | — | — | — | — |
| LBY23 | 91397.3 | — | — | — | 12.5 | 0.14 | 6 | — | — | — |
| LBY174 | 92079.8 | — | — | — | 12.5 | 0.05 | 6 | — | — | — |
| LBY158 | 91648.1 | — | — | — | 12.6 | 0.03 | 7 | 95.2 | 0.29 | 7 |
| LBY146 | 91594.1 | 1.54 | 0.21 | 8 | — | — | — | 97.9 | 0.11 | 10 |
| LBY138 | 92076.1 | 1.52 | 0.29 | 6 | 13.0 | 0.19 | 10 | 102.9 | 0.20 | 16 |
| LBY138 | 92076.2 | — | — | — | 12.6 | 0.17 | 6 | 104.9 | 0.24 | 18 |
| LBY138 | 92078.3 | — | — | — | 12.3 | 0.13 | 4 | — | — | — |
| LBY117 | 91366.3 | 1.72 | 0.23 | 20 | — | — | — | — | — | — |
| LBY117 | 91367.2 | — | — | — | 12.7 | 0.02 | 7 | — | — | — |
| LBY112 | 92051.3 | — | — | — | 12.9 | 0.16 | 10 | 101.2 | 0.04 | 14 |
| LBY112 | 92053.2 | — | — | — | 12.5 | 0.05 | 6 | — | — | — |
| LBY112 | 92053.4 | — | — | — | 12.4 | 0.11 | 5 | 105.4 | 0.01 | 19 |
| LBY108 | 91423.1 | 1.78 | 0.02 | 24 | 12.4 | 0.23 | 5 | 113.7 | L | 28 |
| LBY108 | 91423.4 | — | — | — | 12.7 | 0.04 | 7 | — | — | — |
| LBY108 | 91423.6 | 1.56 | 0.10 | 9 | — | — | — | 99.1 | 0.08 | 12 |
| LBY104 | 91269.2 | 1.83 | 0.22 | 28 | 12.8 | 0.16 | 8 | 121.0 | 0.06 | 36 |
| LBY103 | 91381.9 | — | — | — | 13.1 | 0.06 | 11 | — | — | — |
| CONT. | — | 1.43 | — | — | 11.8 | — | — | 88.9 | — | — |

Table 249 "CONT."—Control; "Ave."—Average; "% Incr." = % increment; "p-val."-p-value, L-p < 0.01.

TABLE 250

Genes showing improved plant performance at Drought growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY83 | 91330.2 | — | — | — | 4.58 | 0.20 | 20 | 0.332 | 0.15 | 20 |
| LBY63 | 91329.3 | 0.640 | 0.17 | 19 | — | — | — | — | — | — |
| LBY224 | 91529.1 | — | — | — | 4.51 | 0.25 | 18 | — | — | — |
| LBY196 | 91300.1 | — | — | — | 4.64 | 0.17 | 22 | — | — | — |
| LBY196 | 91303.2 | — | — | — | 4.56 | 0.21 | 20 | — | — | — |
| LBY150 | 91644.3 | — | — | — | 4.45 | 0.29 | 17 | — | — | — |
| LBY133 | 91139.4 | 0.622 | 0.25 | 15 | — | — | — | — | — | — |
| LBY132 | 91277.1 | — | — | — | 5.08 | 0.04 | 33 | — | — | — |
| LBY125 | 91273.3 | — | — | — | 4.81 | 0.10 | 26 | — | — | — |
| CONT. | — | 0.540 | — | — | 3.82 | — | — | 0.278 | — | — |
| LBY79 | 92221.2 | 0.754 | 0.19 | 15 | 10.0 | 0.07 | 21 | 0.502 | 0.10 | 11 |
| LBY79 | 92221.3 | — | — | — | 9.52 | 0.20 | 15 | 0.488 | 0.28 | 8 |
| LBY72 | 92765.1 | 0.810 | 0.06 | 24 | 11.3 | L | 36 | — | — | — |
| LBY72 | 92765.3 | 0.732 | 0.23 | 12 | — | — | — | — | — | — |
| LBY72 | 92766.2 | — | — | — | 9.65 | 0.15 | 16 | — | — | — |
| LBY36 | 92526.1 | 0.875 | L | 34 | 9.68 | 0.19 | 17 | — | — | — |
| LBY32 | 92830.1 | — | — | — | 10.6 | 0.03 | 27 | 0.512 | 0.08 | 13 |
| LBY32 | 92830.3 | 0.776 | 0.15 | 19 | 10.3 | 0.06 | 24 | — | — | — |
| LBY32 | 92830.4 | 0.744 | 0.18 | 14 | — | — | — | — | — | — |
| LBY32 | 92833.2 | — | — | — | 9.59 | 0.20 | 16 | — | — | — |
| LBY26 | 92484.4 | 0.752 | 0.20 | 15 | 10.2 | 0.05 | 23 | — | — | — |
| LBY26 | 92485.1 | — | — | — | 10.2 | 0.05 | 23 | — | — | — |
| LBY26 | 92488.1 | 0.776 | 0.08 | 19 | — | — | — | — | — | — |
| LBY233 | 92477.1 | 0.758 | 0.16 | 16 | — | — | — | — | — | — |
| LBY233 | 92477.2 | 0.742 | 0.26 | 13 | — | — | — | — | — | — |

TABLE 250-continued

Genes showing improved plant performance at
Drought growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY233 | 92478.3 | — | — | — | 9.74 | 0.13 | 17 | — | — | — |
| LBY214 | 92760.1 | 0.744 | 0.17 | 14 | — | — | — | — | — | — |
| LBY214 | 92760.3 | 0.750 | 0.18 | 15 | — | — | — | — | — | — |
| LBY214 | 92760.4 | 0.772 | 0.09 | 18 | — | — | — | — | — | — |
| LBY210 | 92845.2 | — | — | — | 10.2 | 0.05 | 22 | 0.502 | 0.12 | 11 |
| LBY210 | 92845.3 | 0.763 | 0.15 | 17 | — | — | — | — | — | — |
| LBY210 | 92846.1 | — | — | — | 9.52 | 0.20 | 15 | — | — | — |
| LBY204 | 92826.1 | 0.811 | 0.06 | 24 | 9.85 | 0.11 | 19 | 0.487 | 0.26 | 8 |
| LBY204 | 92827.1 | 0.756 | 0.17 | 16 | 10.8 | 0.01 | 30 | 0.502 | 0.10 | 11 |
| LBY204 | 92828.1 | 0.790 | 0.10 | 21 | 11.2 | L | 34 | 0.505 | 0.10 | 12 |
| LBY196 | 91301.3 | 0.739 | 0.19 | 13 | — | — | — | — | — | — |
| LBY196 | 91303.2 | — | — | — | 10.7 | 0.01 | 29 | 0.499 | 0.12 | 10 |
| LBY187 | 92809.2 | 0.814 | 0.05 | 24 | 10.4 | 0.03 | 25 | 0.486 | 0.26 | 7 |
| LBY187 | 92813.2 | 0.752 | 0.23 | 15 | 9.53 | 0.20 | 15 | — | — | — |
| LBY137 | 92751.2 | — | — | — | 9.50 | 0.21 | 15 | 0.498 | 0.15 | 10 |
| LBY126 | 92834.3 | — | — | — | 10.1 | 0.08 | 21 | — | — | — |
| LBY126 | 92837.4 | 0.780 | 0.07 | 19 | — | — | — | — | — | — |
| LBY120 | 91211.2 | 0.730 | 0.29 | 11 | — | — | — | — | — | — |
| LBY120 | 91212.1 | 0.722 | 0.29 | 10 | — | — | — | — | — | — |
| LBY113 | 92234.2 | — | — | — | 9.78 | 0.11 | 18 | — | — | — |
| CONT. | — | 0.654 | — | — | 8.30 | — | — | 0.453 | — | — |
| LBY96 | 92428.4 | — | — | — | — | — | — | 0.352 | 0.24 | 12 |
| LBY89 | 92261.6 | — | — | — | 6.84 | 0.02 | 36 | 0.355 | 0.22 | 13 |
| LBY87 | 92257.3 | — | — | — | 6.22 | 0.12 | 23 | 0.352 | 0.26 | 12 |
| LBY55 | 92422.5 | — | — | — | — | — | — | 0.354 | 0.26 | 13 |
| LBY30 | 92324.3 | 0.747 | 0.19 | 22 | — | — | — | — | — | — |
| LBY30 | 92324.4 | — | — | — | 7.73 | L | 53 | 0.363 | 0.15 | 16 |
| LBY30 | 92326.2 | — | — | — | 6.05 | 0.17 | 20 | — | — | — |
| LBY225 | 91605.3 | — | — | — | — | — | — | 0.358 | 0.19 | 14 |
| LBY225 | 91607.2 | 0.734 | 0.23 | 20 | — | — | — | — | — | — |
| LBY225 | 91607.3 | — | — | — | — | — | — | 0.352 | 0.30 | 12 |
| LBY213 | 92030.2 | — | — | — | 5.83 | 0.29 | 16 | — | — | — |
| LBY213 | 92033.1 | — | — | — | 6.26 | 0.10 | 24 | 0.353 | 0.24 | 13 |
| LBY213 | 92033.3 | — | — | — | 6.48 | 0.06 | 29 | 0.352 | 0.26 | 12 |
| LBY212 | 92024.3 | — | — | — | 6.18 | 0.13 | 23 | — | — | — |
| LBY212 | 92026.4 | — | — | — | 6.01 | 0.20 | 19 | 0.371 | 0.13 | 18 |
| LBY202 | 92019.2 | — | — | — | 6.08 | 0.16 | 21 | 0.370 | 0.09 | 18 |
| LBY202 | 92021.1 | — | — | — | 5.83 | 0.28 | 16 | 0.359 | 0.19 | 14 |
| LBY193 | 91662.1 | — | — | — | 5.93 | 0.24 | 18 | — | — | — |
| LBY182 | 92396.4 | 0.728 | 0.24 | 19 | — | — | — | — | — | — |
| LBY174 | 92079.1 | — | — | — | 5.95 | 0.22 | 18 | — | — | — |
| LBY174 | 92079.8 | — | — | — | 5.81 | 0.30 | 15 | — | — | — |
| LBY158 | 91647.3 | — | — | — | — | — | — | 0.352 | 0.26 | 12 |
| LBY154 | 92433.4 | — | — | — | 6.23 | 0.11 | 24 | 0.365 | 0.14 | 16 |
| LBY154 | 92433.5 | 0.735 | 0.22 | 20 | — | — | — | — | — | — |
| LBY139 | 92239.2 | — | — | — | 5.96 | 0.21 | 18 | — | — | — |
| LBY139 | 92241.2 | — | — | — | 7.03 | 0.01 | 40 | 0.362 | 0.15 | 15 |
| LBY135 | 92321.6 | — | — | — | 7.65 | L | 52 | 0.357 | 0.22 | 14 |
| LBY135 | 92322.1 | — | — | — | 6.06 | 0.18 | 20 | — | — | — |
| LBY113 | 92234.2 | — | — | — | 6.07 | 0.17 | 20 | 0.375 | 0.07 | 20 |
| CONT. | — | 0.613 | — | — | 5.04 | — | — | 0.314 | — | — |
| LBY91 | 91633.1 | — | — | — | 6.93 | 0.20 | 19 | — | — | — |
| LBY77 | 92062.1 | — | — | — | 7.50 | 0.06 | 29 | 0.384 | 0.18 | 13 |
| LBY54 | 92086.1 | — | — | — | 7.48 | 0.07 | 28 | 0.385 | 0.19 | 14 |
| LBY35 | 92120.2 | — | — | — | 6.92 | 0.25 | 19 | — | — | — |
| LBY29 | 91617.1 | — | — | — | 7.08 | 0.24 | 22 | — | — | — |
| LBY29 | 91619.1 | — | — | — | 7.14 | 0.14 | 23 | 0.376 | 0.29 | 11 |
| LBY29 | 91619.2 | — | — | — | 7.25 | 0.11 | 24 | — | — | — |
| LBY25 | 91335.2 | — | — | — | 7.15 | 0.14 | 23 | 0.384 | 0.20 | 13 |
| LBY230 | 91669.3 | — | — | — | 7.62 | 0.05 | 31 | 0.386 | 0.20 | 14 |
| LBY23 | 91397.3 | — | — | — | 7.68 | 0.04 | 32 | 0.386 | 0.17 | 14 |
| LBY225 | 91605.3 | — | — | — | 7.86 | 0.03 | 35 | 0.384 | 0.19 | 13 |
| LBY225 | 91607.5 | — | — | — | 8.34 | L | 43 | 0.381 | 0.21 | 12 |
| LBY213 | 92033.3 | — | — | — | 7.23 | 0.17 | 24 | 0.383 | 0.26 | 13 |
| LBY212 | 92026.3 | — | — | — | 7.08 | 0.19 | 22 | — | — | — |
| LBY202 | 92022.1 | — | — | — | 7.19 | 0.14 | 23 | — | — | — |
| LBY202 | 92022.2 | — | — | — | 7.19 | 0.12 | 23 | — | — | — |
| LBY182 | 92396.1 | — | — | — | 7.61 | 0.05 | 31 | 0.400 | 0.07 | 18 |
| LBY182 | 92398.2 | — | — | — | 8.54 | L | 47 | 0.405 | 0.06 | 19 |
| LBY136 | 91442.1 | — | — | — | 6.84 | 0.26 | 17 | — | — | — |
| LBY136 | 91442.8 | — | — | — | 8.24 | 0.01 | 41 | 0.403 | 0.07 | 19 |

TABLE 250-continued

Genes showing improved plant performance at
Drought growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY136 | 91442.9 | — | — | — | 8.03 | 0.02 | 38 | 0.375 | 0.28 | 10 |
| LBY118 | 91434.5 | — | — | — | 6.83 | 0.25 | 17 | — | — | — |
| CONT. | — | — | — | — | 5.83 | — | — | 0.339 | — | — |
| LBY97 | 92038.2 | — | — | — | 7.49 | 0.09 | 22 | — | — | — |
| LBY87 | 92256.1 | — | — | — | 7.16 | 0.20 | 17 | — | — | — |
| LBY25 | 91335.3 | — | — | — | 7.01 | 0.26 | 14 | — | — | — |
| LBY230 | 91667.1 | — | — | — | 7.56 | 0.08 | 23 | — | — | — |
| LBY217 | 92362.2 | — | — | — | 8.95 | L | 46 | 0.485 | 0.02 | 21 |
| LBY138 | 92078.4 | — | — | — | 7.14 | 0.20 | 16 | — | — | — |
| LBY135 | 92321.1 | — | — | — | 7.02 | 0.28 | 14 | — | — | — |
| LBY135 | 92321.6 | — | — | — | 7.45 | 0.09 | 21 | — | — | — |
| LBY118 | 91432.3 | — | — | — | 8.43 | L | 37 | 0.458 | 0.09 | 15 |
| LBY117 | 91366.1 | — | — | — | 7.09 | 0.24 | 16 | — | — | — |
| LBY112 | 92051.1 | — | — | — | 7.00 | 0.26 | 14 | — | — | — |
| LBY112 | 92051.3 | — | — | — | 7.78 | 0.04 | 27 | — | — | — |
| LBY108 | 91423.1 | — | — | — | 7.08 | 0.23 | 15 | — | — | — |
| LBY108 | 91423.4 | — | — | — | 7.83 | 0.04 | 28 | 0.451 | 0.16 | 13 |
| LBY104 | 91269.2 | 0.821 | 0.13 | 29 | — | — | — | — | — | — |
| LBY103 | 91381.11 | — | — | — | 7.23 | 0.16 | 18 | — | — | — |
| LBY103 | 91381.9 | — | — | — | 6.96 | 0.29 | 13 | — | — | — |
| CONT. | — | 0.636 | — | — | 6.13 | — | — | 0.399 | — | — |
| LBY96 | 92428.4 | — | — | — | 7.83 | L | 37 | 0.441 | L | 16 |
| LBY89 | 92263.1 | — | — | — | 6.50 | 0.25 | 13 | 0.408 | 0.12 | 8 |
| LBY79 | 92221.2 | — | — | — | 7.30 | 0.01 | 27 | 0.432 | L | 14 |
| LBY79 | 92223.2 | — | — | — | 6.40 | 0.28 | 12 | 0.413 | 0.08 | 9 |
| LBY72 | 92764.1 | — | — | — | 6.61 | 0.15 | 15 | — | — | — |
| LBY72 | 92765.1 | — | — | — | 6.50 | 0.21 | 13 | — | — | — |
| LBY72 | 92766.2 | — | — | — | 6.88 | 0.10 | 20 | 0.420 | 0.07 | 11 |
| LBY72 | 92766.4 | — | — | — | 7.08 | 0.04 | 24 | 0.411 | 0.07 | 9 |
| LBY36 | 92526.1 | — | — | — | 7.49 | 0.01 | 31 | 0.413 | 0.09 | 9 |
| LBY32 | 92830.1 | — | — | — | 6.41 | 0.27 | 12 | — | — | — |
| LBY32 | 92830.3 | — | — | — | 6.76 | 0.15 | 18 | 0.422 | 0.05 | 12 |
| LBY32 | 92830.4 | 0.639 | 0.24 | 12 | — | — | — | — | — | — |
| LBY32 | 92833.2 | — | — | — | 6.80 | 0.09 | 19 | 0.404 | 0.17 | 7 |
| LBY30 | 9232.44 | — | — | — | 6.79 | 0.09 | 18 | 0.404 | 0.17 | 7 |
| LBY30 | 92326.2 | — | — | — | 6.79 | 0.09 | 19 | — | — | — |
| LBY30 | 92326.3 | — | — | — | 6.45 | 0.26 | 13 | — | — | — |
| LBY233 | 92474.3 | — | — | — | 6.48 | 0.24 | 13 | — | — | — |
| LBY233 | 92477.1 | — | — | — | 6.49 | 0.23 | 13 | — | — | — |
| LBY214 | 92760.1 | — | — | — | 6.51 | 0.21 | 14 | — | — | — |
| LBY214 | 92761.1 | — | — | — | 6.58 | 0.16 | 15 | 0.406 | 0.14 | 7 |
| LBY210 | 92845.2 | — | — | — | 7.27 | 0.02 | 27 | 0.409 | 0.13 | 8 |
| LBY210 | 92846.1 | 0.639 | 0.25 | 12 | — | — | — | — | — | — |
| LBY210 | 92846.2 | — | — | — | 6.79 | 0.10 | 18 | 0.417 | 0.04 | 10 |
| LBY204 | 92827.1 | — | — | — | 6.77 | 0.14 | 18 | 0.404 | 0.29 | 7 |
| LBY187 | 92812.1 | — | — | — | — | — | — | 0.401 | 0.20 | 6 |
| LBY165 | 92678.3 | — | — | — | 7.20 | 0.02 | 26 | 0.427 | 0.01 | 13 |
| LBY137 | 92751.5 | — | — | — | 7.47 | 0.01 | 30 | 0.427 | 0.01 | 13 |
| LBY137 | 92752.1 | — | — | — | 6.51 | 0.22 | 14 | — | — | — |
| LBY127 | 92744.2 | — | — | — | 6.40 | 0.27 | 12 | — | — | — |
| LBY126 | 92834.3 | — | — | — | 6.69 | 0.12 | 17 | 0.413 | 0.08 | 9 |
| LBY126 | 92837.3 | — | — | — | 6.51 | 0.23 | 14 | — | — | — |
| LBY110 | 91177.3 | — | — | — | 7.27 | 0.03 | 27 | 0.439 | L | 16 |
| LBY110 | 91179.3 | — | — | — | 6.55 | 0.18 | 14 | — | — | — |
| LBY107 | 92285.2 | — | — | — | 8.35 | L | 46 | 0.463 | L | 22 |
| CONT. | — | 0.571 | — | — | 5.73 | — | — | 0.378 | — | — |
| LBY91 | 91633.2 | — | — | — | 12.5 | 0.20 | 23 | — | — | — |
| LBY81 | 92009.1 | 0.593 | 0.18 | 32 | — | — | — | — | — | — |
| LBY81 | 92013.2 | — | — | — | 12.1 | 0.30 | 19 | — | — | — |
| LBY77 | 92062.1 | — | — | — | 12.3 | 0.24 | 21 | — | — | — |
| LBY54 | 92084.8 | — | — | — | 12.7 | 0.18 | 25 | — | — | — |
| LBY54 | 92087.3 | 0.582 | 0.24 | 30 | — | — | — | — | — | — |
| LBY35 | 92119.2 | 0.576 | 0.22 | 28 | — | — | — | — | — | — |
| LBY158 | 91648.1 | 0.575 | 0.21 | 28 | — | — | — | — | — | — |
| LBY117 | 91366.3 | — | — | — | 12.1 | 0.28 | 19 | — | — | — |
| LBY112 | 92051.3 | 0.564 | 0.27 | 26 | — | — | — | — | — | — |
| LBY112 | 92053.4 | — | — | — | 12.1 | 0.29 | 19 | — | — | — |
| LBY112 | 92053.6 | 0.580 | 0.22 | 29 | — | — | — | — | — | — |
| LBY108 | 91423.1 | — | — | — | 13.0 | 0.13 | 28 | — | — | — |
| LBY108 | 91423.4 | 0.562 | 0.29 | 25 | — | — | — | — | — | — |
| LBY104 | 91269.2 | — | — | — | 13.8 | 0.06 | 36 | — | — | — |

TABLE 250-continued

Genes showing improved plant performance at
Drought growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY103 | 91381.9 | 0.619 | 0.12 | 38 | — | — | — | — | — | — |
| CONT. | — | 0.449 | — | — | 10.2 | — | — | — | — | — |

Table 250. "CONT."—Control; "Ave."—Average; "% Incr." = % increment; "p-val."—p-value, L-p < 0.01.

TABLE 251

Genes showing improved plant performance at
Drought growth conditions under regulation of At6669 promoter

| Gene Name | Event # | Harvest Index | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY83 | 91330.1 | 0.204 | 0.10 | 20 | — | — | — | 4.16 | 0.17 | 7 |
| LBY83 | 91330.2 | — | — | — | 5.56 | L | 22 | 4.71 | 0.01 | 21 |
| LBY83 | 91330.3 | — | — | — | 5.26 | 0.25 | 16 | 4.28 | L | 10 |
| LBY63 | 91325.1 | 0.186 | 0.05 | 9 | — | — | — | — | — | — |
| LBY63 | 91325.2 | 0.192 | 0.03 | 13 | — | — | — | — | — | — |
| LBY63 | 91325.4 | 0.197 | 0.10 | 16 | — | — | — | — | — | — |
| LBY51 | 90981.1 | — | — | — | 4.89 | 0.29 | 8 | 4.15 | 0.03 | 7 |
| LBY48 | 90968.1 | — | — | — | 5.00 | 0.07 | 10 | 4.15 | 0.12 | 7 |
| LBY48 | 90970.2 | — | — | — | — | — | — | 4.16 | 0.13 | 7 |
| LBY224 | 91527.4 | — | — | — | 5.11 | 0.04 | 13 | 4.23 | 0.02 | 9 |
| LBY224 | 91529.1 | — | — | — | 5.34 | L | 18 | 4.15 | 0.05 | 7 |
| LBY224 | 91529.2 | — | — | — | 4.95 | 0.15 | 9 | 4.11 | 0.20 | 6 |
| LBY196 | 91300.1 | — | — | — | 5.59 | 0.04 | 23 | 4.41 | 0.12 | 13 |
| LBY196 | 91303.2 | — | — | — | 5.47 | 0.26 | 21 | 4.36 | 0.12 | 12 |
| LBY196 | 91304.3 | — | — | — | 5.07 | 0.04 | 12 | 4.23 | L | 9 |
| LBY134 | 91281.5 | — | — | — | — | — | — | 4.17 | 0.25 | 7 |
| LBY134 | 91282.1 | — | — | — | 4.88 | 0.17 | 7 | 4.18 | 0.02 | 7 |
| LBY132 | 91277.1 | — | — | — | 6.26 | 0.24 | 38 | 4.64 | 0.12 | 19 |
| LBY125 | 91273.3 | — | — | — | 5.73 | L | 26 | 4.48 | 0.03 | 15 |
| LBY102 | 91262.1 | — | — | — | — | — | — | 4.10 | 0.16 | 5 |
| LBY102 | 91262.8 | 0.192 | 0.07 | 13 | — | — | — | — | — | — |
| LBY102 | 91264.1 | 0.241 | 0.07 | 41 | — | — | — | — | — | — |
| CONT. | — | 0.170 | — | — | 4.54 | — | — | 3.89 | — | — |
| LBY79 | 92221.2 | — | — | — | 10.3 | 0.10 | 23 | 5.69 | L | 14 |
| LBY79 | 92221.3 | — | — | — | 9.94 | 0.06 | 18 | — | — | — |
| LBY72 | 92765.1 | — | — | — | 11.6 | 0.11 | 38 | 5.71 | 0.17 | 14 |
| LBY72 | 92766.2 | — | — | — | 9.81 | L | 17 | 5.37 | 0.10 | 7 |
| LBY72 | 92766.4 | — | — | — | 9.26 | 0.03 | 10 | 5.21 | 0.09 | 4 |
| LBY32 | 92830.1 | — | — | — | 11.0 | 0.13 | 31 | 5.86 | 0.17 | 17 |
| LBY32 | 92830.3 | — | — | — | 10.7 | 0.29 | 27 | — | — | — |
| LBY26 | 92484.4 | — | — | — | 10.5 | L | 24 | 5.47 | L | 9 |
| LBY26 | 92484.5 | — | — | — | 9.35 | 0.17 | 11 | — | — | — |
| LBY26 | 92485.1 | — | — | — | 10.4 | 0.07 | 23 | 5.40 | 0.18 | 8 |
| LBY233 | 92477.2 | — | — | — | — | — | — | 5.26 | 0.20 | 5 |
| LBY233 | 92478.3 | — | — | — | 9.89 | 0.13 | 18 | 5.32 | 0.16 | 6 |
| LBY210 | 92845.2 | — | — | — | 10.4 | 0.12 | 23 | 5.65 | 0.07 | 13 |
| LBY210 | 92846.1 | — | — | — | 9.69 | 0.21 | 15 | 5.34 | 0.26 | 7 |
| LBY210 | 92846.2 | — | — | — | — | — | — | 5.12 | 0.26 | 2 |
| LBY204 | 92826.1 | — | — | — | 10.1 | 0.03 | 20 | 5.42 | 0.02 | 8 |
| LBY204 | 92827.1 | — | — | — | 10.9 | L | 29 | 5.59 | L | 12 |
| LBY204 | 92828.1 | — | — | — | 11.5 | L | 36 | 5.86 | 0.02 | 17 |
| LBY196 | 91303.2 | — | — | — | 11.0 | L | 31 | 5.73 | L | 15 |
| LBY187 | 92809.2 | — | — | — | 10.6 | L | 26 | 5.54 | L | 11 |
| LBY137 | 92751.2 | — | — | — | 9.69 | 0.14 | 15 | 5.43 | 0.09 | 9 |
| LBY126 | 92837.3 | — | — | — | 9.53 | 0.23 | 13 | — | — | — |
| LBY120 | 91211.2 | — | — | — | 9.13 | 0.09 | 9 | 5.19 | 0.09 | 4 |
| LBY120 | 91214.1 | — | — | — | 9.21 | 0.06 | 10 | 5.16 | 0.18 | 3 |
| LBY113 | 92234.2 | — | — | — | 10.1 | L | 20 | 5.45 | L | 9 |
| LBY107 | 92284.2 | — | — | — | — | — | — | 5.17 | 0.12 | 3 |
| CONT. | — | — | — | — | 8.41 | — | — | 5.00 | — | — |
| LBY96 | 92428.4 | — | — | — | 5.97 | 0.04 | 11 | 4.44 | L | 8 |
| LBY89 | 92259.2 | — | — | — | 5.72 | 0.28 | 6 | — | — | — |
| LBY89 | 92261.6 | — | — | — | 7.30 | 0.02 | 36 | 4.70 | L | 15 |

TABLE 251-continued

Genes showing improved plant performance at
Drought growth conditions under regulation of At6669 promoter

| Gene Name | Event # | Harvest Index Ave. | Harvest Index P-Val. | Harvest Index % Incr. | Rosette Area [cm²] Ave. | Rosette Area [cm²] P-Val. | Rosette Area [cm²] % Incr. | Rosette Diameter [cm] Ave. | Rosette Diameter [cm] P-Val. | Rosette Diameter [cm] % Incr. |
|---|---|---|---|---|---|---|---|---|---|---|
| LBY89 | 92263.3 | — | — | — | — | — | — | 4.35 | 0.24 | 6 |
| LBY87 | 92257.1 | — | — | — | 6.11 | 0.20 | 14 | — | — | — |
| LBY87 | 92257.3 | — | — | — | 6.69 | 0.07 | 24 | 4.55 | 0.12 | 11 |
| LBY55 | 92422.5 | — | — | — | 6.20 | 0.13 | 15 | 4.49 | 0.05 | 10 |
| LBY30 | 92324.2 | — | — | — | 5.97 | 0.08 | 11 | 4.38 | 0.06 | 7 |
| LBY30 | 92324.4 | — | — | — | 8.49 | L | 58 | 5.04 | L | 23 |
| LBY30 | 92326.2 | — | — | — | 6.55 | L | 22 | 4.54 | L | 11 |
| LBY225 | 91605.3 | — | — | — | 6.00 | 0.10 | 12 | 4.47 | 0.13 | 9 |
| LBY225 | 91607.2 | — | — | — | 5.90 | 0.29 | 10 | 4.31 | 0.04 | 5 |
| LBY225 | 91607.5 | — | — | — | — | — | — | 4.35 | 0.19 | 6 |
| LBY225 | 91607.6 | — | — | — | 5.78 | 0.16 | 7 | 4.30 | 0.05 | 5 |
| LBY213 | 92030.2 | — | — | — | — | — | — | 4.40 | 0.07 | 7 |
| LBY213 | 92033.1 | 0.280 | 0.04 | 24 | 6.71 | L | 25 | 4.62 | L | 13 |
| LBY213 | 92033.3 | — | — | — | 7.01 | L | 30 | 4.71 | L | 15 |
| LBY212 | 92024.2 | 0.259 | 0.19 | 15 | — | — | — | — | — | — |
| LBY212 | 92024.3 | — | — | — | 6.65 | 0.27 | 24 | 4.58 | 0.19 | 12 |
| LBY212 | 92026.4 | — | — | — | 6.44 | 0.07 | 20 | 4.62 | 0.20 | 13 |
| LBY202 | 92019.2 | — | — | — | 6.43 | 0.20 | 20 | 4.56 | 0.08 | 11 |
| LBY202 | 92021.1 | — | — | — | 6.24 | 0.15 | 16 | 4.45 | 0.22 | 8 |
| LBY202 | 92022.1 | 0.256 | 0.21 | 14 | 6.10 | 0.25 | 14 | 4.28 | 0.24 | 4 |
| LBY193 | 91660.2 | — | — | — | 6.07 | 0.21 | 13 | — | — | — |
| LBY193 | 91662.1 | — | — | — | 6.45 | 0.26 | 20 | 4.48 | 0.19 | 9 |
| LBY193 | 91664.1 | 0.265 | 0.12 | 18 | — | — | — | — | — | — |
| LBY182 | 92396.1 | — | — | — | 5.76 | 0.16 | 7 | 4.28 | 0.06 | 4 |
| LBY182 | 92396.2 | — | — | — | — | — | — | 4.51 | 0.23 | 10 |
| LBY182 | 92396.4 | — | — | — | 5.95 | 0.06 | 11 | 4.25 | 0.14 | 4 |
| LBY174 | 92079.1 | — | — | — | — | — | — | 4.50 | L | 10 |
| LBY174 | 92079.8 | — | — | — | — | — | — | 4.46 | 0.13 | 9 |
| LBY174 | 92080.1 | 0.270 | 0.12 | 20 | — | — | — | — | — | — |
| LBY158 | 91647.3 | — | — | — | 6.15 | 0.04 | 14 | 4.63 | L | 13 |
| LBY158 | 91649.1 | — | — | — | 5.87 | 0.09 | 9 | 4.42 | 0.09 | 8 |
| LBY154 | 92433.4 | — | — | — | 7.30 | L | 36 | 4.88 | L | 19 |
| LBY154 | 92433.5 | — | — | — | 6.23 | 0.26 | 16 | — | — | — |
| LBY146 | 91590.4 | — | — | — | — | — | — | 4.29 | 0.28 | 5 |
| LBY146 | 91594.1 | — | — | — | 6.24 | 0.18 | 16 | 4.29 | 0.29 | 5 |
| LBY139 | 92239.2 | — | — | — | 6.38 | L | 19 | 4.32 | 0.04 | 5 |
| LBY139 | 92241.2 | — | — | — | 7.62 | L | 42 | 4.87 | 0.06 | 19 |
| LBY135 | 92321.6 | 0.255 | 0.25 | 13 | 8.34 | 0.08 | 55 | 4.95 | 0.06 | 21 |
| LBY135 | 92322.1 | 0.265 | 0.23 | 17 | — | — | — | — | — | — |
| LBY135 | 92323.1 | — | — | — | 5.94 | 0.06 | 10 | 4.36 | 0.02 | 6 |
| LBY113 | 92234.1 | — | — | — | 6.07 | 0.23 | 13 | 4.35 | 0.24 | 6 |
| LBY113 | 92234.2 | 0.272 | 0.09 | 21 | 7.00 | L | 30 | 4.70 | L | 15 |
| LBY113 | 92234.5 | 0.277 | 0.06 | 23 | 6.13 | 0.02 | 14 | 4.40 | 0.03 | 7 |
| LBY113 | 92234.6 | 0.285 | 0.13 | 27 | 5.88 | 0.07 | 9 | 4.22 | 0.29 | 3 |
| LBY113 | 92235.2 | — | — | — | — | — | — | 4.26 | 0.09 | 4 |
| CONT. | — | 0.225 | — | — | 5.38 | — | — | 4.10 | — | — |
| LBY91 | 91633.1 | 0.232 | 0.01 | 28 | 7.25 | 0.08 | 18 | 4.65 | 0.17 | 8 |
| LBY91 | 91633.2 | 0.237 | 0.04 | 31 | — | — | — | — | — | — |
| LBY91 | 91634.2 | 0.220 | 0.19 | 21 | 6.72 | 0.18 | 10 | — | — | — |
| LBY77 | 92062.1 | — | — | — | 7.90 | L | 29 | 4.85 | L | 13 |
| LBY54 | 92086.1 | 0.221 | 0.03 | 22 | 7.95 | 0.17 | 30 | 4.90 | 0.17 | 14 |
| LBY35 | 92119.1 | — | — | — | 6.95 | 0.08 | 14 | 4.55 | 0.06 | 6 |
| LBY29 | 91619.1 | — | — | — | 7.58 | 0.12 | 24 | 4.85 | 0.10 | 13 |
| LBY29 | 91619.2 | — | — | — | 7.76 | 0.08 | 27 | 4.83 | 0.02 | 12 |
| LBY25 | 91335.2 | — | — | — | 7.59 | 0.18 | 24 | 4.94 | 0.11 | 15 |
| LBY230 | 91669.2 | 0.202 | 0.27 | 11 | — | — | — | — | — | — |
| LBY230 | 91669.3 | 0.243 | L | 34 | 8.01 | 0.09 | 31 | 4.89 | 0.17 | 14 |
| LBY23 | 91397.3 | — | — | — | 8.10 | 0.04 | 32 | 4.91 | 0.06 | 14 |
| LBY225 | 91605.3 | 0.216 | 0.14 | 19 | 8.25 | L | 35 | 4.86 | 0.04 | 13 |
| LBY225 | 91607.2 | 0.199 | 0.25 | 10 | — | — | — | — | — | — |
| LBY225 | 91607.3 | 0.206 | 0.13 | 14 | 6.72 | 0.21 | 10 | 4.59 | 0.03 | 7 |
| LBY225 | 91607.5 | — | — | — | 8.77 | L | 43 | 5.03 | L | 17 |
| LBY225 | 91607.6 | 0.245 | L | 35 | — | — | — | — | — | — |
| LBY217 | 92363.1 | — | — | — | — | — | — | 4.67 | 0.08 | 9 |
| LBY202 | 92022.1 | — | — | — | 7.69 | 0.28 | 26 | 4.84 | 0.26 | 13 |
| LBY202 | 92022.2 | — | — | — | 7.51 | 0.29 | 23 | — | — | — |
| LBY193 | 91664.5 | — | — | — | 6.71 | 0.18 | 10 | 4.47 | 0.29 | 4 |
| LBY182 | 92396.1 | 0.234 | L | 29 | 7.92 | 0.02 | 29 | 4.93 | L | 15 |
| LBY182 | 92398.2 | 0.204 | 0.25 | 12 | 8.92 | L | 46 | 5.14 | L | 20 |
| LBY136 | 91442.1 | — | — | — | 7.20 | 0.19 | 18 | 4.68 | 0.10 | 9 |
| LBY136 | 91442.6 | — | — | — | 7.45 | 0.14 | 22 | 4.86 | 0.08 | 13 |

TABLE 251-continued

Genes showing improved plant performance at
Drought growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY136 | 91442.8 | 0.208 | 0.14 | 15 | 8.63 | 0.01 | 41 | 5.04 | 0.03 | 17 |
| LBY136 | 91442.9 | — | — | — | 8.43 | 0.14 | 38 | 4.90 | 0.02 | 14 |
| LBY118 | 91432.3 | 0.209 | 0.13 | 15 | — | — | — | — | — | — |
| LBY118 | 91434.4 | — | — | — | — | — | — | 4.44 | 0.23 | 3 |
| LBY118 | 91434.5 | — | — | — | 7.34 | 0.02 | 20 | 4.68 | 0.01 | 9 |
| CONT. | — | 0.181 | — | — | 6.12 | — | — | 4.30 | — | — |
| LBY97 | 92038.2 | — | — | — | 7.25 | 0.08 | 23 | 4.73 | 0.16 | 8 |
| LBY87 | 92256.1 | — | — | — | — | — | — | 4.66 | 0.18 | 7 |
| LBY25 | 91335.3 | — | — | — | 6.89 | 0.08 | 17 | 4.62 | 0.30 | 5 |
| LBY230 | 91665.1 | — | — | — | 6.29 | 0.29 | 6 | 4.64 | 0.13 | 6 |
| LBY230 | 91667.1 | — | — | — | 7.33 | 0.14 | 24 | 4.84 | 0.06 | 11 |
| LBY217 | 92362.2 | — | — | — | 8.62 | L | 46 | 5.30 | L | 21 |
| LBY217 | 92363.1 | — | — | — | — | — | — | 4.61 | 0.10 | 5 |
| LBY138 | 92078.4 | — | — | — | 7.05 | 0.24 | 19 | 4.66 | 0.19 | 6 |
| LBY136 | 91442.6 | — | — | — | — | — | — | 4.56 | 0.26 | 4 |
| LBY135 | 92321.6 | — | — | — | 7.21 | L | 22 | 4.80 | 0.01 | 10 |
| LBY118 | 91432.3 | — | — | — | 8.16 | 0.02 | 38 | 5.07 | L | 16 |
| LBY118 | 91434.5 | — | — | — | 6.40 | 0.20 | 8 | — | — | — |
| LBY117 | 91367.1 | — | — | — | — | — | — | 4.57 | 0.21 | 4 |
| LBY112 | 92051.1 | — | — | — | 6.80 | 0.09 | 15 | 4.64 | 0.17 | 6 |
| LBY112 | 92051.3 | — | — | — | 7.49 | L | 27 | 4.78 | 0.02 | 9 |
| LBY108 | 91422.2 | — | — | — | 6.45 | 0.17 | 9 | — | — | — |
| LBY108 | 91423.1 | — | — | — | 6.90 | 0.06 | 17 | 4.77 | 0.02 | 9 |
| LBY108 | 91423.4 | — | — | — | 7.50 | 0.08 | 27 | 4.82 | 0.23 | 10 |
| LBY104 | 91267.4 | — | — | — | — | — | — | 4.68 | 0.05 | 7 |
| LBY103 | 91381.11 | — | — | — | 7.03 | 0.01 | 19 | 4.72 | 0.04 | 8 |
| LBY103 | 91381.9 | — | — | — | 6.78 | 0.21 | 15 | 4.61 | 0.17 | 5 |
| CONT. | — | — | — | — | 5.91 | — | — | 4.38 | — | — |
| LBY96 | 92425.4 | — | — | — | 7.40 | 0.22 | 5 | — | — | — |
| LBY96 | 92428.4 | — | — | — | 9.71 | 0.08 | 38 | 5.45 | 0.11 | 17 |
| LBY89 | 92259.2 | — | — | — | 7.30 | 0.25 | 3 | — | — | — |
| LBY89 | 92263.1 | — | — | — | — | — | — | 5.09 | 0.21 | 9 |
| LBY79 | 92221.2 | — | — | — | 8.94 | 0.08 | 27 | 5.23 | L | 12 |
| LBY72 | 92764.1 | — | — | — | 8.11 | 0.30 | 15 | — | — | — |
| LBY72 | 92765.1 | — | — | — | 8.20 | 0.17 | 16 | 5.05 | 0.11 | 8 |
| LBY72 | 92766.4 | — | — | — | 8.76 | 0.17 | 24 | 5.14 | 0.08 | 10 |
| LBY36 | 92526.1 | — | — | — | 9.26 | 0.26 | 31 | 5.26 | 0.27 | 13 |
| LBY36 | 92526.2 | — | — | — | 7.42 | 0.26 | 5 | — | — | — |
| LBY32 | 92830.1 | — | — | — | — | — | — | 4.88 | 0.16 | 5 |
| LBY32 | 92833.2 | — | — | — | 8.35 | 0.14 | 18 | 5.02 | 0.20 | 8 |
| LBY30 | 92324.2 | — | — | — | 7.43 | 0.28 | 5 | — | — | — |
| LBY30 | 92324.4 | — | — | — | 8.34 | 0.19 | 18 | 5.00 | 0.25 | 7 |
| LBY30 | 92326.2 | — | — | — | 8.39 | 0.10 | 19 | 5.13 | 0.17 | 10 |
| LBY30 | 92326.3 | — | — | — | — | — | — | 4.88 | 0.16 | 5 |
| LBY233 | 92477.1 | — | — | — | — | — | — | 5.05 | 0.27 | 8 |
| LBY233 | 92477.3 | — | — | — | 7.65 | 0.11 | 8 | 4.87 | 0.04 | 5 |
| LBY233 | 92478.3 | — | — | — | 7.39 | 0.25 | 5 | — | — | — |
| LBY214 | 92760.1 | — | — | — | — | — | — | 4.91 | 0.14 | 5 |
| LBY214 | 92761.1 | — | — | — | 7.96 | 0.26 | 13 | 5.06 | 0.21 | 9 |
| LBY210 | 92845.2 | — | — | — | 8.93 | 0.30 | 27 | 5.18 | 0.30 | 11 |
| LBY210 | 92846.2 | — | — | — | 8.31 | 0.27 | 18 | 4.96 | L | 7 |
| LBY204 | 92826.1 | — | — | — | 7.60 | 0.02 | 8 | — | — | — |
| LBY204 | 92828.1 | — | — | — | — | — | — | 4.88 | 0.04 | 5 |
| LBY187 | 92809.2 | — | — | — | 7.78 | L | 10 | — | — | — |
| LBY187 | 92812.1 | — | — | — | — | — | — | 4.82 | 0.09 | 4 |
| LBY187 | 92813.2 | — | — | — | 7.68 | 0.18 | 9 | 4.79 | 0.15 | 3 |
| LBY165 | 92678.1 | — | — | — | 7.39 | 0.11 | 5 | — | — | — |
| LBY165 | 92678.3 | — | — | — | 8.82 | 0.03 | 25 | 5.13 | 0.14 | 10 |
| LBY137 | 92751.5 | — | — | — | 9.26 | 0.21 | 31 | 5.33 | 0.03 | 15 |
| LBY127 | 92744.2 | — | — | — | 7.79 | 0.27 | 11 | — | — | — |
| LBY127 | 92745.4 | — | — | — | 7.49 | 0.05 | 6 | — | — | — |
| LBY126 | 92834.3 | — | — | — | 8.19 | 0.23 | 16 | — | — | — |
| LBY110 | 91177.3 | — | — | — | 9.00 | 0.22 | 28 | 5.28 | 0.20 | 14 |
| LBY110 | 91179.3 | — | — | — | 8.02 | 0.08 | 14 | 4.84 | 0.29 | 4 |
| LBY107 | 92285.2 | — | — | — | 10.3 | L | 46 | 5.70 | L | 22 |
| CONT. | — | — | — | — | 7.05 | — | — | 4.65 | — | — |
| LBY91 | 91633.1 | 0.230 | 0.03 | 20 | — | — | — | — | — | — |
| LBY91 | 91633.2 | — | — | — | 13.7 | L | 23 | 6.20 | 0.05 | 9 |
| LBY91 | 91634.3 | — | — | — | 11.8 | 0.28 | 6 | — | — | — |
| LBY81 | 92009.4 | — | — | — | 11.9 | 0.30 | 7 | — | — | — |
| LBY77 | 92062.1 | — | — | — | 13.3 | L | 20 | — | — | — |

TABLE 251-continued

Genes showing improved plant performance at Drought growth conditions under regulation of At6669 promoter

| Gene Name | Event # | Harvest Index Ave. | Harvest Index P-Val. | Harvest Index % Incr. | Rosette Area [cm²] Ave. | Rosette Area [cm²] P-Val. | Rosette Area [cm²] % Incr. | Rosette Diameter [cm] Ave. | Rosette Diameter [cm] P-Val. | Rosette Diameter [cm] % Incr. |
|---|---|---|---|---|---|---|---|---|---|---|
| LBY54 | 92084.8 | — | — | — | 13.6 | 0.19 | 23 | — | — | — |
| LBY49 | 92039.4 | — | — | — | 12.7 | 0.11 | 15 | — | — | — |
| LBY49 | 92043.1 | — | — | — | 12.7 | 0.30 | 14 | — | — | — |
| LBY35 | 92119.2 | 0.208 | 0.26 | 8 | — | — | — | — | — | — |
| LBY35 | 92122.1 | — | — | — | 12.1 | 0.26 | 9 | — | — | — |
| LBY29 | 91619.1 | 0.221 | 0.15 | 15 | — | — | — | — | — | — |
| LBY29 | 91619.5 | — | — | — | 12.5 | 0.07 | 12 | — | — | — |
| LBY174 | 92079.1 | 0.223 | 0.14 | 16 | — | — | — | — | — | — |
| LBY158 | 91648.1 | — | — | — | 11.9 | 0.29 | 7 | — | — | — |
| LBY146 | 91590.4 | 0.226 | 0.04 | 17 | — | — | — | — | — | — |
| LBY146 | 91594.1 | — | — | — | 12.2 | 0.11 | 10 | 5.93 | 0.25 | 4 |
| LBY138 | 92076.1 | — | — | — | 12.9 | 0.20 | 16 | — | — | — |
| LBY138 | 92076.2 | — | — | — | 13.1 | 0.24 | 18 | — | — | — |
| LBY117 | 91366.3 | — | — | — | — | — | — | 6.07 | 0.10 | 7 |
| LBY112 | 92051.3 | — | — | — | 12.7 | 0.04 | 14 | — | — | — |
| LBY112 | 92053.4 | — | — | — | 13.2 | 0.01 | 19 | 6.07 | 0.24 | 7 |
| LBY108 | 91423.1 | 0.226 | 0.08 | 18 | 14.2 | L | 28 | 6.39 | L | 12 |
| LBY108 | 91423.6 | — | — | — | 12.4 | 0.08 | 12 | 5.94 | 0.22 | 4 |
| LBY108 | 91424.1 | 0.219 | 0.19 | 14 | — | — | — | — | — | — |
| LBY104 | 91269.1 | 0.232 | 0.23 | 21 | — | — | — | — | — | — |
| LBY104 | 91269.2 | 0.217 | 0.20 | 13 | 15.1 | 0.06 | 36 | 6.54 | 0.23 | 15 |
| CONT. | — | 0.192 | — | — | 11.1 | — | — | 5.68 | — | — |

Table 251. "CONT."—Control; "Ave."—Average; "% Incr." = % increment; "p-val."—p-value, L-p < 0.01.

TABLE 252

Genes showing improved plant performance at Drought growth conditions under regulation of At6669 promoter

| Gene Name | Event # | Seed Yield [mg] Ave. | Seed Yield [mg] P-Val. | Seed Yield [mg] % Incr. | 1000 Seed Weight [mg] Ave. | 1000 Seed Weight [mg] P-Val. | 1000 Seed Weight [mg] % Incr. |
|---|---|---|---|---|---|---|---|
| LBY83 | 91330.1 | 203.5 | 0.27 | 13 | — | — | — |
| LBY83 | 91332.2 | 211.8 | 0.27 | 18 | — | — | — |
| LBY63 | 91325.1 | 198.6 | 0.02 | 10 | — | — | — |
| LBY63 | 91325.4 | 212.8 | 0.29 | 18 | — | — | — |
| LBY63 | 91329.3 | 198.4 | 0.04 | 10 | — | — | — |
| LBY51 | 90981.3 | — | — | — | 21.4 | 0.21 | 6 |
| LBY48 | 90967.3 | — | — | — | 21.1 | 0.12 | 4 |
| LBY224 | 91529.1 | — | — | — | 21.2 | 0.20 | 4 |
| LBY22 | 90961.2 | — | — | — | 24.5 | 0.02 | 21 |
| LBY150 | 91644.3 | — | — | — | 21.5 | 0.11 | 6 |
| LBY134 | 91281.5 | — | — | — | 20.8 | 0.25 | 2 |
| LBY134 | 91282.1 | — | — | — | 24.1 | 0.12 | 19 |
| LBY133 | 91139.1 | — | — | — | 21.1 | 0.05 | 4 |
| LBY102 | 91264.1 | 264.2 | 0.24 | 47 | — | — | — |
| CONT. | — | 180.0 | — | — | 20.3 | — | — |
| LBY96 | 92428.4 | — | — | — | 20.2 | 0.02 | 13 |
| LBY89 | 92259.2 | — | — | — | 18.9 | 0.28 | 6 |
| LBY87 | 92257.1 | — | — | — | 18.2 | 0.26 | 2 |
| LBY55 | 92422.5 | — | — | — | 19.4 | 0.28 | 9 |
| LBY55 | 92423.2 | — | — | — | 19.0 | L | 7 |
| LBY30 | 92324.4 | — | — | — | 19.8 | 0.28 | 11 |
| LBY30 | 92326.2 | — | — | — | 21.8 | 0.03 | 22 |
| LBY225 | 91607.3 | 235.5 | 0.16 | 14 | — | — | — |
| LBY225 | 91607.6 | — | — | — | 20.0 | 0.03 | 13 |
| LBY213 | 92030.2 | — | — | — | 18.7 | 0.05 | 5 |
| LBY213 | 92033.1 | 232.1 | 0.16 | 13 | — | — | — |
| LBY213 | 92033.3 | 228.5 | 0.29 | 11 | 18.8 | 0.03 | 5 |
| LBY212 | 92024.3 | 234.2 | 0.26 | 14 | — | — | — |
| LBY202 | 92022.1 | 242.8 | 0.07 | 18 | — | — | — |
| LBY202 | 92022.3 | — | — | — | 18.2 | 0.30 | 2 |
| LBY193 | 91660.2 | — | — | — | 21.6 | 0.03 | 21 |
| LBY193 | 91664.1 | 242.7 | 0.06 | 18 | 18.4 | 0.12 | 3 |
| LBY182 | 92396.2 | — | — | — | 18.8 | 0.03 | 6 |
| LBY174 | 92079.1 | 235.5 | 0.13 | 14 | — | — | — |
| LBY174 | 92079.7 | — | — | — | 18.8 | 0.11 | 5 |
| LBY174 | 92080.1 | 249.2 | 0.04 | 21 | — | — | — |
| LBY154 | 92433.5 | — | — | — | 19.2 | L | 8 |
| LBY146 | 91590.1 | 227.6 | 0.26 | 11 | — | — | — |
| LBY146 | 91590.2 | 233.0 | 0.28 | 13 | — | — | — |
| LBY146 | 91593.3 | — | — | — | 19.4 | 0.02 | 9 |
| LBY135 | 92322.1 | 239.5 | 0.08 | 16 | 19.4 | 0.01 | 9 |
| LBY135 | 92323.3 | — | — | — | 18.4 | 0.22 | 4 |
| LBY113 | 92234.2 | 225.5 | 0.28 | 10 | 18.8 | 0.03 | 6 |
| LBY113 | 92234.5 | 247.1 | 0.04 | 20 | 19.0 | 0.01 | 7 |
| LBY113 | 92234.6 | 247.5 | 0.09 | 20 | — | — | — |
| CONT. | — | 205.7 | — | — | 17.8 | — | — |
| LBY91 | 91630.1 | — | — | — | 21.1 | L | 8 |
| LBY91 | 91633.1 | 244.1 | 0.26 | 34 | 21.4 | L | 10 |
| LBY91 | 91633.2 | 240.4 | 0.17 | 32 | — | — | — |
| LBY91 | 91634.2 | 228.4 | 0.23 | 25 | — | — | — |
| LBY54 | 92084.4 | 241.9 | 0.29 | 33 | 20.5 | 0.08 | 5 |
| LBY54 | 92086.1 | 239.9 | 0.07 | 32 | — | — | — |
| LBY49 | 92043.7 | 198.4 | 0.28 | 9 | — | — | — |
| LBY35 | 92122.1 | — | — | — | 22.3 | L | 14 |
| LBY29 | 91617.1 | — | — | — | 21.3 | L | 9 |
| LBY29 | 91619.1 | — | — | — | 20.7 | 0.01 | 6 |
| LBY29 | 91619.2 | — | — | — | 20.7 | 0.02 | 6 |
| LBY25 | 91335.2 | — | — | — | 21.3 | 0.06 | 9 |
| LBY230 | 91669.3 | 250.4 | L | 37 | 20.2 | 0.10 | 4 |
| LBY225 | 91605.3 | 223.7 | 0.21 | 23 | — | — | — |
| LBY225 | 91607.2 | — | — | — | 20.3 | 0.29 | 4 |
| LBY225 | 91607.3 | 210.1 | 0.16 | 15 | — | — | — |
| LBY225 | 91607.6 | 247.0 | L | 35 | 21.8 | 0.08 | 12 |
| LBY217 | 92359.1 | — | — | — | 20.0 | 0.24 | 2 |
| LBY217 | 92362.2 | — | — | — | 20.0 | 0.24 | 2 |
| LBY217 | 92363.1 | — | — | — | 22.0 | L | 13 |
| LBY212 | 92026.3 | — | — | — | 20.5 | 0.04 | 5 |
| LBY202 | 92022.2 | — | — | — | 24.2 | 0.22 | 24 |
| LBY193 | 91660.2 | — | — | — | 24.0 | L | 23 |
| LBY182 | 92396.1 | 242.8 | L | 33 | — | — | — |

TABLE 252-continued

Genes showing improved plant performance at Drought growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| LBY182 | 92396.4 | — | — | — | 20.1 | 0.21 | 3 |
| LBY182 | 92398.2 | 220.8 | 0.21 | 21 | — | — | — |
| LBY136 | 91442.8 | 228.5 | 0.02 | 25 | — | — | — |
| LBY118 | 91432.3 | 214.4 | 0.06 | 18 | — | — | — |
| LBY118 | 91433.1 | 210.4 | 0.14 | 15 | — | — | — |
| LBY118 | 91434.5 | — | — | — | 20.4 | 0.15 | 5 |
| CONT. | — | 182.5 | — | — | 19.5 | — | — |
| LBY91 | 91630.1 | — | — | — | 23.2 | L | 21 |
| LBY91 | 91633.1 | 219.2 | 0.19 | 16 | — | — | — |
| LBY81 | 92009.1 | — | — | — | 21.0 | 0.26 | 10 |
| LBY81 | 92013.2 | — | — | — | 21.0 | L | 10 |
| LBY77 | 92061.1 | 209.5 | 0.28 | 10 | | | |
| LBY54 | 92086.1 | — | — | — | 19.6 | 0.29 | 3 |
| LBY49 | 92039.4 | — | — | — | 21.3 | 0.04 | 11 |
| LBY29 | 91619.1 | 219.8 | 0.07 | 16 | — | — | — |
| LBY174 | 92079.1 | 212.4 | 0.15 | 12 | — | — | — |
| LBY174 | 92079.7 | — | — | — | 19.8 | 0.18 | 4 |
| LBY146 | 91593.3 | — | — | — | 21.4 | 0.12 | 12 |
| LBY138 | 92076.1 | — | — | — | 21.1 | 0.13 | 10 |
| LBY117 | 91366.3 | — | — | — | 25.0 | L | 31 |
| LBY108 | 91423.1 | 219.9 | 0.14 | 16 | — | — | — |
| LBY108 | 91423.4 | — | — | — | 20.3 | 0.09 | 6 |
| LBY108 | 91424.1 | 217.3 | 0.05 | 14 | — | — | — |
| LBY104 | 91269.2 | 222.4 | 0.02 | 17 | — | — | — |
| CONT. | — | 189.8 | — | — | 19.1 | — | — |

Table 252. CONT-Control; Ave.- Average; % Incr. = % increment; p-val.- p-value, L-p < 0.01.

TABLE 253

Genes showing improved plant performance at Drought growth conditions under regulation of At6669 promoter

| Gene Name | Event # | 1000 Seed Weight [mg] | | |
|---|---|---|---|---|
| | | Ave. | P-Val. | % Incr. |
| LBY51 | 90981.3 | 21.4 | 0.21 | 6 |
| LBY48 | 90967.3 | 21.1 | 0.12 | 4 |
| LBY224 | 91529.1 | 21.2 | 0.20 | 4 |
| LBY22 | 90961.2 | 24.5 | 0.02 | 21 |
| LBY150 | 91644.3 | 21.5 | 0.11 | 6 |
| LBY134 | 91281.5 | 20.8 | 0.25 | 2 |
| LBY134 | 91282.1 | 24.1 | 0.12 | 19 |
| LBY133 | 91139.1 | 21.1 | 0.05 | 4 |
| CONT. | — | 20.3 | — | — |
| LBY96 | 92428.4 | 20.2 | 0.02 | 13 |
| LBY89 | 92259.2 | 18.9 | 0.28 | 6 |
| LBY87 | 92257.1 | 18.2 | 0.26 | 2 |
| LBY55 | 92422.5 | 19.4 | 0.28 | 9 |
| LBY55 | 92423.2 | 19.0 | L | 7 |
| LBY30 | 92324.4 | 19.8 | 0.28 | 11 |
| LBY30 | 92326.2 | 21.8 | 0.03 | 22 |
| LBY225 | 91607.6 | 20.0 | 0.03 | 13 |
| LBY213 | 92030.2 | 18.7 | 0.05 | 5 |
| LBY213 | 92033.3 | 18.8 | 0.03 | 5 |
| LBY202 | 92022.3 | 18.2 | 0.30 | 2 |
| LBY193 | 91660.2 | 21.6 | 0.03 | 21 |
| LBY193 | 91664.1 | 18.4 | 0.12 | 3 |
| LBY182 | 92396.2 | 18.8 | 0.03 | 6 |
| LBY174 | 92079.7 | 18.8 | 0.11 | 5 |
| LBY154 | 92433.5 | 19.2 | L | 8 |
| LBY146 | 91593.3 | 19.4 | 0.02 | 9 |
| LBY135 | 92322.1 | 19.4 | 0.01 | 9 |
| LBY135 | 92323.3 | 18.4 | 0.22 | 4 |
| LBY113 | 92234.2 | 18.8 | 0.03 | 6 |
| LBY113 | 92234.5 | 19.0 | 0.01 | 7 |
| CONT. | — | 17.8 | — | — |
| LBY91 | 91630.1 | 21.1 | L | 8 |
| LBY91 | 91633.1 | 21.4 | L | 10 |

TABLE 253-continued

Genes showing improved plant performance at Drought growth conditions under regulation of At6669 promoter

| Gene Name | Event # | 1000 Seed Weight [mg] | | |
|---|---|---|---|---|
| | | Ave. | P-Val. | % Incr. |
| LBY54 | 92084.4 | 20.5 | 0.08 | 5 |
| LBY35 | 92122.1 | 22.3 | L | 14 |
| LBY29 | 91617.1 | 21.3 | L | 9 |
| LBY29 | 91619.1 | 20.7 | 0.01 | 6 |
| LBY29 | 91619.2 | 20.7 | 0.02 | 6 |
| LBY25 | 91335.2 | 21.3 | 0.06 | 9 |
| LBY230 | 91669.3 | 20.2 | 0.10 | 4 |
| LBY225 | 91607.2 | 20.3 | 0.29 | 4 |
| LBY225 | 91607.6 | 21.8 | 0.08 | 12 |
| LBY217 | 92359.1 | 20.0 | 0.24 | 2 |
| LBY217 | 92362.2 | 20.0 | 0.24 | 2 |
| LBY217 | 92363.1 | 22.0 | L | 13 |
| LBY212 | 92026.3 | 20.5 | 0.04 | 5 |
| LBY202 | 92022.2 | 24.2 | 0.22 | 24 |
| LBY193 | 91660.2 | 24.0 | L | 23 |
| LBY182 | 92396.4 | 20.1 | 0.21 | 3 |
| LBY118 | 91434.5 | 20.4 | 0.15 | 5 |
| CONT. | — | 19.5 | — | — |
| LBY91 | 91630.1 | 23.2 | L | 21 |
| LBY81 | 92009.1 | 21.0 | 0.26 | 10 |
| LBY81 | 92013.2 | 21.0 | L | 10 |
| LBY54 | 92086.1 | 19.6 | 0.29 | 3 |
| LBY49 | 92039.4 | 21.3 | 0.04 | 11 |
| LBY174 | 92079.7 | 19.8 | 0.18 | 4 |
| LBY146 | 91593.3 | 21.4 | 0.12 | 12 |
| LBY138 | 92076.1 | 21.1 | 0.13 | 10 |
| LBY117 | 91366.3 | 25.0 | L | 31 |
| LBY108 | 91423.4 | 20.3 | 0.09 | 6 |
| CONT. | — | 19.1 | — | — |

Table 253. "CONT."—Control; "Ave."—Average; "% Incr." = % increment; "p-val."—p-value, L—p < 0.01.

TABLE 254

Genes showing improved plant performance at Drought growth conditions under regulation of 6669 promoter

| Gene Name | Event # | Harvest Index | | |
|---|---|---|---|---|
| | | Ave. | P-Val. | % Incr. |
| LBY83 | 91330.1 | 0.204 | 0.10 | 20 |
| LBY63 | 91325.1 | 0.186 | 0.05 | 9 |
| LBY63 | 91325.2 | 0.192 | 0.03 | 13 |
| LBY63 | 91325.4 | 0.197 | 0.10 | 16 |
| LBY102 | 91262.8 | 0.192 | 0.07 | 13 |
| LBY102 | 91264.1 | 0.241 | 0.07 | 41 |
| CONT. | — | 0.170 | — | — |
| LBY213 | 92033.1 | 0.280 | 0.04 | 24 |
| LBY212 | 92024.2 | 0.259 | 0.19 | 15 |
| LBY202 | 92022.1 | 0.256 | 0.21 | 14 |
| LBY193 | 91664.1 | 0.265 | 0.12 | 18 |
| LBY174 | 92080.1 | 0.270 | 0.12 | 20 |
| LBY135 | 92321.6 | 0.255 | 0.25 | 13 |
| LBY135 | 92322.1 | 0.265 | 0.23 | 17 |
| LBY113 | 92234.2 | 0.272 | 0.09 | 21 |
| LBY113 | 92234.5 | 0.277 | 0.06 | 23 |
| LBY113 | 92234.6 | 0.285 | 0.13 | 27 |
| CONT. | — | 0.225 | — | — |
| LBY91 | 91633.1 | 0.232 | 0.01 | 28 |
| LBY91 | 91633.2 | 0.237 | 0.04 | 31 |
| LBY91 | 91634.2 | 0.220 | 0.19 | 21 |
| LBY54 | 92086.1 | 0.221 | 0.03 | 22 |
| LBY230 | 91669.2 | 0.202 | 0.27 | 11 |
| LBY230 | 91669.3 | 0.243 | L | 34 |
| LBY225 | 91605.3 | 0.216 | 0.14 | 19 |
| LBY225 | 91607.2 | 0.199 | 0.25 | 10 |
| LBY225 | 91607.3 | 0.206 | 0.13 | 14 |
| LBY225 | 91607.6 | 0.245 | L | 35 |
| LBY182 | 92396.1 | 0.234 | L | 29 |

TABLE 254-continued

Genes showing improved plant performance at Drought growth conditions under regulation of 6669 promoter

| | | Harvest Index | | |
|---|---|---|---|---|
| Gene Name | Event # | Ave. | P-Val. | % Incr. |
| LBY182 | 92398.2 | 0.204 | 0.25 | 12 |
| LBY136 | 91442.8 | 0.208 | 0.14 | 15 |
| LBY118 | 91432.3 | 0.209 | 0.13 | 15 |
| CONT. | — | 0.181 | — | — |
| LBY91 | 91633.1 | 0.230 | 0.03 | 20 |
| LBY35 | 92119.2 | 0.208 | 0.26 | 8 |
| LBY29 | 91619.1 | 0.221 | 0.15 | 15 |
| LBY174 | 92079.1 | 0.223 | 0.14 | 16 |
| LBY146 | 91590.4 | 0.226 | 0.04 | 17 |
| LBY108 | 91423.1 | 0.226 | 0.08 | 18 |
| LBY108 | 91424.1 | 0.219 | 0.19 | 14 |
| LBY104 | 91269.1 | 0.232 | 0.23 | 21 |
| LBY104 | 91269.2 | 0.217 | 0.20 | 13 |
| CONT. | — | 0.192 | — | — |

Table 254. "CONT."—Control; "Ave."—Average; "% Incr." = % increment; "p-val."—p-value, L—p < 0.01.

Example 30

Evaluation of Transgenic *Arabidopsis* for Seed Yield and Plant Growth Rate Under Normal Conditions in Greenhouse Assays Until Bolting (GH-SB Assays)

Assay 2: Plant Performance Improvement Measured Until Bolting Stage: Plant Biomass and Plant Growth Rate in Greenhouse Conditions (GH-SB Assays)

Under normal (standard conditions)—This assay follows the plant biomass formation and the rosette area growth of plants grown in the greenhouse under normal growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:2 ratio. Plants were grown under normal conditions which included irrigation of the trays with a solution containing of 6 mM inorganic nitrogen in the form of $KNO_3$ with 1 mM $KH_2PO_4$, 1 mM $MgSO_4$, 1.5 mM $CaCl_2$ and microelements. Under normal conditions the plants grow in a controlled environment in a closed transgenic greenhouse; temperature was 18-22° C., humidity around 70%; Irrigation was done by flooding with a water solution containing 6 mM N (nitrogen) (as described hereinabove), and flooding was repeated whenever water loss reached 50%. All plants were grown in the greenhouse until bolting stage. Plant biomass (the above ground tissue) was weighted directly after harvesting the rosette (plant fresh weight [FW]). Following plants were dried in an oven at 50° C. for 48 hours and weighted (plant dry weight [DW]).

Under drought and standard growth conditions—This assay follows the plant biomass formation and the rosette area growth of plants grown in the greenhouse under drought conditions and standard growth conditions. Transgenic *Arabidopsis* seeds were sown in phytogel media supplemented with ½ MS medium and a selection agent (Kanamycin). The $T_2$ transgenic seedlings are then transplanted to 1.7 trays filled with peat and perlite in a 1:2 ratio and tuff at the bottom of the tray and a net below the trays (in order to facilitate water drainage). Half of the plants were irrigated with tap water (standard growth conditions) when tray weight reached 50% of its field capacity. The other half of the plants were irrigated with tap water when tray weight reached 20% of its field capacity in order to induce drought stress (drought conditions). All plants were grown in the greenhouse until bolting stage. At harvest, plant biomass (the above ground tissue) was weighted directly after harvesting the rosette (plant fresh weight [FW]). Thereafter, plants were dried in an oven at 50° C. for 48 hours and weighted (plant dry weight [DW]).

Under limited and optimal nitrogen concentration—This assay follows the plant biomass formation and the rosette area growth of plants grown in the greenhouse at limiting and non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing nitrogen limiting conditions, which were achieved by irrigating the plants with a solution containing 2.8 mM inorganic nitrogen in the form of $KNO_3$, supplemented with 1 mM $KH_2PO_4$, 1 mM $MgSO_4$, 1.5 mM $CaCl_2$ and microelements, while normal nitrogen levels were achieved by applying a solution of 5.5 mM inorganic nitrogen also in the form of $KNO_3$ with 1 mM $KH_2PO_4$, 1 mM $MgSO_4$, 1.5 mM $CaCl_2$ and microelements. All plants were grown in the greenhouse until mature seeds. Plant biomass (the above ground tissue) was weight in directly after harvesting the rosette (plant fresh weight [FW]). Following plants were dried in an oven at 50° C. for 48 hours and weighted (plant dry weight [DW]). Each construct was validated at its $T_2$ generation. Transgenic plants transformed with a construct conformed by an empty vector carrying a promoter and the selectable marker were used as control [The promoters which were used are described in Example 25 above, e.g., the At6669 promoter (SEQ ID NO: 10654) or the 35S promoter (SEQ ID NO: 10650].

Additionally or alternatively, Mock-transgenic plants expressing the uidA reporter gene (GUS-Intron) or with no gene at all, under the same promoter were used as control. The plants were analyzed for their overall size, growth rate, fresh weight and dry matter. Transgenic plants performance was compared to control plants grown in parallel under the same conditions. The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at rsbweb (dot) nih (dot) gov/]. Images were captured in resolution of 10 Mega Pixels (3888×2592 pixels)

and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number (Formula VIII, described above), rosette area (Formula IX described above) and plot coverage (Formula XI, described above) were calculated using the indicated formulas.

Plant Fresh and Dry weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical analyses—To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Experimental Results

Tables 255-263 summarize the observed phenotypes of transgenic plants expressing the genes constructs using the GH-SB Assays.

The genes listed in Tables 255-257 improved plant performance when grown at drought conditions. These genes produced larger plants with a larger photosynthetic area, biomass (fresh weight, dry weight, rosette diameter, rosette area and plot coverage), relative growth rate, blade relative area and petiole relative area. The genes were cloned under the regulation of a constitutive At6669 promoter (SEQ ID NO: 10654). The evaluation of each gene was performed by testing the performance of different number of events. Event with p-value <0.1 was considered statistically significant.

TABLE 255

Genes showing improved plant performance at Drought growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LBY98 | 91152.3 | — | — | — | — | — | — | 12.2 | 0.01 | 8 |
| LBY98 | 91152.8 | 300.6 | 0.29 | 6 | — | — | — | — | — | — |
| LBY94 | 92333.7 | — | — | — | — | — | — | 11.8 | 0.18 | 4 |
| LBY84 | 92212.2 | — | — | — | — | — | — | 12.2 | 0.04 | 8 |
| LBY84 | 92212.3 | — | — | — | — | — | — | 11.8 | 0.11 | 4 |
| LBY75 | 92094.2 | — | — | — | 3943.8 | 0.04 | 10 | — | — | — |
| LBY73 | 92388.1 | — | — | — | — | — | — | 12.4 | 0.02 | 10 |
| LBY69 | 92169.2 | 301.9 | 0.26 | 7 | — | — | — | 12.0 | 0.27 | 6 |
| LBY69 | 92171.1 | — | — | — | 3806.2 | 0.06 | 6 | — | — | — |
| LBY62 | 91400.5 | — | — | — | 3750.0 | 0.13 | 5 | 12.1 | 0.18 | 7 |
| LBY62 | 91401.3 | — | — | — | — | — | — | 12.4 | L | 9 |
| LBY58 | 91376.6 | — | — | — | — | — | — | 12.1 | 0.10 | 7 |
| LBY58 | 91378.2 | — | — | — | — | — | — | 12.4 | 0.14 | 9 |
| LBY28 | 92281.1 | — | — | — | — | — | — | 11.9 | 0.09 | 5 |
| LBY28 | 92281.3 | — | — | — | 4031.2 | L | 13 | — | — | — |
| LBY28 | 92283.2 | — | — | — | — | — | — | 11.9 | 0.05 | 5 |
| LBY218 | 92159.3 | — | — | — | — | — | — | 12.8 | 0.02 | 13 |
| LBY197 | 92399.1 | — | — | — | — | — | — | 12.1 | 0.06 | 7 |
| LBY195 | 92191.4 | — | — | — | 3943.8 | L | 10 | 12.4 | 0.23 | 9 |
| LBY195 | 92193.1 | — | — | — | — | — | — | 12.1 | 0.02 | 7 |
| LBY195 | 92193.2 | — | — | — | 3787.5 | 0.15 | 6 | 12.8 | 0.11 | 13 |
| LBY195 | 92193.3 | 305.0 | 0.22 | 8 | — | — | — | — | — | — |
| LBY190 | 91510.2 | — | — | — | — | — | — | 12.4 | 0.02 | 10 |
| LBY190 | 91513.2 | 328.8 | 0.02 | 16 | 4087.5 | 0.20 | 14 | 12.5 | 0.04 | 10 |
| LBY184 | 92145.2 | — | — | — | — | — | — | 12.6 | L | 11 |
| LBY184 | 92147.3 | — | — | — | 3925.0 | 0.24 | 10 | 12.5 | L | 10 |
| LBY184 | 92148.4 | — | — | — | — | — | — | 13.0 | 0.19 | 15 |
| LBY163 | 91481.2 | — | — | — | — | — | — | 12.2 | 0.01 | 8 |
| LBY163 | 91481.3 | — | — | — | — | — | — | 12.0 | 0.27 | 6 |
| LBY163 | 91484.3 | 324.4 | 0.06 | 15 | — | — | — | 12.1 | 0.06 | 7 |
| LBY160 | 92302.7 | — | — | — | — | — | — | 11.8 | 0.18 | 4 |
| LBY105 | 91385.1 | — | — | — | 3825.0 | 0.13 | 7 | 12.1 | 0.03 | 7 |
| LBY105 | 91385.2 | — | — | — | — | — | — | 11.9 | 0.24 | 5 |
| LBY105 | 91386.6 | — | — | — | 3818.8 | 0.22 | 7 | 12.3 | 0.10 | 9 |
| CONT. | — | 282.3 | — | — | 3575.0 | — | — | 11.3 | — | — |
| LBY94 | 92332.1 | 167.7 | 0.25 | 21 | — | — | — | — | — | — |
| LBY94 | 92333.2 | — | — | — | 1950.0 | 0.25 | 24 | 10.1 | 0.26 | 5 |
| LBY84 | 92210.3 | 159.4 | 0.24 | 15 | — | — | — | — | — | — |
| LBY84 | 92212.3 | 162.5 | 0.14 | 17 | 1812.5 | 0.17 | 15 | — | — | — |
| LBY84 | 92213.3 | 163.8 | 0.22 | 18 | 1856.2 | 0.11 | 18 | — | — | — |
| LBY75 | 92094.1 | 162.5 | 0.14 | 17 | 1956.2 | 0.06 | 24 | 10.2 | 0.27 | 6 |
| LBY75 | 92094.2 | 166.2 | 0.10 | 20 | — | — | — | — | — | — |
| LBY75 | 92096.1 | 184.4 | 0.14 | 33 | 2093.8 | 0.02 | 33 | 10.8 | 0.14 | 13 |
| LBY73 | 92386.2 | 165.6 | 0.11 | 20 | 1743.8 | 0.30 | 11 | — | — | — |
| LBY73 | 92387.3 | — | — | — | 2125.0 | 0.10 | 35 | 10.8 | 0.02 | 13 |
| LBY73 | 92388.1 | 218.1 | 0.11 | 58 | 2187.5 | 0.02 | 39 | 11.2 | 0.03 | 16 |

TABLE 255-continued

Genes showing improved plant performance at Drought growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LBY69 | 92169.3 | — | — | — | 2181.2 | 0.01 | 39 | 11.2 | 0.01 | 17 |
| LBY66 | 92089.3 | 180.6 | 0.03 | 31 | 1943.8 | 0.05 | 24 | 10.5 | 0.03 | 9 |
| LBY66 | 92091.1 | 171.9 | 0.10 | 24 | 2168.8 | 0.05 | 38 | — | — | — |
| LBY66 | 92093.3 | — | — | — | — | — | — | 10.2 | 0.09 | 7 |
| LBY62 | 91400.5 | — | — | — | — | — | — | 10.0 | 0.29 | 4 |
| LBY62 | 91401.3 | — | — | — | 1837.5 | 0.17 | 17 | 10.2 | 0.18 | 7 |
| LBY58 | 91376.5 | 180.0 | 0.09 | 30 | 2318.8 | L | 47 | 10.6 | 0.11 | 10 |
| LBY58 | 91376.6 | — | — | — | — | — | — | 10.5 | 0.04 | 9 |
| LBY58 | 91378.2 | 166.9 | 0.15 | 21 | 2112.5 | 0.01 | 34 | 10.4 | 0.06 | 9 |
| LBY45 | 92194.6 | — | — | — | — | — | — | 10.1 | 0.26 | 5 |
| LBY45 | 92197.3 | — | — | — | 1750.0 | 0.28 | 11 | — | — | — |
| LBY37 | 91217.1 | — | — | — | — | — | — | 10.4 | 0.15 | 9 |
| LBY37 | 91218.2 | — | — | — | 2337.5 | 0.05 | 49 | 11.6 | L | 20 |
| LBY28 | 92281.3 | 181.2 | 0.02 | 31 | 2187.5 | 0.04 | 39 | 10.6 | 0.02 | 11 |
| LBY211 | 92411.1 | — | — | — | 1788.4 | 0.23 | 14 | — | — | — |
| LBY211 | 92412.1 | 186.9 | 0.02 | 35 | 2050.0 | 0.02 | 30 | 10.6 | 0.11 | 10 |
| LBY206 | 92350.3 | 160.6 | 0.20 | 16 | 1918.8 | 0.15 | 22 | 10.4 | 0.25 | 9 |
| LBY206 | 92350.4 | — | — | — | 1843.8 | 0.15 | 17 | — | — | — |
| LBY206 | 92351.1 | 174.4 | 0.12 | 26 | 1975.0 | 0.03 | 26 | 10.8 | 0.14 | 13 |
| LBY206 | 92353.2 | — | — | — | 1950.0 | 0.25 | 24 | — | — | — |
| LBY199 | 92307.1 | 189.4 | 0.01 | 37 | 2200.0 | 0.16 | 40 | 10.8 | 0.06 | 13 |
| LBY199 | 92308.1 | — | — | — | 2156.2 | 0.04 | 37 | 10.8 | 0.04 | 12 |
| LBY176 | 92509.2 | 190.7 | 0.01 | 38 | 2185.7 | L | 39 | 10.2 | 0.18 | 7 |
| LBY176 | 92511.2 | 165.0 | 0.14 | 19 | 1806.2 | 0.17 | 15 | 10.2 | 0.12 | 6 |
| LBY176 | 92512.1 | 174.4 | 0.05 | 26 | 2043.8 | 0.05 | 30 | 10.1 | 0.18 | 5 |
| LBY164 | 92669.4 | — | — | — | — | — | — | 10.2 | 0.10 | 7 |
| LBY151 | 92651.2 | — | — | — | 1825.0 | 0.17 | 16 | 10.8 | L | 13 |
| LBY151 | 92651.3 | — | — | — | 1837.5 | 0.14 | 17 | — | — | — |
| LBY143 | 91470.4 | 177.5 | 0.09 | 28 | 2031.2 | 0.20 | 29 | 10.2 | 0.27 | 6 |
| LBY143 | 91470.7 | — | — | — | — | — | — | 10.5 | 0.04 | 9 |
| LBY143 | 91470.8 | — | — | — | 1956.2 | 0.07 | 24 | 10.9 | L | 13 |
| LBY143 | 91473.2 | — | — | — | 1825.0 | 0.21 | 16 | — | — | — |
| CONT. | — | 138.3 | — | — | 1572.4 | — | — | 9.61 | — | — |
| LBY99 | 91635.3 | — | — | — | — | — | — | 10.6 | 0.01 | 8 |
| LBY99 | 91635.4 | — | — | — | 2756.2 | 0.11 | 26 | — | — | — |
| LBY99 | 91635.5 | 220.5 | 0.18 | 29 | 2730.4 | 0.08 | 25 | 10.4 | 0.02 | 6 |
| LBY99 | 91636.1 | 195.6 | 0.05 | 14 | 2926.8 | 0.01 | 34 | — | — | — |
| LBY99 | 91636.4 | — | — | — | — | — | — | 10.2 | 0.08 | 4 |
| LBY66 | 92093.1 | 191.9 | 0.16 | 12 | — | — | — | 10.2 | 0.08 | 4 |
| LBY66 | 92093.3 | 218.8 | L | 28 | 3006.2 | L | 37 | — | — | — |
| LBY218 | 92159.1 | 200.0 | 0.26 | 17 | — | — | — | — | — | — |
| LBY218 | 92159.3 | 196.9 | 0.18 | 15 | 2881.2 | 0.02 | 32 | — | — | — |
| LBY218 | 92160.3 | 196.9 | 0.07 | 15 | — | — | — | — | — | — |
| LBY218 | 92162.3 | 197.5 | 0.15 | 15 | — | — | — | 10.4 | 0.09 | 6 |
| LBY211 | 92409.1 | 191.2 | 0.05 | 12 | — | — | — | — | — | — |
| LBY211 | 92412.1 | 195.6 | 0.05 | 14 | — | — | — | — | — | — |
| LBY205 | 92164.1 | — | — | — | 2593.8 | 0.21 | 18 | — | — | — |
| LBY199 | 92306.2 | 186.2 | 0.14 | 9 | — | — | — | — | — | — |
| LBY197 | 92399.1 | 199.4 | 0.12 | 16 | — | — | — | — | — | — |
| LBY195 | 92191.4 | 205.6 | 0.05 | 20 | — | — | — | — | — | — |
| LBY195 | 92192.2 | 193.1 | 0.02 | 13 | — | — | — | — | — | — |
| LBY195 | 92193.2 | 196.2 | 0.28 | 15 | — | — | — | 10.4 | 0.06 | 6 |
| LBY195 | 92193.3 | — | — | — | 2818.8 | 0.02 | 29 | — | — | — |
| LBY190 | 91510.2 | 181.2 | 0.24 | 6 | — | — | — | — | — | — |
| LBY190 | 91513.2 | 198.8 | 0.10 | 16 | — | — | — | 10.3 | 0.06 | 5 |
| LBY184 | 92147.3 | 209.4 | L | 22 | — | — | — | 10.8 | 0.08 | 9 |
| LBY184 | 92148.3 | — | — | — | 2455.4 | 0.25 | 12 | — | — | — |
| LBY176 | 92509.2 | — | — | — | — | — | — | 10.3 | 0.15 | 5 |
| LBY176 | 92510.1 | 200.0 | L | 17 | — | — | — | 10.6 | 0.10 | 8 |
| LBY176 | 92512.1 | 187.5 | 0.21 | 10 | — | — | — | — | — | — |
| LBY164 | 92669.4 | 191.9 | 0.03 | 12 | — | — | — | — | — | — |
| LBY164 | 92670.2 | 197.5 | 0.15 | 15 | — | — | — | — | — | — |
| LBY163 | 91482.2 | — | — | — | — | — | — | 10.5 | 0.14 | 7 |
| LBY163 | 91484.3 | 198.8 | 0.28 | 16 | — | — | — | — | — | — |
| LBY163 | 91484.6 | 220.0 | L | 29 | 2981.2 | L | 36 | — | — | — |
| LBY160 | 92302.6 | — | — | — | 2581.2 | 0.12 | 18 | — | — | — |
| LBY160 | 92302.7 | 200.0 | 0.29 | 17 | — | — | — | — | — | — |
| LBY151 | 92649.1 | 208.1 | L | 22 | 2606.2 | 0.26 | 19 | — | — | — |
| LBY143 | 91470.4 | 187.5 | 0.07 | 10 | 2556.2 | 0.14 | 17 | — | — | — |
| LBY143 | 91472.1 | 213.1 | L | 24 | — | — | — | — | — | — |
| LBY105 | 91386.6 | 190.0 | 0.04 | 11 | 2737.5 | 0.04 | 25 | — | — | — |
| LBY105 | 91388.1 | 188.1 | 0.22 | 10 | — | — | — | — | — | — |

TABLE 255-continued

Genes showing improved plant performance at Drought growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LBY100 | 91410.3 | 211.2 | 0.29 | 23 | — | — | — | 10.5 | 0.03 | 7 |
| LBY100 | 91410.4 | — | — | — | 2437.5 | 0.28 | 11 | — | — | — |
| LBY100 | 91410.6 | 183.1 | 0.16 | 7 | — | — | — | — | — | — |
| CONT. | — | 171.2 | — | — | 2190.0 | — | — | 9.82 | — | — |
| LBY47 | 91626.1 | — | — | — | — | — | — | 12.1 | 0.28 | 4 |
| LBY18 | 91298.3 | — | — | — | — | — | — | 12.2 | 0.29 | 5 |
| LBY16 | 91595.2 | 210.6 | 0.25 | 10 | — | — | — | — | — | — |
| LBY16 | 91595.3 | — | — | — | — | — | — | 12.2 | 0.12 | 5 |
| CONT. | — | 191.1 | — | — | — | — | — | 11.6 | — | — |

Table 255. CONT-Control; Ave.-Average; % Incr. = % increment; p-val.-p-value, L-p < 0.01.

TABLE 256

Genes showing improved plant performance at Drought growth conditions under regulation of At6669 promoter

| Gene Name | Event # | Plot Coverage [cm$^2$] | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY62 | 91400.5 | — | — | — | — | — | — | 5.20 | 0.22 | 8 |
| LBY62 | 91401.3 | 72.7 | 0.14 | 11 | 9.09 | 0.14 | 11 | — | — | — |
| LBY58 | 91378.2 | 76.2 | 0.04 | 16 | 9.52 | 0.04 | 16 | 4.97 | 0.27 | 3 |
| LBY28 | 92281.1 | 71.4 | 0.24 | 9 | 8.92 | 0.24 | 9 | — | — | — |
| LBY195 | 92193.1 | 81.8 | 0.21 | 25 | 10.2 | 0.21 | 25 | 5.26 | 0.25 | 9 |
| LBY195 | 92193.2 | 79.1 | 0.07 | 21 | 9.89 | 0.07 | 21 | 5.19 | 0.23 | 8 |
| LBY190 | 91510.2 | 75.0 | 0.08 | 15 | 9.37 | 0.08 | 15 | 5.06 | 0.08 | 5 |
| LBY190 | 91513.2 | 88.3 | 0.10 | 35 | 11.0 | 0.10 | 35 | 5.41 | 0.22 | 12 |
| LBY184 | 92145.2 | 83.3 | 0.01 | 27 | 10.4 | 0.01 | 27 | 5.25 | L | 9 |
| LBY184 | 92147.3 | 87.0 | 0.21 | 33 | 10.9 | 0.21 | 33 | — | — | — |
| LBY184 | 92148.4 | 79.4 | 0.15 | 21 | 9.92 | 0.15 | 21 | 5.16 | 0.26 | 7 |
| LBY163 | 91481.2 | 70.6 | 0.27 | 8 | 8.83 | 0.27 | 8 | — | — | — |
| LBY163 | 91481.3 | 80.8 | 0.02 | 23 | 10.1 | 0.02 | 23 | 5.29 | 0.04 | 10 |
| LBY163 | 91482.3 | 73.6 | 0.10 | 12 | 9.19 | 0.10 | 12 | 5.14 | 0.27 | 7 |
| LBY163 | 91484.3 | 92.3 | 0.03 | 41 | 11.5 | 0.03 | 41 | 5.77 | L | 20 |
| LBY105 | 91385.1 | 80.9 | 0.02 | 24 | 10.1 | 0.02 | 24 | 5.21 | 0.02 | 8 |
| CONT. | — | 65.5 | — | — | 8.18 | — | — | 4.81 | — | — |
| LBY94 | 92333.2 | 62.3 | 0.10 | 34 | 7.79 | 0.10 | 34 | 4.92 | 0.05 | 15 |
| LBY84 | 92213.3 | 56.6 | 0.09 | 22 | 7.07 | 0.09 | 22 | 4.57 | 0.25 | 7 |
| LBY75 | 92094.1 | 56.7 | 0.20 | 22 | 7.09 | 0.20 | 22 | 4.71 | 0.16 | 10 |
| LBY75 | 92094.2 | 53.9 | 0.20 | 16 | 6.74 | 0.20 | 16 | 4.60 | 0.20 | 8 |
| LBY75 | 92096.1 | 66.5 | L | 43 | 8.31 | L | 43 | 5.08 | 0.01 | 19 |
| LBY73 | 92387.3 | 62.3 | 0.14 | 34 | 7.79 | 0.14 | 34 | 4.86 | 0.19 | 14 |
| LBY73 | 92388.1 | 66.6 | 0.04 | 44 | 8.32 | 0.04 | 44 | 5.09 | 0.04 | 19 |
| LBY69 | 92169.3 | 72.7 | L | 57 | 9.08 | L | 57 | 5.19 | L | 21 |
| LBY66 | 92089.3 | 57.2 | 0.09 | 23 | 7.15 | 0.09 | 23 | 4.75 | 0.08 | 11 |
| LBY66 | 92091.1 | 66.1 | 0.06 | 43 | 8.27 | 0.06 | 43 | 5.15 | 0.04 | 20 |
| LBY66 | 92093.1 | — | — | — | — | — | — | 4.57 | 0.28 | 7 |
| LBY66 | 92093.3 | 60.1 | 0.09 | 30 | 7.51 | 0.09 | 30 | 5.00 | 0.16 | 17 |
| LBY62 | 91400.3 | 56.6 | 0.08 | 22 | 7.08 | 0.08 | 22 | 4.66 | 0.14 | 9 |
| LBY62 | 91401.3 | 61.9 | 0.03 | 33 | 7.73 | 0.03 | 33 | 4.87 | 0.07 | 14 |
| LBY58 | 91376.5 | 70.4 | L | 52 | 8.80 | L | 52 | 5.33 | L | 25 |
| LBY58 | 91376.6 | 53.3 | 0.28 | 15 | 6.66 | 0.28 | 15 | 4.57 | 0.27 | 7 |
| LBY58 | 91378.2 | 65.8 | 0.01 | 42 | 8.23 | 0.01 | 42 | 5.05 | 0.03 | 18 |
| LBY45 | 92194.6 | 56.4 | 0.11 | 22 | 7.05 | 0.11 | 22 | 4.84 | 0.13 | 13 |
| LBY45 | 92197.3 | 63.7 | 0.01 | 37 | 7.96 | 0.01 | 37 | 4.98 | 0.02 | 16 |
| LBY37 | 91217.1 | 52.3 | 0.28 | 13 | 6.54 | 0.28 | 13 | — | — | — |
| LBY37 | 91218.2 | 73.8 | L | 59 | 9.22 | L | 59 | 5.20 | L | 22 |
| LBY28 | 92281.3 | 66.5 | 0.14 | 43 | 8.31 | 0.14 | 43 | 5.14 | 0.26 | 20 |
| LBY211 | 92412.1 | 66.8 | L | 44 | 8.35 | L | 44 | 5.00 | 0.02 | 17 |
| LBY206 | 92350.3 | 61.9 | 0.09 | 33 | 7.74 | 0.09 | 33 | 4.90 | 0.06 | 15 |
| LBY206 | 92350.4 | 53.3 | 0.27 | 15 | 6.66 | 0.27 | 15 | 4.72 | 0.13 | 10 |
| LBY206 | 92351.1 | 65.1 | L | 40 | 8.14 | L | 40 | 5.02 | 0.02 | 17 |
| LBY206 | 92353.2 | — | — | — | — | — | — | 4.79 | 0.26 | 12 |
| LBY199 | 92307.1 | 71.0 | 0.15 | 53 | 8.87 | 0.15 | 53 | 5.29 | 0.16 | 24 |
| LBY176 | 92509.1 | 52.6 | 0.27 | 14 | 6.58 | 0.27 | 14 | 4.54 | 0.29 | 6 |
| LBY176 | 92509.2 | 61.9 | 0.02 | 34 | 7.74 | 0.02 | 34 | 4.90 | 0.03 | 15 |
| LBY176 | 92511.2 | 52.4 | 0.27 | 13 | 6.54 | 0.27 | 13 | 4.61 | 0.19 | 8 |

TABLE 256-continued

Genes showing improved plant performance at Drought growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY176 | 92512.1 | 60.4 | 0.06 | 30 | 7.55 | 0.06 | 30 | 4.82 | 0.05 | 13 |
| LBY151 | 92651.2 | 60.9 | 0.06 | 31 | 7.61 | 0.06 | 31 | 4.74 | 0.22 | 11 |
| LBY151 | 92651.3 | 54.9 | 0.24 | 18 | 6.86 | 0.24 | 18 | 4.68 | 0.21 | 10 |
| LBY143 | 91470.4 | 69.6 | 0.03 | 50 | 8.70 | 0.03 | 50 | 5.12 | 0.04 | 20 |
| LBY143 | 91470.7 | 60.1 | 0.05 | 30 | 7.51 | 0.05 | 30 | 4.80 | 0.06 | 12 |
| LBY143 | 91470.8 | 68.5 | 0.01 | 48 | 8.57 | 0.01 | 48 | 5.02 | 0.03 | 18 |
| LBY143 | 91473.2 | — | — | — | — | — | — | 4.59 | 0.23 | 7 |
| CONT. | — | 46.4 | — | — | 5.79 | — | — | 4.27 | — | — |
| LBY99 | 91635.3 | 46.4 | 0.19 | 16 | 5.80 | 0.19 | 16 | — | — | — |
| LBY99 | 91635.4 | 49.0 | 0.08 | 23 | 6.12 | 0.08 | 23 | 4.31 | 0.25 | 7 |
| LBY99 | 91635.5 | 56.5 | 0.08 | 42 | 7.07 | 0.08 | 42 | 4.87 | 0.07 | 21 |
| LBY66 | 92093.1 | 47.3 | L | 19 | 5.91 | L | 19 | 4.45 | L | 10 |
| LBY66 | 92093.3 | 56.4 | L | 42 | 7.05 | L | 42 | 4.72 | 0.01 | 17 |
| LBY66 | 92093.5 | 42.6 | 0.15 | 7 | 5.32 | 0.15 | 7 | 4.29 | 0.09 | 7 |
| LBY218 | 92159.1 | 48.6 | 0.03 | 22 | 6.07 | 0.03 | 22 | 4.47 | L | 11 |
| LBY218 | 92159.3 | — | — | — | — | — | — | 4.57 | 0.26 | 13 |
| LBY218 | 92162.3 | 54.3 | 0.05 | 36 | 6.78 | 0.05 | 36 | 4.76 | 0.11 | 18 |
| LBY211 | 92409.1 | 42.7 | 0.13 | 7 | 5.33 | 0.13 | 7 | 4.19 | 0.19 | 4 |
| LBY211 | 92412.1 | 46.2 | 0.12 | 16 | 5.77 | 0.12 | 16 | 4.38 | 0.06 | 9 |
| LBY205 | 92164.3 | 46.7 | 0.07 | 17 | 5.83 | 0.07 | 17 | 4.31 | 0.16 | 7 |
| LBY199 | 92306.2 | 49.5 | 0.05 | 24 | 6.19 | 0.05 | 24 | 4.50 | 0.10 | 12 |
| LBY199 | 92308.1 | — | — | — | — | — | — | 4.23 | 0.09 | 5 |
| LBY197 | 92399.1 | 47.5 | 0.02 | 19 | 5.94 | 0.02 | 19 | 4.49 | L | 11 |
| LBY195 | 92191.4 | 47.5 | 0.10 | 19 | 5.94 | 0.10 | 19 | 4.41 | 0.10 | 10 |
| LBY195 | 92193.2 | 53.4 | L | 34 | 6.68 | L | 34 | 4.65 | L | 15 |
| LBY195 | 92193.3 | 53.2 | 0.08 | 33 | 6.65 | 0.08 | 33 | 4.60 | 0.08 | 14 |
| LBY190 | 91510.2 | — | — | — | — | — | — | 4.15 | 0.25 | 3 |
| LBY190 | 91513.2 | 59.9 | L | 50 | 7.49 | L | 50 | 4.87 | L | 21 |
| LBY190 | 91513.3 | 50.2 | 0.05 | 26 | 6.27 | 0.05 | 26 | 4.43 | 0.11 | 10 |
| LBY184 | 92147.3 | 57.9 | 0.03 | 45 | 7.24 | 0.03 | 45 | 4.78 | L | 19 |
| LBY184 | 92148.1 | 47.2 | 0.04 | 18 | 5.90 | 0.04 | 18 | 4.38 | 0.07 | 9 |
| LBY176 | 92509.2 | 50.5 | 0.19 | 27 | 6.31 | 0.19 | 27 | — | — | — |
| LBY176 | 92510.1 | 53.7 | 0.06 | 35 | 6.71 | 0.06 | 35 | 4.63 | L | 15 |
| LBY176 | 92512 .1 | — | — | — | — | — | — | 4.28 | 0.27 | 6 |
| LBY164 | 92669.1 | 43.0 | 0.30 | 8 | 5.38 | 0.30 | 8 | — | — | — |
| LBY163 | 91481.3 | 43.7 | 0.07 | 10 | 5.46 | 0.07 | 10 | — | — | — |
| LBY163 | 91482.2 | 52.3 | L | 31 | 6.54 | L | 31 | 4.51 | L | 12 |
| LBY163 | 91482.3 | 47.5 | L | 19 | 5.93 | L | 19 | 4.37 | 0.04 | 8 |
| LBY163 | 91484.6 | 54.4 | L | 37 | 6.81 | L | 37 | 4.80 | L | 19 |
| LBY160 | 92302.7 | 55.5 | 0.05 | 39 | 6.94 | 0.05 | 39 | 4.66 | 0.07 | 16 |
| LBY151 | 92649.1 | 58.6 | 0.05 | 47 | 7.32 | 0.05 | 47 | 4.93 | 0.07 | 22 |
| LBY143 | 91470 .4 | 50.2 | 0.22 | 26 | 6.28 | 0.22 | 26 | 4.50 | 0.27 | 12 |
| LBY143 | 91472.1 | 48.6 | L | 22 | 6.08 | L | 22 | 4.51 | 0.09 | 12 |
| LBY105 | 91386.6 | 42.9 | 0.11 | 8 | 5.36 | 0.11 | 8 | 4.16 | 0.21 | 3 |
| LBY105 | 91388.1 | 50.3 | 0.03 | 26 | 6.29 | 0.03 | 26 | 4.45 | 0.05 | 10 |
| LBY100 | 91410.6 | 44.6 | 0.03 | 12 | 5.58 | 0.03 | 12 | 4.17 | 0.23 | 3 |
| CONT. | — | 39.8 | — | — | 4.98 | — | — | 4.03 | — | — |
| LBY90 | 91193.1 | 99.3 | 0.14 | 23 | 12.4 | 0.14 | 23 | 6.48 | 0.08 | 17 |
| LBY47 | 91627.1 | 86.3 | 0.18 | 7 | 10.8 | 0.18 | 7 | — | — | — |
| LBY47 | 91628.1 | 89.7 | 0.14 | 11 | 11.2 | 0.14 | 11 | 5.84 | 0.21 | 5 |
| LBY45 | 92196.3 | 85.6 | 0.15 | 6 | 10.7 | 0.15 | 6 | 5.77 | 0.29 | 4 |
| LBY45 | 92197.3 | 97.9 | 0.04 | 21 | 12.2 | 0.04 | 21 | 6.26 | L | 13 |
| LBY222 | 91604.3 | 84.4 | 0.14 | 5 | 10.5 | 0.14 | 5 | 5.68 | 0.02 | 2 |
| LBY220 | 91306.4 | 84.9 | 0.27 | 5 | 10.6 | 0.27 | 5 | — | — | — |
| LBY194 | 91147.1 | 88.4 | 0.24 | 10 | 11.1 | 0.24 | 10 | — | — | — |
| LBY18 | 91297.1 | — | — | — | — | — | — | 6.18 | 0.18 | 11 |
| LBY18 | 91298.3 | 84.3 | 0.24 | 4 | 10.5 | 0.24 | 4 | 5.76 | L | 4 |
| LBY162 | 91809.4 | — | — | — | — | — | — | 5.80 | 0.03 | 4 |
| LBY16 | 91599.1 | 88.2 | 0.01 | 9 | 11.0 | 0.01 | 9 | — | — | — |
| LBY100 | 91410.3 | 95.1 | L | 18 | 11.9 | L | 18 | 6.11 | 0.09 | 10 |
| LBY100 | 91410.6 | 90.0 | 0.23 | 11 | 11.2 | 0.23 | 11 | — | — | — |
| CONT. | — | 80.7 | — | — | 10.1 | — | — | 5.56 | — | — |

Table 256. CONT.-Control; Ave.-Average; % Incr. = % increment; p-val.-p-value, L-p < 0.01.

TABLE 257

Genes showing improved plant performance at Drought growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY98 | 91152.3 | 0.699 | 0.18 | 27 | — | — | — | — | — | — |
| LBY94 | 92333.7 | 0.665 | 0.29 | 21 | — | — | — | — | — | — |
| LBY84 | 92212.3 | 0.671 | 0.28 | 22 | — | — | — | — | — | — |
| LBY75 | 92097.4 | 0.672 | 0.25 | 22 | — | — | — | — | — | — |
| LBY73 | 92388.1 | 0.666 | 0.28 | 21 | — | — | — | — | — | — |
| LBY69 | 92171.4 | 0.666 | 0.28 | 21 | — | — | — | — | — | — |
| LBY69 | 92172.2 | 0.695 | 0.18 | 26 | — | — | — | — | — | — |
| LBY62 | 91400.3 | 0.671 | 0.28 | 22 | — | — | — | — | — | — |
| LBY62 | 91401.3 | 0.672 | 0.26 | 22 | — | — | — | — | — | — |
| LBY58 | 91376.6 | 0.700 | 0.15 | 27 | — | — | — | — | — | — |
| LBY58 | 91377.1 | 0.669 | 0.27 | 21 | — | — | — | — | — | — |
| LBY58 | 91378.2 | 0.670 | 0.28 | 21 | — | — | — | — | — | — |
| LBY218 | 92159.3 | 0.720 | 0.14 | 31 | — | — | — | — | — | — |
| LBY197 | 92399.3 | 0.672 | 0.26 | 22 | — | — | — | — | — | — |
| LBY197 | 92403.4 | 0.667 | 0.26 | 21 | — | — | — | — | — | — |
| LBY195 | 92191.4 | 0.706 | 0.17 | 28 | — | — | — | — | — | — |
| LBY195 | 92193.1 | — | — | — | 9.70 | 0.16 | 27 | — | — | — |
| LBY195 | 92193.2 | 0.778 | 0.03 | 41 | 9.27 | 0.23 | 21 | — | — | — |
| LBY195 | 92193.3 | 0.697 | 0.17 | 26 | — | — | — | — | — | — |
| LBY190 | 91513.2 | — | — | — | 10.4 | 0.06 | 36 | — | — | — |
| LBY184 | 92145.2 | 0.748 | 0.06 | 36 | 9.80 | 0.12 | 28 | — | — | — |
| LBY184 | 9214.37 | — | — | — | 10.2 | 0.08 | 33 | — | — | — |
| LBY184 | 92148.1 | 0.687 | 0.21 | 25 | — | — | — | — | — | — |
| LBY184 | 92148.4 | — | — | — | 9.16 | 0.26 | 20 | — | — | — |
| LBY163 | 91481.3 | — | — | — | 9.36 | 0.20 | 22 | — | — | — |
| LBY163 | 91484.3 | — | — | — | 10.8 | 0.03 | 41 | 0.444 | 0.14 | 19 |
| LBY163 | 91484.6 | 0.713 | 0.13 | 29 | — | — | — | — | — | — |
| LBY160 | 92302.6 | 0.693 | 0.19 | 26 | — | — | — | — | — | — |
| LBY160 | 92302.7 | 0.698 | 0.18 | 27 | — | — | — | — | — | — |
| LBY105 | 91385.1 | — | — | — | 9.29 | 0.22 | 22 | — | — | — |
| LBY105 | 91386.6 | 0.718 | 0.11 | 30 | — | — | — | — | — | — |
| CONT. | — | 0.552 | — | — | 7.64 | — | — | 0.374 | — | — |
| LBY94 | 92333.2 | — | — | — | 7.91 | 0.13 | 35 | — | — | — |
| LBY75 | 92096.1 | 0.709 | 0.10 | 44 | 8.51 | 0.06 | 45 | 0.462 | 0.26 | 21 |
| LBY73 | 92387.3 | — | — | — | 7.86 | 0.14 | 34 | — | — | — |
| LBY73 | 92388.1 | 0.734 | 0.07 | 49 | 8.45 | 0.06 | 45 | — | — | — |
| LBY69 | 92169.3 | 0.726 | 0.07 | 48 | 9.31 | 0.02 | 59 | — | — | — |
| LBY66 | 92089.3 | 0.670 | 0.16 | 36 | 7.26 | 0.29 | 24 | — | — | — |
| LBY66 | 92091.1 | 0.649 | 0.24 | 32 | 8.47 | 0.06 | 45 | 0.463 | 0.26 | 21 |
| LBY66 | 92093.3 | — | — | — | 7.54 | 0.21 | 29 | — | — | — |
| LBY62 | 91401.3 | — | — | — | 7.78 | 0.16 | 33 | — | — | — |
| LBY58 | 91376.5 | — | — | — | 9.06 | 0.02 | 55 | 0.490 | 0.13 | 28 |
| LBY58 | 91378.2 | 0.660 | 0.20 | 34 | 8.42 | 0.06 | 44 | — | — | — |
| LBY45 | 92197.3 | — | — | — | 8.05 | 0.11 | 38 | — | — | — |
| LBY37 | 91217.1 | 0.624 | 0.30 | 27 | — | — | — | — | — | — |
| LBY37 | 91218.2 | 0.744 | 0.05 | 51 | 9.45 | 0.01 | 62 | 0.466 | 0.24 | 21 |
| LBY28 | 92281.3 | — | — | — | 8.46 | 0.07 | 45 | — | — | — |
| LBY211 | 92412.1 | 0.674 | 0.16 | 37 | 8.47 | 0.06 | 45 | — | — | — |
| LBY206 | 92350.3 | 0.650 | 0.22 | 32 | 7.79 | 0.15 | 33 | — | — | — |
| LBY206 | 92351.1 | 0.674 | 0.16 | 37 | 8.32 | 0.08 | 42 | — | — | — |
| LBY199 | 92307.1 | 0.625 | 0.29 | 27 | 9.10 | 0.03 | 56 | 0.476 | 0.21 | 24 |
| LBY199 | 92308.1 | — | — | — | 7.48 | 0.25 | 28 | — | — | — |
| LBY176 | 92509.2 | — | — | — | 7.82 | 0.15 | 34 | — | — | — |
| LBY176 | 92512.1 | — | — | — | 7.61 | 0.19 | 30 | — | — | — |
| LBY151 | 92651.2 | 0.625 | 0.29 | 27 | 7.62 | 0.19 | 30 | — | — | — |
| LBY143 | 91470.4 | — | — | — | 8.87 | 0.03 | 52 | — | — | — |
| LBY143 | 91470.7 | — | — | — | 7.56 | 0.20 | 29 | — | — | — |
| LBY143 | 91470.8 | 0.656 | 0.20 | 34 | 8.65 | 0.05 | 48 | — | — | — |
| CONT. | — | 0.491 | — | — | 5.85 | — | — | 0.383 | — | — |
| LBY99 | 91635.4 | — | — | — | 6.28 | 0.20 | 22 | — | — | — |
| LBY99 | 91635.5 | — | — | — | 7.36 | 0.02 | 43 | 0.470 | 0.07 | 20 |
| LBY66 | 92093.1 | — | — | — | 6.19 | 0.24 | 20 | 0.441 | 0.20 | 13 |
| LBY66 | 92093.3 | 0.787 | 0.06 | 27 | 7.28 | 0.02 | 41 | 0.449 | 0.16 | 15 |
| LBY218 | 92159.1 | — | — | — | 6.33 | 0.19 | 23 | — | — | — |
| LBY218 | 92159.3 | — | — | — | 6.59 | 0.13 | 28 | 0.442 | 0.24 | 13 |
| LBY218 | 92162.3 | — | — | — | 7.03 | 0.04 | 36 | 0.461 | 0.10 | 18 |
| LBY199 | 92306.2 | — | — | — | 6.44 | 0.15 | 25 | — | — | — |
| LBY197 | 92399.1 | — | — | — | 6.15 | 0.26 | 19 | — | — | — |
| LBY195 | 92191.4 | — | — | — | 6.15 | 0.27 | 19 | — | — | — |
| LBY195 | 92192.2 | — | — | — | 6.43 | 0.18 | 24 | — | — | — |
| LBY195 | 92193.1 | — | — | — | 6.19 | 0.29 | 20 | — | — | — |

TABLE 257-continued

Genes showing improved plant performance at Drought growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY195 | 92193.2 | — | — | — | 6.92 | 0.05 | 34 | 0.448 | 0.18 | 14 |
| LBY195 | 92193.3 | — | — | — | 6.85 | 0.07 | 33 | — | — | — |
| LBY190 | 91513.2 | — | — | — | 7.79 | L | 51 | 0.467 | 0.07 | 19 |
| LBY190 | 91513.3 | — | — | — | 6.50 | 0.14 | 26 | — | — | — |
| LBY184 | 92147.3 | — | — | — | 7.49 | 0.02 | 45 | 0.448 | 0.17 | 14 |
| LBY176 | 92509.2 | — | — | — | 6.52 | 0.15 | 26 | 0.438 | 0.27 | 12 |
| LBY176 | 92510.1 | — | — | — | 6.92 | 0.06 | 34 | 0.440 | 0.23 | 12 |
| LBY164 | 92670.2 | — | — | — | 6.29 | 0.23 | 22 | — | — | — |
| LBY163 | 91482.2 | — | — | — | 6.80 | 0.07 | 32 | — | — | — |
| LBY163 | 91482.3 | — | — | — | 6.17 | 0.25 | 20 | — | — | — |
| LBY163 | 91484.6 | — | — | — | 7.08 | 0.04 | 37 | 0.469 | 0.06 | 20 |
| LBY160 | 92302.7 | — | — | — | 7.24 | 0.03 | 40 | 0.446 | 0.18 | 14 |
| LBY151 | 92649.1 | — | — | — | 7.53 | 0.01 | 46 | 0.467 | 0.08 | 19 |
| LBY143 | 91470.4 | — | — | — | 6.46 | 0.15 | 25 | 0.441 | 0.24 | 13 |
| LBY143 | 91472.1 | — | — | — | 6.24 | 0.22 | 21 | — | — | — |
| LBY105 | 91388.1 | — | — | — | 6.50 | 0.14 | 26 | — | — | — |
| LBY100 | 91410.3 | — | — | — | 6.97 | 0.06 | 35 | — | — | — |
| CONT. | — | 0.618 | — | — | 5.16 | — | — | 0.392 | — | — |
| LBY90 | 91193.1 | — | — | — | 11.8 | 0.07 | 23 | 0.536 | 0.03 | 16 |
| LBY90 | 91193.4 | — | — | — | — | — | — | 0.479 | 0.28 | 4 |
| LBY47 | 91626.1 | — | — | — | — | — | — | 0.481 | 0.11 | 4 |
| LBY47 | 91627.1 | — | — | — | 10.2 | 0.14 | 6 | 0.480 | 0.20 | 4 |
| LBY4 | 91627.3 | 0.645 | 0.15 | 15 | — | — | — | — | — | — |
| LBY47 | 91628.1 | — | — | — | 10.7 | 0.10 | 11 | — | — | — |
| LBY45 | 92194.4 | — | — | — | — | — | — | 0.506 | 0.30 | 9 |
| LBY45 | 92196.3 | — | — | — | 10.2 | 0.21 | 6 | | | |
| LBY45 | 92197.3 | — | — | — | 11.6 | 0.02 | 21 | 0.514 | 0.11 | 11 |
| LBY221 | 91417.2 | 0.686 | 0.05 | 22 | — | — | — | — | — | — |
| LBY220 | 91305.3 | 0.641 | 0.19 | 14 | — | — | — | — | — | — |
| LBY194 | 91145.1 | 0.652 | 0.26 | 16 | — | — | — | — | — | — |
| LBY194 | 91147.1 | — | — | — | 10.6 | 0.20 | 11 | 0.498 | 0.28 | 8 |
| LBY18 | 91297.1 | — | — | — | — | — | — | 0.492 | 0.14 | 6 |
| LBY18 | 91298.3 | — | — | — | 9.99 | 0.26 | 4 | — | — | — |
| LBY162 | 91809.4 | — | — | — | — | — | — | 0.475 | 0.22 | 3 |
| LBY16 | 91599.1 | — | — | — | 10.4 | 0.02 | 9 | — | — | — |
| LBY129 | 91585.1 | 0.631 | 0.22 | 12 | — | — | — | — | — | — |
| LBY129 | 91589.1 | — | — | — | — | — | — | 0.477 | 0.11 | 3 |
| LBY100 | 91410.3 | — | — | — | 11.3 | 0.18 | 18 | 0.499 | 0.28 | 8 |
| LBY100 | 91410.6 | — | — | — | 10.7 | 0.13 | 11 | 0.473 | 0.27 | 2 |
| CONT. | — | 0.562 | — | — | 9.58 | — | — | 0.462 | — | — |

Table 257. CONT.-Control; Ave.-Average; % Incr. = % increment; p-val.- p-value, L-p < 0.01.

The genes listed in Tables 258-260 improved plant performance when grown at normal conditions. These genes produced larger plants with a larger photosynthetic area, biomass (fresh weight, dry weight, rosette diameter, rosette area and plot coverage), relative growth rate, blade relative area and petiole relative area. The genes were cloned under the regulation of a constitutive At6669 promoter (SEQ ID NO: 10654). The evaluation of each gene was performed by testing the performance of different number of events. Event with p-value <0.1 was considered statistically significant.

TABLE 258

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave | P-Val. | % Incr. |
| LGN43 | 89053.2 | — | — | — | — | — | — | 11.6 | 0.17 | 9 |
| CONT. | — | — | — | — | — | — | — | 10.6 | — | — |
| LGN44 | 89055.7 | — | — | — | 3258.3 | 0.21 | 8 | — | — | — |
| LGN44 | 89056.1 | — | — | — | 3220.8 | 0.20 | 7 | — | — | — |
| LGN44 | 89057.3 | — | — | — | 3129.2 | 0.27 | 4 | — | — | — |
| CONT. | — | — | — | — | 3008.3 | — | — | — | — | — |
| LGN40 | 90346.2 | — | — | — | — | — | — | 11.5 | 0.30 | 3 |
| CONT. | — | — | — | — | — | — | — | 11.2 | — | — |
| LGN20 | 89089.3 | — | — | — | 4583.3 | 0.26 | 7 | — | — | — |
| CONT. | — | — | — | — | 4270.8 | — | — | — | — | — |

TABLE 258-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave | P-Val. | % Incr. |
| LGN17 | 89028.4 | 361.7 | 0.13 | 7 | 5450.0 | 0.09 | 8 | — | — | — |
| CONT. | — | 338.1 | — | — | 5046.9 | — | — | — | — | — |
| LGN44 | 89055.2 | 381.7 | 0.22 | 4 | — | — | — | — | — | — |
| CONT. | — | 366.2 | — | — | — | — | — | — | — | — |
| LGN17 | 89027.1 | — | — | — | — | — | — | 12.3 | 0.05 | 10 |
| LGN17 | 89027.2 | 384.6 | 0.28 | 7 | 4798.2 | 0.08 | 8 | — | — | — |
| LGN17 | 89028.4 | 383.8 | 0.17 | 7 | 4879.2 | 0.05 | 10 | 12.5 | 0.02 | 12 |
| CONT. | — | 358.1 | — | — | 4431.2 | — | — | 11.2 | — | — |
| LBY90 | 91192.3 | — | — | — | — | — | — | 11.7 | 0.23 | 4 |
| LBY90 | 91193.4 | 277.5 | 0.14 | 24 | 2812.5 | 0.03 | 16 | — | — | — |
| LBY8 | 91185.1 | 257.6 | 0.18 | 15 | — | — | — | — | — | — |
| LBY59 | 91322.3 | 261.9 | 0.13 | 17 | 2850.0 | 0.01 | 17 | — | — | — |
| LBY57 | 90974.1 | — | — | — | — | — | — | 11.9 | 0.03 | 6 |
| LBY47 | 91627.1 | — | — | — | — | — | — | 11.9 | 0.06 | 5 |
| LBY47 | 91628.1 | — | — | — | — | — | — | 11.9 | 0.03 | 6 |
| LBY45 | 92197.3 | — | — | — | 2862.5 | 0.08 | 18 | — | — | — |
| LBY40 | 91310.1 | — | — | — | 2718.8 | 0.12 | 12 | 11.7 | 0.14 | 4 |
| LBY40 | 91310.2 | — | — | — | — | — | — | 11.6 | 0.28 | 3 |
| LBY228 | 91610.2 | — | — | — | — | — | — | 12.2 | 0.03 | 8 |
| LBY228 | 91610.4 | — | — | — | 2712.5 | 0.22 | 12 | 11.9 | 0.06 | 5 |
| LBY194 | 91149.2 | — | — | — | — | — | — | 11.6 | 0.28 | 3 |
| LBY18 | 91297.2 | 248.8 | 0.25 | 11 | — | — | — | — | — | — |
| LBY16 | 91599.3 | 251.2 | 0.27 | 12 | 2793.8 | 0.06 | 15 | — | — | — |
| LBY128 | 91439.6 | — | — | — | — | — | — | 11.9 | 0.08 | 6 |
| LBY100 | 91410.2 | — | — | — | — | — | — | 11.8 | 0.14 | 5 |
| LBY100 | 91410.3 | — | — | — | 2887.5 | 0.07 | 19 | — | — | — |
| LBY100 | 91410.4 | — | — | — | — | — | — | 11.7 | 0.14 | 4 |
| CONT. | — | 224.5 | — | — | 2430.4 | — | — | 11.3 | — | — |
| LGN61 | 89107.2 | — | — | — | 5204.2 | 0.28 | 3 | 12.7 | 0.15 | 3 |
| LGN61 | 89107.3 | 351.7 | 0.09 | 9 | 5341.7 | 0.24 | 6 | — | — | — |
| CONT. | — | 322.5 | — | — | 5037.5 | — | — | 12.4 | — | — |
| LGN20 | 89089.3 | 348.9 | 0.10 | 7 | — | — | — | — | — | — |
| LGN20 | 89091.4 | 347.5 | 0.25 | 6 | — | — | — | — | — | — |
| CONT. | — | 327.1 | — | — | — | — | — | — | — | — |
| LBY98 | 91152.5 | — | — | — | 7268.8 | 0.27 | 5 | 12.2 | 0.02 | 3 |
| LBY75 | 92094.1 | — | — | — | — | — | — | 12.1 | 0.16 | 2 |
| LBY218 | 92159.1 | — | — | — | — | — | — | 12.2 | 0.26 | 3 |
| LBY218 | 92159.3 | 521.9 | 0.22 | 8 | 7593.8 | 0.01 | 9 | — | — | — |
| LBY205 | 92167.4 | 511.9 | 0.07 | 6 | — | — | — | 12.2 | 0.26 | 3 |
| LBY195 | 92192.2 | 499.4 | 0.27 | 3 | — | — | — | — | — | — |
| LBY190 | 91513.2 | — | — | — | — | — | — | 12.5 | 0.03 | 6 |
| LBY163 | 91481.2 | — | — | — | 7575.0 | 0.17 | 9 | 12.8 | L | 8 |
| LBY163 | 91481.3 | 524.4 | 0.02 | 8 | 7156.2 | 0.29 | 3 | — | — | — |
| LBY163 | 91484.3 | 506.9 | 0.13 | 5 | 7487.5 | 0.03 | 8 | — | — | — |
| LBY160 | 92302.7 | 508.1 | 0.27 | 5 | — | — | — | — | — | — |
| LBY105 | 91385.2 | 511.2 | 0.08 | 6 | — | — | — | — | — | — |
| CONT. | — | 483.9 | — | — | 6955.4 | — | — | 11.8 | — | — |
| LGN40 | 90346.2 | 395.0 | 0.03 | 11 | 5885.1 | 0.04 | 9 | — | — | — |
| LGN40 | 90347.1 | 385.0 | 0.06 | 8 | — | — | — | — | — | — |
| CONT. | — | 356.7 | — | — | 5383.3 | — | — | — | — | — |
| LBY94 | 92332.1 | — | — | — | 2848.2 | 0.16 | 12 | — | — | — |
| LBY94 | 92333.2 | — | — | — | 2881.2 | 0.12 | 13 | — | — | — |
| LBY84 | 92212.3 | — | — | — | — | — | — | 10.2 | 0.24 | 4 |
| LBY84 | 92213.3 | — | — | — | 3000.0 | 0.10 | 18 | 10.8 | 0.01 | 9 |
| LBY75 | 92096.1 | — | — | — | 3131.2 | 0.09 | 23 | 10.9 | 0.01 | 10 |
| LBY73 | 92387.3 | — | — | — | 2912.5 | 0.22 | 15 | 11.5 | 0.01 | 16 |
| LBY73 | 92388.1 | 228.8 | 0.25 | 14 | 2787.5 | 0.26 | 10 | — | — | — |
| LBY69 | 9216.39 | 273.8 | 0.02 | 36 | 3137.5 | 0.05 | 23 | 11.5 | 0.30 | 16 |
| LBY66 | 92089.3 | — | — | — | — | — | — | 10.5 | 0.17 | 6 |
| LBY66 | 92091.1 | 229.4 | 0.28 | 14 | 2943.8 | 0.20 | 16 | 11.2 | L | 13 |
| LBY66 | 92093.1 | — | — | — | — | — | — | 10.2 | 0.29 | 3 |
| LBY66 | 92093.3 | 239.4 | 0.14 | 19 | 2975.0 | 0.26 | 17 | 10.8 | 0.12 | 9 |
| LBY62 | 91401.3 | — | — | — | — | — | — | 10.2 | 0.29 | 3 |
| LBY58 | 91376.5 | 256.2 | 0.05 | 27 | 3125.0 | 0.12 | 23 | 10.4 | 0.13 | 5 |
| LBY58 | 91378.2 | — | — | — | 3187.5 | 0.03 | 25 | 10.5 | 0.17 | 6 |
| LBY45 | 92196.3 | 229.4 | 0.27 | 14 | — | — | — | 10.3 | 0.15 | 4 |
| LBY45 | 92197.3 | — | — | — | — | — | — | 11.4 | 0.04 | 16 |
| LBY37 | 91217.1 | 240.6 | 0.20 | 20 | 2762.5 | 0.27 | 9 | — | — | — |
| LBY37 | 91218.2 | 231.4 | 0.26 | 15 | — | — | — | — | — | — |
| LBY211 | 92412.1 | 248.1 | 0.07 | 23 | 3406.2 | 0.08 | 34 | 11.0 | 0.04 | 11 |
| LBY206 | 92350.3 | — | — | — | 3093.8 | 0.03 | 22 | 10.4 | 0.14 | 6 |
| LBY199 | 92305.2 | — | — | — | — | — | — | 10.2 | 0.29 | 3 |

TABLE 258-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave | P-Val. | % Incr. |
| LBY199 | 92307.1 | — | — | — | 3018.8 | 0.04 | 19 | 10.6 | 0.24 | 7 |
| LBY199 | 92308.1 | 231.2 | 0.22 | 15 | 3212.5 | L | 26 | — | — | — |
| LBY176 | 92509.1 | — | — | — | — | — | — | 11.0 | 0.13 | 11 |
| LBY176 | 92509.2 | 246.9 | 0.08 | 23 | 3362.5 | 0.02 | 32 | 12.1 | L | 23 |
| LBY164 | 92670.4 | 251.9 | 0.16 | 25 | — | — | — | — | — | — |
| LBY151 | 92649.2 | — | — | — | 2787.5 | 0.22 | 10 | 10.4 | 0.10 | 5 |
| LBY151 | 92651.2 | — | — | — | — | — | — | 10.4 | 0.28 | 6 |
| LBY151 | 92651.3 | 233.1 | 0.23 | 16 | — | — | — | — | — | — |
| LBY143 | 91470.4 | 250.0 | 0.23 | 24 | 3281.2 | L | 29 | 10.4 | 0.14 | 6 |
| LBY143 | 91470.7 | 258.8 | 0.14 | 29 | 3018.8 | 0.04 | 19 | 10.9 | L | 11 |
| LBY143 | 91470.8 | 230.6 | 0.23 | 15 | 3108.0 | 0.02 | 22 | — | — | — |
| CONT. | — | 201.3 | — | 2540.6 | — | 9.89 | — | — | — | — |
| LBY99 | 91635.3 | 261.2 | L | 14 | — | — | — | 10.8 | 0.30 | 10 |
| LBY99 | 91635.4 | 287.5 | L | 26 | — | — | — | 11.4 | 0.06 | 17 |
| LBY99 | 91635.5 | — | — | — | — | — | — | 10.8 | 0.08 | 10 |
| LBY99 | 91636.1 | 247.5 | 0.13 | 8 | 3162.5 | 0.11 | 10 | — | — | — |
| LBY99 | 91636.4 | 256.2 | L | 12 | — | — | — | 11.0 | 0.14 | 12 |
| LBY66 | 92089.2 | — | — | — | 3056.2 | 0.30 | 6 | — | — | — |
| LBY66 | 92093.3 | 279.4 | L | 22 | 3431.2 | 0.02 | 19 | — | — | — |
| LBY218 | 92159.1 | — | — | — | — | — | — | 10.4 | 0.23 | 7 |
| LBY218 | 92159.3 | 241.2 | 0.09 | 5 | — | — | — | — | — | — |
| LBY218 | 92160.3 | 264.2 | 0.20 | 16 | — | — | — | 10.4 | 0.01 | 7 |
| LBY218 | 92162.3 | — | — | — | 3168.8 | 0.10 | 10 | 10.1 | 0.11 | 3 |
| LBY211 | 92412.1 | — | — | — | — | — | — | 10.1 | 0.19 | 3 |
| LBY205 | 92164.1 | — | — | — | — | — | — | 10.9 | 0.06 | 11 |
| LBY205 | 92164.3 | 258.1 | 0.27 | 13 | — | — | — | — | — | — |
| LBY205 | 92166.2 | — | — | — | 3218.8 | 0.14 | 11 | — | — | — |
| LBY199 | 92308.1 | 248.8 | L | 9 | — | — | — | 10.6 | L | 8 |
| LBY197 | 92400.4 | 270.0 | L | 18 | — | — | — | — | — | — |
| LBY197 | 92403.4 | 242.5 | 0.28 | 6 | — | — | — | 10.4 | 0.04 | 6 |
| LBY195 | 92193.1 | 239.4 | 0.04 | 5 | — | — | — | — | — | — |
| LBY195 | 92193.2 | 262.8 | L | 15 | 3450.0 | 0.21 | 19 | 10.3 | 0.13 | 5 |
| LBY195 | 92193.3 | 251.2 | L | 10 | 3537.5 | L | 22 | 10.9 | L | 11 |
| LBY190 | 91513.2 | — | — | — | 3318.8 | 0.26 | 15 | — | — | — |
| LBY190 | 91513.3 | 275.7 | L | 21 | 3157.1 | 0.15 | 9 | 10.3 | 0.30 | 5 |
| LBY176 | 92509.2 | 251.2 | L | 10 | — | — | — | — | — | — |
| LBY176 | 92512.1 | — | — | — | 3306.2 | 0.16 | 14 | — | — | — |
| LBY176 | 92513.1 | — | — | — | 3141.1 | 0.23 | 9 | — | — | — |
| LBY164 | 92669.1 | 275.6 | L | 21 | 3118.8 | 0.16 | 8 | 11.1 | 0.17 | 13 |
| LBY164 | 92671.1 | — | — | — | 3225.0 | 0.13 | 12 | — | — | — |
| LBY163 | 91481.3 | — | — | — | — | — | — | 10.8 | 0.03 | 10 |
| LBY163 | 914822 | 278.1 | L | 22 | — | — | — | 10.8 | 0.08 | 10 |
| LBY163 | 91482.3 | 235.6 | 0.22 | 3 | — | — | — | — | — | — |
| LBY163 | 91484.6 | 255.6 | L | 12 | — | — | — | 10.7 | 0.04 | 9 |
| LBY160 | 92302.6 | 256.9 | L | 12 | — | — | — | 10.4 | 0.18 | 6 |
| LBY160 | 92302.7 | — | — | — | — | — | — | 10.9 | 0.27 | 12 |
| LBY151 | 92649.1 | — | — | — | 3237.5 | 0.21 | 12 | 11.0 | 0.28 | 12 |
| LBY143 | 91470.4 | — | — | — | 3567.9 | 0.12 | 24 | 10.6 | 0.18 | 8 |
| LBY143 | 91470.7 | 262.1 | 0.23 | 15 | 3214.3 | 0.22 | 11 | — | — | — |
| LBY143 | 91470.8 | 255.0 | L | 12 | — | — | — | — | — | — |
| LBY105 | 91386.6 | 239.4 | 0.03 | 5 | — | — | — | 10.5 | 0.13 | 7 |
| LBY100 | 91410.2 | 239.6 | 0.23 | 5 | — | — | — | — | — | — |
| LBY100 | 91410.3 | 270.0 | L | 18 | — | — | — | 10.6 | L | 9 |
| CONT. | — | 228.7 | — | — | 2887.8 | — | — | 9.79 | — | — |
| LGN43 | 89052.3 | 376.2 | 0.15 | 7 | 5541.7 | 0.25 | 4 | 12.4 | 0.21 | 6 |
| LGN43 | 89053.1 | 370.4 | 0.25 | 5 | | | | 12.8 | 0.09 | 9 |
| LGN43 | 89053.2 | 378.8 | 0.17 | 8 | 5645.8 | 0.17 | 6 | 12.3 | 0.26 | 5 |
| CONT. | — | 351.5 | — | — | 5322.8 | — | — | 11.7 | — | — |

Table 258. CONT. = Control; Ave. = Average; % Incr. = % increment; p-val. = p-value, L = p < 0.01.

TABLE 259

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGN43 | 89053.2 | 65.1 | 0.02 | 32 | 8.14 | 0.02 | 32 | 4.76 | L | 14 |
| CONT. | — | 49.2 | — | — | 6.15 | — | — | 4.17 | — | — |
| LGN17 | 89028.4 | 75.2 | 0.13 | 16 | 9.40 | 0.13 | 16 | 5.29 | 0.10 | 8 |
| CONT. | — | 64.6 | — | — | 8.08 | — | — | 4.91 | — | — |
| LGN17 | 89027.1 | 74.5 | 0.20 | 23 | 9.32 | 0.20 | 23 | 4.99 | 0.19 | 13 |
| LGN17 | 89028.4 | 72.3 | 0.27 | 19 | 9.03 | 0.27 | 19 | — | — | — |
| CONT. | — | 60.5 | — | — | 7.56 | — | — | 4.40 | — | — |
| LBY90 | 91192.3 | 75.2 | 0.25 | 7 | 9.39 | 0.25 | 7 | — | — | — |
| LBY90 | 91193.1 | 78.0 | 0.06 | 11 | 9.75 | 0.06 | 11 | 5.42 | 0.18 | 4 |
| LBY88 | 91186.4 | 78.2 | 0.18 | 12 | 9.78 | 0.18 | 12 | 5.52 | 0.09 | 6 |
| LBY59 | 91322.3 | 85.7 | L | 22 | 10.7 | L | 22 | 5.69 | L | 9 |
| LBY47 | 91626.1 | 77.7 | 0.16 | 11 | 9.71 | 0.16 | 11 | 5.42 | 0.12 | 4 |
| LBY45 | 92194.4 | 81.0 | 0.24 | 16 | 10.1 | 0.24 | 16 | 5.71 | L | 9 |
| LBY45 | 92196.3 | 82.3 | L | 18 | 10.3 | L | 18 | 5.72 | L | 10 |
| LBY45 | 92197.3 | 98.7 | 0.05 | 41 | 12.3 | 0.05 | 41 | 6.12 | 0.10 | 17 |
| LBY40 | 91310.1 | 83.0 | L | 19 | 10.4 | L | 19 | 5.42 | 0.12 | 4 |
| LBY40 | 91310.2 | 80.0 | 0.01 | 14 | 10.0 | 0.01 | 14 | 5.61 | 0.01 | 7 |
| LBY228 | 91610.4 | 82.2 | 0.10 | 17 | 10.3 | 0.10 | 17 | 5.62 | 0.03 | 8 |
| LBY18 | 91297.2 | — | — | — | — | — | — | 5.75 | 0.06 | 10 |
| LBY16 | 91599.3 | 77.4 | 0.05 | 11 | 9.68 | 0.05 | 11 | 5.59 | 0.01 | 7 |
| LBY128 | 91439.6 | 77.7 | 0.04 | 11 | 9.71 | 0.04 | 11 | — | — | — |
| LBY100 | 91410.3 | 96.6 | L | 38 | 12.1 | L | 38 | 6.18 | L | 18 |
| CONT. | — | 70.0 | — | — | 8.75 | — | — | 5.23 | — | — |
| LGN61 | 89105.3 | — | — | — | — | — | — | 5.63 | 0.03 | 5 |
| CONT. | — | — | — | — | — | — | — | 5.37 | — | — |
| LGN61 | 89105.3 | 85.9 | 0.27 | 16 | 10.7 | 0.27 | 16 | 5.50 | 0.21 | 13 |
| LGN61 | 89107.3 | 89.7 | 0.22 | 21 | 11.2 | 0.22 | 21 | 5.60 | 0.18 | 15 |
| CONT. | — | 74.0 | — | — | 9.25 | — | — | 4.89 | — | — |
| LBY75 | 92094.1 | — | — | — | — | — | — | 5.65 | 0.10 | 4 |
| LBY75 | 92094.2 | 92.2 | 0.15 | 10 | 11.5 | 0.15 | 10 | 5.70 | 0.18 | 5 |
| LBY62 | 91401.3 | 88.1 | 0.24 | 5 | 11.0 | 0.24 | 5 | 5.58 | 0.24 | 3 |
| LBY218 | 92159.3 | 92.6 | 0.05 | 10 | 11.6 | 0.05 | 10 | 5.73 | 0.07 | 5 |
| LBY190 | 91513.2 | 89.0 | 0.27 | 6 | 11.1 | 0.27 | 6 | 5.64 | 0.18 | 4 |
| LBY163 | 91481.2 | 93.6 | 0.02 | 11 | 11.7 | 0.02 | 11 | 5.78 | 0.03 | 6 |
| LBY163 | 91481.3 | 89.5 | 0.14 | 6 | 11.2 | 0.14 | 6 | 5.82 | 0.02 | 7 |
| LBY163 | 91484.3 | 96.8 | L | 15 | 12.1 | L | 15 | 5.86 | 0.03 | 8 |
| CONT. | — | 84.1 | — | — | 10.5 | — | — | 5.43 | — | — |
| LGN40 | 90347.1 | 78.9 | 0.09 | 6 | 9.86 | 0.09 | 6 | 5.54 | 0.04 | 9 |
| CONT. | — | 74.2 | — | — | 9.28 | — | — | 5.07 | — | — |
| LBY94 | 92333.2 | — | — | — | 8.40 | 0.07 | 19 | 5.24 | 0.13 | 12 |
| LBY84 | 92213.3 | 68.3 | 0.14 | 21 | 8.54 | 0.14 | 21 | 5.21 | 0.20 | 12 |
| LBY75 | 92096.1 | 75.9 | 0.01 | 35 | 9.49 | 0.01 | 35 | 5.44 | 0.02 | 17 |
| LBY73 | 92387.3 | 64.8 | 0.17 | 15 | 8.10 | 0.17 | 15 | — | — | — |
| LBY73 | 92388.1 | 69.6 | 0.04 | 23 | 8.70 | 0.04 | 23 | 5.17 | 0.07 | 11 |
| LBY69 | 92169.3 | 79.6 | L | 41 | 9.95 | L | 41 | 5.50 | 0.04 | 18 |
| LBY66 | 92089.3 | 64.3 | 0.18 | 14 | 8.03 | 0.18 | 14 | 5.11 | 0.09 | 9 |
| LBY66 | 92091.1 | 71.7 | 0.02 | 27 | 8.97 | 0.02 | 27 | 5.37 | 0.02 | 15 |
| LBY66 | 92093.3 | 71.3 | 0.12 | 26 | 8.91 | 0.12 | 26 | 5.26 | 0.11 | 13 |
| LBY62 | 91400.7 | — | — | — | — | — | — | 4.95 | 0.28 | 6 |
| LBY62 | 91401.3 | 64.7 | 0.16 | 15 | 8.08 | 0.16 | 15 | — | — | — |
| LBY58 | 91376.5 | 73.8 | 0.02 | 31 | 9.22 | 0.02 | 31 | 5.58 | 0.07 | 20 |
| LBY58 | 91378.2 | 73.0 | 0.04 | 29 | 9.12 | 0.04 | 29 | 5.39 | 0.02 | 16 |
| LBY37 | 91217.1 | 62.9 | 0.29 | 11 | 7.86 | 0.29 | 11 | 4.97 | 0.22 | 7 |
| LBY211 | 92412.1 | 88.5 | 0.01 | 57 | 11.1 | 0.01 | 57 | 6.03 | 0.02 | 29 |
| LBY206 | 92350.3 | 74.3 | 0.01 | 32 | 9.29 | 0.01 | 32 | 5.38 | 0.02 | 15 |
| LBY199 | 92307.1 | 74.5 | 0.04 | 32 | 9.31 | 0.04 | 32 | 5.39 | 0.03 | 15 |
| LBY199 | 92308.1 | 69.9 | 0.17 | 24 | 8.74 | 0.17 | 24 | 5.39 | 0.02 | 16 |
| LBY176 | 92509.2 | 85.3 | 0.01 | 51 | 10.7 | 0.01 | 51 | 5.78 | 0.01 | 24 |
| LBY151 | 92649.2 | 64.4 | 0.21 | 14 | 8.05 | 0.21 | 14 | 5.18 | 0.15 | 11 |
| LBY151 | 92651.3 | 64.4 | 0.27 | 14 | 8.05 | 0.27 | 14 | 5.03 | 0.19 | 8 |
| LBY143 | 91470.4 | 76.4 | L | 35 | 9.55 | L | 35 | 5.57 | L | 19 |
| LBY143 | 91470.7 | 67.7 | 0.19 | 20 | 9.03 | 0.02 | 28 | 5.44 | 0.02 | 17 |
| LBY143 | 91470.8 | 71.1 | 0.07 | 26 | 8.89 | 0.07 | 26 | 5.26 | 0.07 | 13 |
| CONT. | — | 56.4 | — | — | 7.05 | — | — | 4.67 | — | — |
| LBY99 | 91635.3 | 62.6 | 0.07 | 36 | 7.82 | 0.07 | 36 | 4.96 | L | 12 |
| LBY99 | 91635.4 | 71.0 | L | 55 | 8.88 | L | 55 | 5.29 | L | 19 |
| LBY99 | 91635.5 | 63.3 | 0.02 | 38 | 7.91 | 0.02 | 38 | 5.07 | 0.14 | 14 |
| LBY99 | 91636.4 | 58.0 | 0.22 | 26 | 7.25 | 0.22 | 26 | 4.79 | 0.05 | 8 |
| LBY66 | 92093.3 | 64.2 | 0.05 | 40 | 8.02 | 0.05 | 40 | 5.08 | L | 15 |
| LBY218 | 92159.1 | 61.5 | 0.27 | 34 | 7.69 | 0.27 | 34 | 5.06 | 0.24 | 14 |
| LBY218 | 92159.3 | 58.1 | L | 27 | 7.26 | L | 27 | 4.94 | L | 12 |
| LBY218 | 92160.3 | 59.5 | 0.03 | 30 | 7.44 | 0.03 | 30 | 4.92 | 0.09 | 11 |

TABLE 259-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY218 | 92162.3 | 57.6 | 0.09 | 26 | 7.20 | 0.09 | 26 | 4.81 | 0.21 | 9 |
| LBY211 | 92412.1 | 49.4 | 0.20 | 8 | 6.17 | 0.20 | 8 | — | — | — |
| LBY205 | 92164.1 | 59.5 | 0.07 | 30 | 7.44 | 0.07 | 30 | 4.90 | 0.04 | 11 |
| LBY205 | 92164.3 | 59.0 | L | 29 | 7.38 | L | 29 | 5.06 | L | 14 |
| LBY199 | 92308.1 | — | — | — | — | — | — | 4.97 | 0.26 | 12 |
| LBY197 | 92399.1 | 51.3 | 0.26 | 12 | 6.42 | 0.26 | 12 | 4.70 | 0.18 | 6 |
| LBY197 | 92400.4 | 57.6 | L | 26 | 7.20 | L | 26 | 4.87 | 0.06 | 10 |
| LBY197 | 92403.4 | 60.5 | 0.06 | 32 | 7.56 | 0.06 | 32 | 4.89 | 0.10 | 10 |
| LBY195 | 92191.4 | 55.7 | 0.15 | 21 | 6.96 | 0.15 | 21 | 4.73 | 0.14 | 7 |
| LBY195 | 92193.2 | 60.4 | 0.01 | 32 | 7.55 | 0.01 | 32 | 4.99 | L | 13 |
| LBY195 | 92193.3 | 71.0 | L | 55 | 8.88 | L | 55 | 5.30 | L | 20 |
| LBY190 | 91510.2 | 62.2 | L | 35 | 7.77 | L | 35 | 4.98 | L | 13 |
| LBY190 | 91513.2 | 63.0 | L | 37 | 7.88 | L | 37 | 5.07 | L | 15 |
| LBY190 | 91513.3 | 67.2 | 0.06 | 46 | 8.40 | 0.06 | 46 | 5.23 | 0.02 | 18 |
| LBY176 | 92509.2 | 63.0 | 0.07 | 37 | 7.87 | 0.07 | 37 | 5.07 | 0.19 | 14 |
| LBY176 | 92510.1 | 54.8 | 0.21 | 20 | 6.85 | 0.21 | 20 | 4.87 | 0.25 | 10 |
| LBY164 | 92669.1 | 69.8 | 0.19 | 52 | 8.73 | 0.19 | 52 | 5.23 | 0.21 | 18 |
| LBY163 | 91481.3 | 64.2 | 0.12 | 40 | 8.03 | 0.12 | 40 | 5.05 | 0.11 | 14 |
| LBY163 | 91482.2 | 66.9 | L | 46 | 8.36 | L | 46 | 5.19 | L | 17 |
| LBY163 | 91482.3 | 50.9 | 0.16 | 11 | 6.37 | 0.16 | 11 | 4.66 | 0.06 | 5 |
| LBY163 | 91484.6 | 64.2 | L | 40 | 8.03 | L | 40 | 5.23 | L | 18 |
| LBY160 | 92302.5 | 54.3 | 0.01 | 18 | 6.78 | 0.01 | 18 | 4.83 | L | 9 |
| LBY160 | 92302.6 | 57.9 | 0.11 | 26 | 7.24 | 0.11 | 26 | 4.78 | 0.07 | 8 |
| LBY160 | 92302.7 | 61.1 | 0.22 | 33 | 7.63 | 0.22 | 33 | 4.98 | 0.06 | 12 |
| LBY151 | 92649.1 | 60.6 | 0.21 | 32 | 7.57 | 0.21 | 32 | 5.04 | 0.22 | 14 |
| LBY151 | 92649.3 | 48.8 | 0.26 | 6 | 6.10 | 0.26 | 6 | — | — | — |
| LBY143 | 91470.4 | 59.4 | 0.12 | 30 | 7.43 | 0.12 | 30 | 4.83 | 0.01 | 9 |
| LBY143 | 91470.8 | 52.8 | 0.02 | 15 | 6.60 | 0.02 | 15 | 4.61 | 0.11 | 4 |
| LBY105 | 91386.6 | 53.5 | 0.13 | 17 | 6.69 | 0.13 | 17 | — | — | — |
| LBY100 | 91410.2 | — | — | — | — | — | — | 4.65 | 0.13 | 5 |
| LBY100 | 91410.3 | 59.2 | L | 29 | 7.41 | L | 29 | 4.91 | 0.13 | 11 |
| LBY100 | 91410.6 | 57.7 | 0.29 | 26 | 7.22 | 0.29 | 26 | 4.86 | 0.19 | 10 |
| CONT. | — | 45.9 | — | — | 5.74 | — | — | 4.43 | — | — |
| LGN43 | 89052.3 | 81.0 | 0.12 | 17 | 10.1 | 0.12 | 17 | 5.50 | 0.14 | 11 |
| CONT. | — | 69.2 | — | — | 8.65 | — | — | 4.94 | — | — |
| LGN13 | 89084.3 | 85.3 | 0.29 | 11 | 10.7 | 0.29 | 11 | — | — | — |
| CONT. | — | 76.8 | — | — | 9.60 | — | — | — | — | — |

Table 259. "CONT." = Control; "Ave." = Average; "% Incr." = % increment; "p-val." = p-value, L p < 0.01.

TABLE 260

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LGN43 | 89053.2 | — | — | — | 7.48 | 0.04 | 32 | 0.365 | 0.08 | 9 |
| CONT. | — | — | — | — | 5.65 | — | — | 0.335 | — | — |
| LGN17 | 89028.4 | — | — | — | 8.75 | 0.16 | 16 | — | — | — |
| CONT. | — | — | — | — | 7.54 | — | — | — | — | — |
| LGN44 | 89056.1 | 0.724 | 0.28 | 16 | — | — | — | — | — | — |
| CONT. | — | 0.625 | — | — | — | — | — | — | — | — |
| LGN17 | 89027.1 | 0.672 | 0.19 | 13 | 8.89 | 0.21 | 23 | 0.394 | 0.12 | 18 |
| LGN17 | 89028.4 | 0.687 | 0.08 | 15 | — | — | — | — | — | — |
| CONT. | — | 0.597 | — | — | 7.23 | — | — | 0.334 | — | — |
| LBY90 | 91192.2 | 0.689 | 0.19 | 21 | — | — | — | — | — | — |
| LBY90 | 91192.3 | — | — | — | 8.86 | 0.21 | 7 | — | — | — |
| LBY90 | 91193.1 | — | — | — | 9.31 | 0.04 | 13 | 0.456 | 0.20 | 4 |
| LBY88 | 91186.4 | — | — | — | 9.36 | 0.11 | 13 | 0.479 | 0.01 | 9 |
| LBY59 | 91321.3 | — | — | — | — | — | — | 0.461 | 0.12 | 5 |
| LBY59 | 91322.3 | — | — | — | 10.1 | 0.13 | 22 | — | — | — |
| LBY57 | 90974.1 | 0.648 | 0.08 | 14 | — | — | — | — | — | — |
| LBY47 | 91626.1 | — | — | — | 9.17 | 0.16 | 11 | — | — | — |
| LBY47 | 91627.3 | 0.629 | 0.14 | 10 | — | — | — | — | — | — |
| LBY47 | 91628.1 | 0.672 | 0.21 | 18 | — | — | — | — | — | — |

TABLE 260-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY45 | 92194.4 | — | — | — | 9.66 | 0.20 | 17 | 0.485 | L | 11 |
| LBY45 | 92196.3 | — | — | — | 9.70 | 0.24 | 17 | 0.476 | 0.07 | 8 |
| LBY45 | 92197.3 | — | — | — | 11.5 | 0.01 | 39 | 0.496 | 0.18 | 13 |
| LBY40 | 91310.1 | — | — | — | 9.87 | 0.19 | 19 | — | — | — |
| LBY40 | 91310.2 | — | — | — | 9.46 | 0.02 | 14 | 0.454 | 0.19 | 4 |
| LBY40 | 91311.1 | 0.681 | 0.24 | 20 | — | — | — | — | — | — |
| LBY40 | 91314.1 | 0.623 | 0.24 | 9 | — | — | — | — | — | — |
| LBY228 | 91610.2 | 0.712 | 0.10 | 25 | — | — | — | — | — | — |
| LBY228 | 91610.4 | — | — | — | 9.71 | 0.23 | 17 | 0.463 | 0.07 | 6 |
| LBY222 | 91602.2 | 0.688 | 0.16 | 21 | — | — | — | — | — | — |
| LBY222 | 91604.4 | 0.680 | 0.19 | 19 | — | — | — | — | — | — |
| LBY221 | 91417.1 | 0.621 | 0.23 | 9 | — | — | — | — | — | — |
| LBY220 | 91305.2 | 0.663 | 0.23 | 16 | — | — | — | — | — | — |
| LBY18 | 91297.2 | — | — | — | — | — | — | 0.487 | 0.27 | 11 |
| LBY18 | 91297.4 | 0.614 | 0.26 | 8 | — | — | — | — | — | — |
| LBY16 | 91595.3 | 0.671 | 0.21 | 18 | — | — | — | — | — | — |
| LBY16 | 91599.3 | — | — | — | 9.06 | 0.06 | 10 | 0.458 | 0.26 | 4 |
| LBY16 | 91599.7 | — | — | — | 9.95 | 0.23 | 20 | — | — | — |
| LBY129 | 91585.1 | 0.656 | 0.07 | 15 | — | — | — | — | — | — |
| LBY129 | 91585.4 | 0.675 | 0.21 | 18 | — | — | — | — | — | — |
| LBY128 | 91437.2 | 0.649 | 0.15 | 14 | — | — | — | — | — | — |
| LBY128 | 91439.6 | — | — | — | 9.08 | 0.06 | 10 | — | — | — |
| LBY100 | 91410.3 | — | — | — | 11.4 | 0.01 | 37 | 0.495 | 0.19 | 13 |
| LBY100 | 91410.4 | 0.626 | 0.15 | 10 | — | — | — | — | — | — |
| CONT. | — | 0.570 | — | — | 8.27 | — | — | 0.439 | — | — |
| LGN61 | 89105.3 | — | — | — | — | — | — | 0.451 | 0.02 | 8 |
| CONT. | — | — | — | — | — | — | — | 0.420 | — | — |
| LGN61 | 89106.1 | 0.696 | 0.30 | 18 | — | — | — | — | — | — |
| LGN61 | 89107.3 | — | — | — | 10.6 | 0.26 | 20 | 0.440 | 0.21 | 17 |
| CONT. | — | 0.590 | — | — | 8.80 | — | — | 0.375 | — | — |
| LBY75 | 92097.4 | 0.723 | 0.19 | 20 | — | — | — | — | — | — |
| LBY73 | 92386.2 | 0.717 | 0.18 | 19 | — | — | — | — | — | — |
| LBY69 | 92171.1 | 0.707 | 0.24 | 17 | — | — | — | — | — | — |
| LBY69 | 92172.3 | 0.713 | 0.20 | 18 | — | — | — | — | — | — |
| LBY62 | 91400.7 | 0.791 | 0.05 | 31 | — | — | — | — | — | — |
| LBY190 | 91513.2 | 0.699 | 0.28 | 16 | — | — | — | — | — | — |
| LBY163 | 91481.3 | — | — | — | — | — | — | 0.488 | 0.27 | 13 |
| LBY160 | 92302.7 | 0.696 | 0.28 | 15 | — | — | — | — | — | — |
| LBY105 | 91388.1 | 0.765 | 0.07 | 27 | — | — | — | — | — | — |
| CONT. | — | 0.603 | — | — | — | — | — | 0.434 | — | — |
| LGN40 | 90345.1 | 0.776 | 0.16 | 14 | — | — | — | — | — | — |
| LGN40 | 90346.2 | — | — | — | — | — | — | 0.424 | 0.20 | 7 |
| LGN40 | 90347.1 | — | — | — | 9.23 | 0.09 | 6 | 0.440 | 0.06 | 11 |
| CONT. | — | 0.682 | — | — | 8.69 | — | — | 0.397 | — | — |
| LBY84 | 92213.3 | — | — | — | 8.88 | 0.28 | 23 | — | — | — |
| LBY75 | 92096.1 | — | — | — | 9.74 | 0.11 | 35 | 0.504 | 0.28 | 17 |
| LBY73 | 92387.3 | 0.714 | 0.13 | 32 | — | — | — | — | — | — |
| LBY73 | 92388.1 | — | — | — | 8.86 | 0.28 | 23 | — | — | — |
| LBY69 | 92169.3 | 0.775 | 0.07 | 44 | 10.2 | 0.06 | 42 | — | — | — |
| LBY66 | 92091.1 | 0.703 | 0.16 | 30 | 9.22 | 0.19 | 28 | — | — | — |
| LBY66 | 92093.3 | 0.701 | 0.19 | 30 | 9.09 | 0.22 | 26 | — | — | — |
| LBY58 | 91376.5 | — | — | — | 9.39 | 0.15 | 30 | 0.504 | 0.29 | 17 |
| LBY58 | 91378.2 | — | — | — | 9.41 | 0.16 | 30 | — | — | — |
| LBY45 | 92197.3 | 0.699 | 0.18 | 30 | — | — | — | — | — | — |
| LBY211 | 92412.1 | — | — | — | 11.4 | 0.01 | 57 | 0.567 | 0.06 | 31 |
| LBY206 | 92350.3 | — | — | — | 9.54 | 0.13 | 32 | — | — | — |
| LBY199 | 92307.1 | — | — | — | 9.58 | 0.13 | 33 | — | — | — |
| LBY199 | 92308.1 | — | — | — | 8.99 | 0.25 | 25 | 0.505 | 0.28 | 17 |
| LBY176 | 92509.1 | 0.708 | 0.19 | 31 | — | — | — | — | — | — |
| LBY176 | 92509.2 | 0.826 | 0.02 | 53 | 10.9 | 0.02 | 51 | 0.522 | 0.18 | 21 |
| LBY143 | 91470.4 | — | — | — | 9.80 | 0.10 | 36 | 0.531 | 0.14 | 23 |
| LBY143 | 91470.7 | 0.665 | 0.29 | 23 | — | — | — | — | — | — |
| LBY143 | 91470.8 | — | — | — | 9.16 | 0.21 | 27 | — | — | — |
| CONT. | — | 0.540 | — | — | 7.21 | — | — | 0.431 | — | — |
| LBY99 | 91635.3 | — | — | — | 8.22 | 0.06 | 37 | — | — | — |
| LBY99 | 91635.4 | 0.775 | 0.04 | 28 | 9.33 | L | 56 | 0.523 | 0.10 | 19 |
| LBY99 | 91635.5 | 0.709 | 0.21 | 17 | 8.25 | 0.06 | 38 | 0.495 | 0.30 | 12 |
| LBY99 | 91636.4 | — | — | — | 7.60 | 0.16 | 27 | — | — | — |
| LBY66 | 92093.3 | — | — | — | 8.39 | 0.04 | 40 | 0.493 | 0.28 | 12 |
| LBY218 | 92159.1 | — | — | — | 8.09 | 0.07 | 35 | 0.497 | 0.26 | 13 |
| LBY218 | 92159.3 | — | — | — | 7.62 | 0.14 | 27 | — | — | — |

TABLE 260-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LBY218 | 92160.3 | — | — | — | 7.80 | 0.11 | 30 | — | — | — |
| LBY218 | 92162.3 | — | — | — | 7.56 | 0.16 | 26 | — | — | — |
| LBY205 | 92164.1 | 0.726 | 0.16 | 20 | 7.83 | 0.11 | 30 | — | — | — |
| LBY205 | 92164.3 | — | — | — | 7.76 | 0.11 | 29 | 0.512 | 0.16 | 16 |
| LBY205 | 92166.2 | — | — | — | 7.25 | 0.28 | 21 | — | — | — |
| LBY199 | 92308.1 | — | — | — | 7.89 | 0.11 | 32 | — | — | — |
| LBY197 | 92400.4 | — | — | — | 7.55 | 0.16 | 26 | — | — | — |
| LBY197 | 92403.4 | — | — | — | 7.94 | 0.09 | 32 | — | — | — |
| LBY195 | 92191.4 | — | — | — | 7.28 | 0.24 | 21 | — | — | — |
| LBY195 | 92193.2 | — | — | — | 7.95 | 0.08 | 33 | 0.500 | 0.23 | 14 |
| LBY195 | 92193.3 | 0.711 | 0.19 | 17 | 9.31 | L | 55 | 0.517 | 0.13 | 17 |
| LBY190 | 91510.2 | — | — | — | 8.17 | 0.05 | 36 | 0.492 | 0.29 | 12 |
| LBY190 | 91513.2 | — | — | — | 8.25 | 0.04 | 38 | 0.504 | 0.18 | 14 |
| LBY190 | 91513.3 | — | — | — | 8.84 | 0.02 | 47 | 0.514 | 0.15 | 17 |
| LBY184 | 92148.1 | — | — | — | 7.46 | 0.22 | 24 | — | — | — |
| LBY176 | 92509.2 | — | — | — | 8.23 | 0.05 | 37 | 0.499 | 0.22 | 13 |
| LBY176 | 92510.1 | — | — | — | 7.20 | 0.28 | 20 | — | — | — |
| LBY176 | 92512.1 | — | — | — | 7.28 | 0.26 | 21 | — | — | — |
| LBY164 | 92669.1 | 0.735 | 0.11 | 21 | 9.19 | 0.01 | 53 | 0.511 | 0.19 | 16 |
| LBY163 | 91481.3 | 0.766 | 0.05 | 26 | 8.44 | 0.04 | 41 | 0.493 | 0.29 | 12 |
| LBY163 | 91482.2 | — | — | — | 8.83 | 0.02 | 47 | 0.513 | 0.14 | 16 |
| LBY163 | 91484.6 | — | — | — | 8.41 | 0.03 | 40 | 0.524 | 0.09 | 19 |
| LBY160 | 92302.5 | — | — | — | 7.12 | 0.29 | 19 | — | — | — |
| LBY160 | 92302.6 | — | — | — | 7.61 | 0.15 | 27 | — | — | — |
| LBY160 | 92302.7 | 0.704 | 0.24 | 16 | 7.99 | 0.08 | 33 | — | — | — |
| LBY151 | 92649.1 | 0.757 | 0.07 | 25 | 7.86 | 0.10 | 31 | 0.494 | 0.29 | 12 |
| LBY143 | 91470.4 | — | — | — | 7.79 | 0.10 | 30 | — | — | — |
| LBY100 | 91410.3 | — | — | — | 7.76 | 0.11 | 29 | — | — | — |
| LBY100 | 91410.6 | 0.703 | 0.25 | 16 | 7.62 | 0.16 | 27 | — | — | — |
| CONT. | — | 0.608 | — | — | 6.00 | — | — | 0.440 | — | — |
| LGN43 | 89052.3 | — | — | — | 9.44 | 0.13 | 17 | 0.416 | 0.21 | 11 |
| CONT. | — | — | — | — | 8.07 | — | — | 0.374 | — | — |
| LGN13 | 89084.5 | 0.727 | 0.03 | 26 | — | — | — | — | — | — |
| LGN13 | 89084.6 | 0.657 | 0.12 | 14 | — | — | — | — | — | — |
| CONT. | — | 0.577 | — | — | — | — | — | — | — | — |

Table 260. "CONT." Control; "Ave." Average; "% Incr." = % increment; "p-val." p-value, L-p < 0.01.

The genes listed in Tables 261-263 improved plant performance when grown at low nitrogen (Low N) conditions. These genes produced larger plants with a larger photosynthetic area, biomass (fresh weight, dry weight, rosette diameter, rosette area and plot coverage) and relative growth rate (RGR). The genes were cloned under the regulation of a constitutive At6669 promoter (SEQ ID NO: 10654). The evaluation of each gene was performed by testing the performance of different number of events. Event with p-value <0.1 was considered statistically significant.

TABLE 261

Genes showing improved plant performance at Low Nitrogen growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LGN43 | 89052.2 | — | — | — | 2487.5 | 0.13 | 3 | 10.5 | 0.30 | 5 |
| LGN43 | 89052.3 | — | — | — | 2495.8 | 0.23 | 3 | — | — | — |
| LGN43 | 89053.2 | 241.7 | 0.04 | 9 | 2587.5 | 0.11 | 7 | — | — | — |
| CONT. | — | 221.7 | — | — | 2412.5 | — | — | 10.0 | — | — |
| LGN44 | 89055.7 | — | — | — | — | — | — | 10.5 | 0.27 | 2 |
| LGN44 | 89056.1 | 187.5 | 0.11 | 7 | 2195.8 | 0.23 | 38 | — | — | — |
| CONT. | — | 175.4 | — | — | 1587.5 | — | — | 10.3 | — | — |
| LGN61 | 89105.2 | 242.9 | 0.27 | 4 | 3008.3 | 0.26 | 4 | 11.5 | 0.29 | 4 |
| LGN61 | 89105.3 | — | — | — | 3175.0 | 0.04 | 10 | 11.2 | 0.08 | 2 |
| LGN61 | 89107.2 | — | — | — | — | — | — | 11.6 | 0.05 | 5 |
| CONT. | — | 232.9 | — | — | 5895.8 | — | 11.0 | — | — | — |
| LGN40 | 90345.1 | — | — | — | 2491.7 | 0.12 | 4 | — | — | — |
| LGN40 | 90346.3 | — | — | — | 2466.7 | 0.20 | 3 | — | — | — |
| LGN40 | 90347.1 | — | — | — | 2454.2 | 0.27 | 3 | — | — | — |
| CONT. | — | — | — | — | 2387.1 | — | — | — | — | — |

TABLE 261-continued

Genes showing improved plant performance at Low Nitrogen growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LGN17 | 89028.4 | 303.8 | 0.14 | 15 | 2579.2 | 0.09 | 8 | — | — | — |
| CONT. | — | 263.1 | — | — | 3328.1 | — | — | — | — | — |
| LGN44 | 89057.3 | — | — | — | — | — | — | 12.7 | 0.15 | 6 |
| CONT. | — | — | — | — | — | — | — | 12.0 | — | — |
| LGN17 | 89024.1 | 315.0 | 0.09 | 8 | 3258.3 | 0.26 | 5 | 12.1 | 0.09 | 6 |
| LGN17 | 89028.4 | 316.7 | 0.04 | 9 | 3262.5 | 0.24 | 5 | 11.8 | 0.11 | 3 |
| CONT. | — | 290.6 | — | — | 3103.1 | — | — | 11.4 | — | — |
| LGN20 | 89089.3 | — | — | — | — | — | — | 10.8 | 0.06 | 4 |
| LGN20 | 89091 | 260.0 | 0.10 | 7 | 3258.3 | 0.13 | 7 | — | — | — |
| CONT. | — | 243.8 | — | — | 3057.1 | — | — | 10.4 | — | — |
| LGN40 | 90345.1 | — | — | — | — | — | — | 11.8 | 0.08 | 11 |
| LGN40 | 90345.4 | 271.2 | 0.03 | 4 | 3583.3 | 0.03 | 5 | 11.7 | 0.05 | 10 |
| LGN40 | 90347.1 | — | — | — | — | — | — | 11.4 | 0.18 | 8 |
| CONT. | — | 261.7 | — | — | 3408.3 | — | — | 10.6 | — | — |
| LGN13 | 89084.3 | 302.9 | 0.25 | 4 | — | — | — | 12.5 | 0.27 | 6 |
| CONT. | — | 290.0 | — | — | — | — | — | 11.9 | — | — |

Table 261. "CONT." Control; "Ave." Average; "% Incr." = % increment; "p-val." p-value, L-p < 0.01.

TABLE 262

Genes showing improved plant performance at Low Nitrogen growth conditions under regulation of At6669 promoter

| Gene Name | Event # | Plot Coverage [cm$^2$] | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGN43 | 89053.2 | 40.5 | 0.05 | 27 | 5.07 | 0.05 | 27 | 3.60 | 0.07 | 14 |
| CONT. | — | 31.9 | — | — | 3.99 | — | — | 3.15 | — | — |
| LGN61 | 89105.3 | — | — | — | — | — | — | 3.94 | 0.04 | 4 |
| LGN61 | 89107.2 | — | — | — | — | — | — | 4.01 | 0.29 | 6 |
| LGN61 | 89107.3 | 53.4 | 0.17 | 13 | 6.67 | 0.17 | 13 | 4.14 | 0.09 | 9 |
| CONT. | — | 47.1 | — | — | 5.89 | — | — | 3.78 | — | — |
| LGN17 | 89028.4 | 45.8 | 0.13 | 14 | 5.73 | 0.13 | 14 | 3.69 | 0.19 | 5 |
| CONT. | — | 40.1 | — | — | 5.02 | — | — | 3.50 | — | — |
| LGN61 | 89107.3 | 57.7 | 0.29 | 12 | 7.21 | 0.29 | 12 | — | — | — |
| CONT. | — | 51.3 | — | — | 6.42 | — | — | — | — | — |
| LGN17 | 89024 | 59.6 | 0.03 | 26 | 7.45 | 0.03 | 26 | 4.31 | 0.05 | 15 |
| LGN17 | 89028.4 | 58.3 | L | 24 | 7.29 | L | 24 | 4.18 | L | 11 |
| CONT. | — | 47.2 | — | — | 5.90 | — | — | 3.76 | — | — |
| LGN40 | 90345.4 | 60.8 | 0.25 | 22 | 7.59 | 0.28 | 12 | — | — | — |
| CONT. | — | 49.9 | — | — | 6.78 | — | — | — | — | — |
| LGN13 | 89084.3 | 75.5 | 0.12 | 24 | 9.44 | 0.12 | 24 | 4.86 | 0.12 | 13 |
| CONT. | — | 60.9 | — | — | 7.62 | — | — | 4.32 | — | — |

Table 262. "CONT." Control; "Ave." Average; "% Incr." = % increment; "p-val." p-value, L-p < 0.01.

TABLE 263

Genes showing improved plant performance at Low Nitrogen growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LGN43 | 89052.2 | 0.751 | 0.22 | 16 | — | — | — | — | — | — |
| LGN43 | 89052.3 | — | — | — | — | — | — | 0.276 | 0.25 | 15 |
| LGN43 | 89053.2 | — | — | — | 4.60 | 0.06 | 25 | 0.267 | 0.14 | 11 |
| CONT. | — | 0.646 | — | — | 3.68 | — | — | 0.240 | — | — |
| LGN61 | 89105.2 | — | — | — | — | — | — | 0.273 | 0.21 | 8 |
| LGN61 | 89105.3 | — | — | — | — | — | — | 0.273 | 0.29 | 8 |

TABLE 263-continued

Genes showing improved plant performance at Low Nitrogen growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LGN61 | 89106.1 | — | — | — | — | — | — | 0.268 | 0.25 | 6 |
| LGN61 | 89107.2 | 0.724 | 0.28 | 13 | — | — | — | 0.292 | 0.10 | 16 |
| LGN61 | 89107.3 | — | — | — | 5.85 | 0.28 | 10 | 0.278 | 0.12 | 11 |
| CONT. | — | 0.642 | — | — | 5.32 | — | — | 0.252 | — | — |
| LGN40 | 90345.1 | — | — | — | — | — | — | 0.260 | 0.27 | 8 |
| LGN40 | 90345.3 | — | — | — | — | — | — | 0.257 | 0.27 | 7 |
| LGN40 | 90347.1 | — | — | — | — | — | — | 0.252 | 0.22 | 5 |
| CONT. | — | — | — | — | — | — | — | 0.241 | — | — |
| LGN17 | 89028.4 | — | — | — | 5.19 | 0.21 | 12 | — | — | — |
| CONT. | — | — | — | — | 4.62 | — | — | — | — | — |
| LGN44 | 89055.7 | 0.754 | 0.23 | 8 | — | — | — | — | — | — |
| LGN44 | 89057.3 | 0.792 | 0.17 | 14 | — | — | — | — | — | — |
| CONT. | — | 0.696 | — | — | — | — | — | — | — | — |
| LGN17 | 89024.1 | 0.744 | 0.26 | 6 | 7.16 | 0.04 | 29 | 0.328 | 0.05 | 22 |
| LGN17 | 89028.4 | — | — | — | 6.83 | 0.01 | 23 | 0.290 | 0.18 | 8 |
| CONT. | — | 0.699 | — | — | 5.56 | — | — | 0.269 | — | — |
| LGN20 | 89089.3 | 0.784 | 0.13 | 14 | — | — | — | — | — | — |
| LGN20 | 89091.4 | 0.772 | 0.20 | 12 | — | — | — | — | — | — |
| LGN20 | 89093.4 | 0.719 | 0.29 | 4 | — | — | — | — | — | — |
| CONT. | — | 0.691 | — | — | — | — | — | — | — | — |
| LGN40 | 90345.1 | 0.797 | 0.04 | 25 | — | — | — | — | — | — |
| LGN40 | 90345.4 | 0.734 | 0.27 | 15 | 7.17 | 0.28 | 22 | — | — | — |
| LGN40 | 90347.1 | 0.754 | 0.08 | 19 | — | — | — | — | — | — |
| CONT. | — | 0.636 | — | — | 5.87 | — | — | — | — | — |
| LGN13 | 89084.2 | 0.728 | 0.21 | 6 | — | — | — | — | — | — |
| CONT. | — | 0.684 | — | — | — | — | — | — | — | — |
| LGN13 | 89084.3 | 0.693 | 0.29 | 11 | 8.92 | 0.14 | 24 | — | — | — |
| CONT. | — | 0.624 | — | — | 7.20 | — | — | — | — | — |

Table 263. "CONT."-Control; "Ave."-Average; "% Incr." = % increment; "p-val."-p-value. L-p < 0.01.

Example 31

Evaluating Transgenic *Arabidopsis* Under Normal and Low Nitrogen Conditions Using Seedling Analyses of $T_2$ and $T_1$ Plants Seedling analysis of plants growth under favorable (normal) nitrogen concentration levels—Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N, normal conditions). For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Seedling analysis of plants growth under low and favorable nitrogen concentration levels—Low nitrogen is an abiotic stress that impact root growth and seedling growth. Therefore, an assay that examines plant performance under low (0.75 mM Nitrogen) and favorable (15 mM Nitrogen) nitrogen concentrations was performed, as follows.

Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N) for the normal nitrogen concentration treatment and 0.75 mM nitrogen for the low nitrogen concentration treatments. For experiments performed in T2 lines, each plate contained 5 seedlings of the same transgenic event, and 3-4 different plates (replicates) for each event. For each polynucleotide of the invention at least four-five independent transformation events were analyzed from each construct. For experiments performed in T1 lines, each plate contained 5 seedlings of 5 independent transgenic events and 3-4 different plates (replicates) were planted. In total, for T1 lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-3F). An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to the following Formulas XIII (RGR leaf area, above), XXVIII (RGR root coverage, described above) and VI (RGR root length, below).

At the end of the experiment, plantlets were removed from the media and weighed for the determination of plant fresh weight. Plantlets were then dried for 24 hours at 60° C., and weighed again to measure plant dry weight for later statistical analysis. The fresh and dry weights were provided for each *Arabidopsis* plant. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if p≤0.1. The JMP statistics software package was used (Version 5.2.1, SAS Institute Inc., Cary, N.C., USA).

Experimental Results

Tables 264-266 summarize the observed phenotypes of transgenic plants expressing the gene constructs using the TC-T2 assays [tissue culture (seedling assays), T2 plants, seedling (plantlets) analyses].

The genes presented in Table 264 showed a significant improvement as they produced larger plant biomass (plant fresh and dry weight) in T2 generation when grown under low nitrogen growth conditions, compared to control plants. The genes were cloned under the regulation of a constitutive promoter (At6669, SEQ ID NO: 10654). The evaluation of each gene was carried out by testing the performance of different number of events. Some of the genes were evaluated in more than one seedling assay. The results obtained in these second experiments were significantly positive as well.

TABLE 264

Genes showing improved plant performance at Low Nitrogen growth conditions under regulation of At6669 promoter

| Gene Name | Event # | Dry Weight [mg] | | | Fresh Weight [mg] | | |
|---|---|---|---|---|---|---|---|
| | | Ave. | P-VaL | % Incr. | Ave. | P-VaL | % Incr. |
| LGN35 | 89043.1 | 4.15 | L | 15 | 65.7 | 0.02 | 28 |
| LGN35 | 89043.2 | 4.15 | 0.01 | 15 | 57.3 | 0.25 | 11 |
| LGN35 | 89043.3 | — | — | — | 58.4 | 0.03 | 14 |
| LGN35 | 89043.4 | 4.20 | L | 16 | 60.5 | 0.07 | 18 |
| CONT. | — | 3.61 | — | — | 51.4 | — | — |
| LGN39 | 89931.1 | — | — | — | 84.7 | 0.17 | 10 |
| LGN39 | 89931.3 | 5.47 | 0.18 | 15 | 84.5 | 0.12 | 10 |
| LGN39 | 89931.4 | — | — | — | 85.2 | 0.08 | 11 |
| LGN34 | 90400.2 | 5.35 | 0.09 | 12 | — | — | — |
| LGN34 | 90403.3 | 5.75 | 0.20 | 21 | 92.8 | 0.11 | 21 |
| CONT. | — | 4.76 | — | — | 76.7 | — | — |
| NUE3 | 88975.1 | 4.30 | 0.14 | 17 | — | — | — |
| NUE3 | 88977.1 | 3.92 | 0.27 | 7 | 98.6 | 0.05 | 40 |
| NUE3 | 88977.2 | 4.17 | 0.18 | 14 | 85.8 | 0.06 | 21 |
| LGN9 | 89186.1 | 3.98 | 0.29 | 8 | 103.6 | 0.21 | 47 |
| LGN9 | 89186.2 | — | — | — | 78.9 | 0.23 | 12 |
| LGN7 | 89181.1 | — | — | — | 133.4 | 0.19 | 89 |
| LGN14 | 89168.2 | — | — | — | 78.6 | 0.14 | 11 |
| CONT. | — | 3.67 | — | — | 70.6 | — | — |
| LGN26 | 89036.1 | 5.65 | 0.05 | 25 | 79.5 | 0.05 | 21 |
| LGN26 | 89036.3 | 4.88 | 0.26 | 8 | — | — | — |
| LGN26 | 89037.2 | 6.10 | L | 35 | 90.8 | 0.02 | 38 |
| LGN26 | 89037.3 | 5.75 | 0.02 | 27 | 75.3 | 0.16 | 14 |
| CONT. | — | 4.53 | — | — | 65.9 | — | — |
| LGN46 | 89101.1 | — | — | — | 74.2 | 0.15 | 10 |
| LGN46 | 89101.4 | 4.90 | 0.10 | 12 | 83.0 | 0.12 | 22 |
| LGN46 | 89101.7 | — | — | — | 74.1 | 0.18 | 9 |
| CONT. | — | 4.71 | — | — | 76.8 | — | — |
| LGN57 | 89064.2 | 5.98 | 0.03 | 55 | 97.2 | 0.20 | 40 |
| LGN57 | 89065.1 | 4.90 | 0.10 | 27 | — | — | — |
| LGN57 | 89067.1 | 5.30 | 0.01 | 38 | 88.0 | 0.18 | 27 |
| LGN57 | 89067.2 | 4.92 | 0.04 | 28 | — | — | — |
| CONT. | — | 3.85 | — | — | 69.3 | — | — |
| LGN4 | 89075.2 | — | — | — | 81.5 | L | 23 |
| CONT. | — | — | — | — | 66.4 | — | — |
| LGN52 | 90578.6 | 4.30 | 0.19 | 5 | 73.8 | 0.03 | 9 |
| LGN52 | 90581.1 | 4.72 | 0.02 | 15 | 72.9 | 0.05 | 7 |
| LGN52 | 90581.2 | 5.07 | 0.04 | 24 | — | — | — |
| CONT. | — | 4.10 | — | — | 72.7 | — | — |
| LGN46 | 89101.9 | 5.03 | 0.16 | 23 | — | — | — |
| CONT. | — | 4.09 | — | — | — | — | — |
| LGN45 | 91579.5 | 5.38 | 0.17 | 7 | — | — | — |
| CONT. | — | 5.04 | — | — | — | — | — |
| LGN23 | 92317.2 | 4.42 | 0.20 | 12 | — | — | — |
| CONT. | — | 3.96 | — | — | — | — | — |
| LGN18 | 92468.3 | 4.95 | 0.17 | 6 | — | — | — |
| CONT. | — | 4.66 | — | — | — | — | — |
| LGN35 | 89043.2 | 4.72 | 0.29 | 8 | — | — | — |
| CONT. | — | 4.38 | — | — | — | — | — |
| LGN33 | 91570.4 | — | — | — | 72.3 | 0.29 | 13 |
| LGN33 | 91572.1 | 4.15 | 0.04 | 14 | — | — | — |
| LGN33 | 91572.3 | 3.92 | 0.08 | 8 | — | — | — |
| LGN33 | 91574.4 | 3.90 | 0.23 | 7 | — | — | — |
| CONT. | — | 3.64 | — | — | 64.0 | — | — |
| LGN47 | 91171.4 | 4.88 | 0.24 | 14 | — | — | — |
| LGN47 | 91174.4 | 4.77 | L | 11 | — | — | — |
| CONT. | — | 4.29 | — | — | — | — | — |
| LGN42 | 92204.1 | 5.35 | 0.19 | 5 | — | — | — |
| CONT. | — | 5.07 | — | — | — | — | — |
| NUE3 | 88977.1 | 3.98 | 0.23 | 8 | 69.9 | 0.25 | 11 |
| NUE3 | 88977.2 | 4.47 | 0.03 | 22 | 72.5 | 0.15 | 15 |
| NUE3 | 88977.5 | 4.65 | 0.07 | 27 | 74.9 | 0.22 | 19 |
| LGN9 | 89186.1 | — | — | — | 87.5 | 0.19 | 39 |
| LGN7 | 89181.1 | 4.28 | 0.13 | 16 | — | — | — |
| LGN7 | 89183.2 | 3.98 | 0.28 | 8 | — | — | — |
| LGN14 | 89165.3 | 3.98 | 0.28 | 8 | — | — | — |
| CONT. | — | 3.67 | — | — | 62.8 | — | — |
| LGN49 | 89079.3 | — | — | — | 86.8 | 0.29 | 12 |
| LGN49 | 89081.3 | 5.98 | 0.02 | 18 | 108.1 | 0.29 | 40 |
| LGN49 | 89081.6 | — | — | — | 85.0 | 0.12 | 10 |
| CONT. | — | 5.05 | — | — | 77.2 | — | — |
| LGN4 | 89075.2 | 5.00 | L | 27 | 87.5 | 0.02 | 19 |
| CONT. | — | 3.92 | — | — | 73.5 | — | — |

TABLE 264-continued

Genes showing improved plant performance at Low Nitrogen growth conditions under regulation of At6669 promoter

| Gene Name | Event # | Dry Weight [mg] Ave. | P-VaL | % Incr. | Fresh Weight [mg] Ave. | P-VaL | % Incr. |
|---|---|---|---|---|---|---|---|
| LGN23 | 92316.2 | 3.95 | 0.09 | 11 | — | — | — |
| LGN23 | 92317.2 | 4.15 | 0.27 | 16 | — | — | — |
| CONT. | — | 3.56 | — | — | — | — | — |
| LGN24 | 89096.3 | 3.55 | 0.25 | 3 | — | — | — |
| CONT. | — | 3.45 | — | — | — | — | — |
| LGN5 | 88198.1 | 5.40 | 0.07 | 8 | 95.8 | 0.17 | 17 |
| LGN5 | 88198.4 | 5.88 | 0.26 | 18 | 98.4 | 0.06 | 20 |
| LGN5 | 88203.2 | 5.00 | 0.19 | 7 | — | — | — |
| CONT. | — | 4.99 | — | — | 82.2 | — | — |
| LGN47 | 91174.3 | 4.98 | 0.20 | 13 | — | — | — |
| CONT. | — | 4.40 | — | — | — | — | — |
| LGN1 | 92184.1 | 4.22 | 0.10 | 8 | 104.6 | 0.14 | 32 |
| LGN1 | 92185.1 | 4.50 | L | 15 | — | — | — |
| LGN1 | 92185.2 | 4.40 | 0.10 | 12 | — | — | — |
| LGN1 | 92187.1 | 4.33 | 0.05 | 11 | 122.5 | 0.23 | 54 |
| LGN1 | 92188.1 | 4.77 | 0.08 | 22 | — | — | — |
| CONT. | — | 3.91 | — | — | 90.8 | — | — |
| LGN2 | 89029.2 | 4.35 | 0.13 | 10 | — | — | — |
| LGN2 | 89029.5 | 4.30 | 0.15 | 9 | — | — | — |
| LGN2 | 89032.2 | 4.40 | 0.11 | 11 | — | — | — |
| LGN2 | 89033.1 | 4.42 | 0.15 | 12 | 75.8 | 0.22 | 11 |
| CONT. | — | 3.96 | — | — | 68.1 | — | — |
| LGN45 | 91575.2 | — | — | — | 70.5 | L | 25 |
| LGN45 | 91575.3 | — | — | — | 67.1 | 0.27 | 19 |
| LGN45 | 91579.3 | — | — | — | 81.8 | 0.12 | 45 |
| LGN45 | 91579.4 | — | — | — | 87.3 | 0.12 | 55 |
| LGN45 | 91579.5 | — | — | — | 62.4 | 0.24 | 11 |
| CONT. | — | — | — | — | 56.3 | — | — |
| LGN33 | 91574.4 | 4.15 | 0.09 | 10 | 69.8 | 0.19 | 22 |
| CONT. | — | 3.76 | — | — | 57.3 | — | — |
| LGN57 | 89064.2 | 4.90 | 0.03 | 25 | 84.4 | 0.02 | 21 |
| LGN57 | 89065.1 | 3.88 | 0.28 | 3 | — | — | — |
| LGN57 | 89066.1 | — | — | — | 76.1 | 0.25 | 9 |
| CONT. | — | 3.92 | — | — | 70.0 | — | — |
| NUE102 | 90005.1 | — | — | — | 67.8 | 0.18 | 19 |
| CONT. | — | — | — | — | 57.0 | — | — |
| LGN42 | 92204.2 | 4.60 | 0.04 | 11 | — | — | — |
| LGN42 | 92204.5 | 5.17 | 0.12 | 25 | — | — | — |
| CONT. | — | 4.15 | — | — | — | — | — |
| LGN60 | 89176.1 | 5.47 | 0.13 | 23 | 81.9 | 0.29 | 8 |
| CONT. | — | 4.45 | — | — | 75.9 | — | — |

Table 264. "CONT."-Control; "Ave."-Average; "% Incr." = % increment; "p-val."-p-value. L-p < 0.01.

The genes presented in Table 265 showed a significant improvement as they produced larger plant biomass (plant fresh and dry weight) in $T_2$ generation when grown under normal growth conditions, compared to control plants. The genes were cloned under the regulation of a constitutive promoter (At6669, SEQ ID NO: 10654). The evaluation of each gene was carried out by testing the performance of different number of events. Some of the genes were evaluated in more than one seedling assay. The results obtained in these second experiments were significantly positive as well.

TABLE 265

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LBY200 | 92754.1 | 9.63 | 0.04 | 43 | 181.0 | L | 45 |
| LBY200 | 92754.3 | 7.60 | 0.16 | 13 | 159.2 | 0.02 | 27 |
| LBY200 | 92757.1 | 9.05 | 0.03 | 34 | 214.7 | 0.16 | 72 |
| LBY200 | 92757.2 | 8.27 | 0.03 | 23 | 168.6 | 0.08 | 35 |
| LBY200 | 92758.3 | — | — | — | 149.5 | 0.27 | 20 |
| LBY141 | 92564.1 | 10.3 | 0.08 | 53 | 188.0 | 0.07 | 50 |
| LBY141 | 92565.2 | 8.43 | 0.02 | 25 | 173.5 | 0.06 | 39 |
| LBY141 | 92566.3 | 8.70 | 0.17 | 29 | 158.8 | 0.16 | 27 |
| LBY141 | 92566.4 | — | — | — | 151.2 | 0.19 | 21 |
| LBY141 | 92568.1 | 7.77 | 0.12 | 15 | 154.4 | 0.15 | 24 |
| CONT. | — | 6.74 | — | — | 124.9 | — | — |
| LGN35 | 89043.2 | 8.68 | 0.04 | 20 | — | — | — |
| CONT. | — | 7.21 | — | — | — | — | — |
| LBY175 | 92179.1 | 10.6 | 0.24 | 22 | — | — | — |
| LBY175 | 92181.2 | 10.4 | 0.05 | 20 | — | — | — |
| LBY175 | 92181.4 | 9.75 | 0.29 | 12 | — | — | — |
| LBY149 | 92245.2 | 11.1 | 0.20 | 28 | — | — | — |
| LBY140 | 92265.2 | 11.1 | 0.03 | 28 | — | — | — |
| LBY116 | 92136.4 | 11.0 | 0.10 | 27 | — | — | — |
| LBY116 | 92138.6 | 13.0 | L | 50 | — | — | — |
| CONT. | — | 8.68 | — | — | — | — | — |
| LGN39 | 89931.3 | 7.60 | 0.15 | 40 | 131.1 | 0.15 | 36 |
| LGN34 | 90400.2 | 9.70 | L | 78 | 160.7 | L | 67 |
| LGN34 | 90403.3 | 7.22 | 0.15 | 33 | 132.1 | 0.15 | 37 |
| CONT. | — | 5.44 | — | — | 96.2 | — | — |
| NUE3 | 88975.1 | — | — | — | 131.7 | 0.26 | 20 |
| NUE3 | 88977.1 | 7.60 | 0.06 | 35 | 148.5 | 0.08 | 36 |
| NUE3 | 88977.2 | 6.42 | 0.09 | 14 | 168.8 | 0.15 | 54 |
| LGN9 | 89186.1 | 6.38 | 0.19 | 14 | 140.9 | 0.03 | 29 |
| LGN7 | 89183.3 | — | — | — | 125.9 | 0.29 | 15 |
| LGN7 | 89183.8 | — | — | — | 133.5 | 0.10 | 22 |
| LGN14 | 89168.1 | — | — | — | 128.2 | 0.21 | 17 |
| LGN14 | 89168.2 | 6.17 | 0.28 | 10 | 122.0 | 0.20 | 12 |

TABLE 265-continued

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LGN14 | 89168.5 | — | — | — | 148.4 | 0.26 | 36 |
| CONT. | — | 5.61 | — | — | 109.4 | — | — |
| LBY52 | 93946.3 | 10.4 | 0.29 | 22 | — | — | — |
| LBY34_H2 | 93855.2 | 10.0 | 0.17 | 17 | — | — | — |
| LBY34_H2 | 93856.1 | 11.2 | 0.04 | 30 | 185.2 | 0.02 | 39 |
| LBY27_H4 | 93931.4 | 10.3 | 0.19 | 21 | 170.9 | 0.12 | 28 |
| LBY148 | 93767.2 | 9.57 | 0.29 | 12 | 163.6 | 0.10 | 23 |
| CONT. | — | 8.55 | — | — | 133.3 | — | — |
| LGN26 | 89037.2 | 10.2 | 0.23 | 13 | 177.4 | 0.28 | 13 |
| LGN26 | 89037.3 | 12.9 | L | 43 | 224.2 | 0.04 | 43 |
| LGN26 | 89037.4 | 12.4 | L | 38 | 208.7 | 0.01 | 33 |
| CONT. | — | 9.00 | — | — | 156.9 | — | — |
| LGN46 | 89101.3 | 9.67 | 0.25 | 8 | — | — | — |
| LGN46 | 89101.7 | 10.6 | 0.23 | 15 | 187.6 | 0.21 | 20 |
| CONT. | — | 9.18 | — | — | 156.5 | — | — |
| LGN57 | 89064.2 | 11.2 | 0.09 | 45 | 212.9 | 0.11 | 58 |
| LGN57 | 89065.1 | 10.9 | 0.04 | 42 | 179.2 | 0.05 | 33 |
| LGN57 | 89067.1 | 9.67 | 0.08 | 25 | 188.2 | 0.05 | 39 |
| LGN57 | 89067.2 | — | — | — | 159.0 | 0.26 | 18 |
| CONT. | — | 7.74 | — | — | 135.1 | — | — |
| LGN36 | 89044.1 | 11.3 | 0.10 | 25 | 212.2 | 0.03 | 33 |
| CONT. | — | 9.03 | — | — | 159.9 | — | — |
| LBY185 | 91498.2 | 10.7 | 0.10 | 29 | — | — | — |
| LBY185 | 91499.2 | 10.9 | 0.12 | 32 | — | — | — |
| LBY185 | 91499.3 | 9.70 | 0.26 | 17 | 242.3 | 0.23 | 41 |
| LBY179 | 91545.2 | 10.6 | L | 28 | — | — | — |
| LBY173 | 91652.1 | 11.8 | L | 43 | 242.5 | 0.06 | 41 |
| LBY173 | 91653.1 | 11.4 | 0.26 | 38 | 238.1 | 0.29 | 38 |
| LBY121 | 92290.4 | 11.0 | 0.07 | 33 | 231.8 | 0.10 | 35 |
| CONT. | — | 8.27 | — | — | 172.1 | — | — |
| LGN54 | 88208.2 | 10.7 | 0.06 | 18 | 195.3 | 0.17 | 10 |
| CONT. | — | 9.05 | — | — | 180.3 | — | — |
| LBY80 | 92270.1 | 8.97 | 0.02 | 32 | — | — | — |
| LBY78 | 92311.3 | — | — | — | 166.2 | 0.28 | 16 |
| LBY78 | 92311.4 | 8.97 | L | 32 | 177.0 | 0.04 | 24 |
| LBY78 | 92312.2 | 7.75 | 0.20 | 14 | 165.0 | 0.28 | 15 |
| LBY78 | 92313.5 | 8.43 | 0.08 | 24 | 176.6 | 0.24 | 24 |
| LBY53 | 92414.1 | 7.75 | 0.09 | 14 | — | — | — |
| LBY53 | 92418.1 | 7.75 | 0.10 | 14 | — | — | — |
| LBY208 | 92356.1 | 8.45 | 0.03 | 24 | 173.0 | 0.03 | 21 |
| LBY208 | 92357.1 | 9.15 | 0.02 | 35 | 165.8 | 0.30 | 16 |
| LBY208 | 92358.2 | 8.38 | 0.02 | 23 | — | — | — |
| LBY208 | 92358.4 | 7.83 | 0.20 | 15 | 178.1 | 0.27 | 25 |
| LBY153 | 92249.2 | 9.53 | 0.01 | 40 | 194.5 | 0.01 | 36 |
| LBY153 | 92252.2 | 8.38 | 0.25 | 23 | — | — | — |
| LBY153 | 92253.2 | 8.35 | 0.16 | 23 | — | — | — |
| LBY149 | 92246.3 | 8.72 | 0.27 | 29 | 172.2 | 0.26 | 20 |
| LBY121 | 92290.3 | 8.60 | 0.10 | 27 | — | — | — |
| LBY121 | 92291.4 | 7.95 | 0.16 | 17 | 188.8 | 0.20 | 32 |
| LBY121 | 92293.2 | 8.30 | 0.11 | 22 | 167.4 | 0.29 | 17 |
| CONT. | — | 6.79 | — | — | 143.0 | — | — |
| LGN4 | 89075.2 | — | — | — | 167.8 | 0.27 | 16 |
| CONT. | — | — | — | — | 144.4 | — | — |
| LGN52 | 90578.6 | 7.38 | 0.25 | 20 | 156.5 | 0.08 | 30 |
| LGN52 | 90581.1 | 6.98 | 0.26 | 13 | 139.1 | 0.17 | 16 |
| CONT. | — | 6.16 | — | — | 119.9 | — | — |
| LGN41 | 92101.1 | 8.93 | 0.04 | 31 | — | — | — |
| LGN41 | 92102.3 | 8.78 | 0.11 | 28 | — | — | — |
| CONT. | — | 6.84 | — | — | — | — | — |
| LGN46 | 89101.4 | 7.75 | 0.08 | 24 | 140.6 | 0.27 | 14 |
| LGN46 | 89101.9 | 7.80 | 0.11 | 25 | 152.3 | 0.10 | 24 |
| CONT. | — | 6.24 | — | — | 122.9 | — | — |
| LGN45 | 91575.2 | 12.9 | 0.02 | 28 | 237.4 | L | 29 |
| LGN45 | 91575.3 | 13.0 | L | 29 | 283.7 | L | 54 |
| LGN45 | 91579.4 | 11.3 | 0.16 | 12 | 248.0 | 0.10 | 35 |
| CONT. | — | 10.1 | — | — | 183.7 | — | — |
| LBY92 | 93921.2 | 14.2 | 0.03 | 53 | 239.5 | L | 66 |
| LBY92 | 93923.3 | 12.4 | 0.21 | 33 | 197.2 | 0.18 | 37 |
| LBY201 | 93928.1 | 10.3 | 0.10 | 11 | — | — | — |
| LBY148 | 93764.1 | — | — | — | 163.2 | 0.14 | 13 |
| LBY106_H3 | 93918.1 | 14.4 | 0.09 | 55 | 218.1 | 0.12 | 51 |
| CONT. | — | 9.30 | — | — | 144.0 | — | — |
| LBY50 | 91317.3 | 9.18 | 0.01 | 39 | 177.3 | L | 42 |

TABLE 265-continued

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LBY50 | 91319.2 | 6.98 | 0.20 | 6 | 146.2 | 0.25 | 17 |
| LBY24 | 91220.6 | 7.45 | 0.25 | 13 | 144.4 | 0.08 | 16 |
| LBY24 | 91221.2 | 8.70 | 0.22 | 32 | 183.0 | 0.17 | 46 |
| LBY24 | 91223.1 | 7.47 | 0.29 | 13 | 152.3 | 0.25 | 22 |
| LBY21 | 90977.1 | 7.55 | 0.14 | 14 | 138.2 | 0.14 | 11 |
| LBY21 | 90978.4 | — | — | — | 151.9 | 0.28 | 22 |
| LBY161 | 91293.3 | 8.60 | L | 30 | 195.4 | 0.11 | 56 |
| LBY161 | 91294.1 | 8.78 | 0.02 | 33 | 200.6 | 0.17 | 61 |
| LBY161 | 91294.2 | — | — | — | 152.0 | 0.24 | 22 |
| LBY15 | 91142.2 | 8.40 | L | 27 | 149.2 | 0.02 | 19 |
| LBY15 | 91144.2 | 7.75 | 0.23 | 17 | — | — | — |
| LBY15 | 91144.3 | 7.62 | 0.20 | 16 | 142.9 | 0.30 | 14 |
| CONT. | — | 6.60 | — | — | 124.9 | — | — |
| LGN23 | 92316.2 | 9.55 | 0.10 | 16 | 187.0 | 0.15 | 24 |
| LGN23 | 92317.2 | 11.3 | 0.09 | 38 | 225.3 | 0.01 | 49 |
| LGN23 | 92318.1 | — | — | — | 169.7 | 0.30 | 13 |
| CONT. | — | 8.21 | — | — | 150.9 | — | — |
| LGN48 | 89063.2 | — | — | — | 159.5 | 0.05 | 24 |
| CONT. | — | — | — | — | 128.4 | — | — |
| LGN18 | 92466.3 | 12.3 | 0.06 | 44 | 239.0 | 0.03 | 64 |
| CONT. | — | 8.59 | — | — | 146.0 | — | — |
| LBY41 | 91620.4 | 11.4 | L | 40 | 201.0 | 0.12 | 30 |
| LBY41 | 91621.1 | 10.2 | 0.05 | 26 | 197.6 | L | 28 |
| LBY41 | 91623.1 | — | — | — | 194.6 | 0.27 | 26 |
| LBY41 | 91623.2 | 9.95 | 0.08 | 22 | 185.4 | 0.19 | 20 |
| LBY186 | 91657.1 | 12.0 | 0.03 | 48 | 204.2 | 0.06 | 32 |
| LBY186 | 91659.1 | 12.9 | L | 59 | 208.0 | 0.12 | 34 |
| LBY186 | 91659.3 | 10.8 | L | 33 | 202.0 | 0.10 | 30 |
| LBY186 | 91659.4 | 10.1 | 0.21 | 25 | 203.0 | 0.12 | 31 |
| LBY166 | 91542.5 | 9.32 | 0.09 | 15 | 198.1 | 0.04 | 28 |
| LBY166 | 91544.3 | 14.4 | L | 77 | 257.0 | L | 66 |
| LBY166 | 91544.4 | 9.25 | 0.14 | 14 | 186.1 | 0.06 | 20 |
| LBY166 | 91544.5 | 10.1 | 0.03 | 24 | 206.3 | 0.08 | 33 |
| CONT. | — | 8.14 | — | — | 155.0 | — | — |
| LGN35 | 89043.1 | 12.3 | L | 40 | 231.9 | 0.04 | 47 |
| LGN35 | 89043.4 | 10.5 | 0.13 | 19 | — | — | — |
| CONT. | — | 8.80 | — | — | 157.3 | — | — |
| LGN33 | 91572.1 | 7.45 | 0.02 | 24 | 127.4 | 0.05 | 20 |
| LGN33 | 91572.3 | 7.95 | 0.02 | 32 | 144.4 | 0.02 | 36 |
| LGN33 | 91574.2 | 7.00 | 0.26 | 16 | 130.4 | 0.20 | 23 |
| CONT. | — | 6.01 | — | — | 106.3 | — | — |
| LGN18 | 92468.3 | 10.3 | 0.03 | 33 | 170.2 | 0.06 | 31 |
| LGN18 | 92468.5 | 9.62 | 0.23 | 24 | 188.2 | 0.08 | 45 |
| CONT. | — | 7.75 | — | — | 130.2 | — | — |
| LBY186 | 91657.1 | 9.30 | 0.20 | 23 | 161.8 | 0.12 | 28 |
| LBY186 | 91659.1 | 10.2 | 0.11 | 36 | 161.5 | 0.15 | 28 |
| LBY179 | 91549.1 | 10.2 | 0.02 | 35 | 164.2 | 0.02 | 30 |
| LBY179 | 91549.3 | 10.2 | 0.18 | 36 | 170.1 | 0.15 | 35 |
| LBY152 | 91286.1 | 9.95 | 0.16 | 32 | 171.2 | 0.10 | 35 |
| LBY152 | 91287.1 | 8.82 | 0.28 | 17 | 147.7 | 0.27 | 17 |
| LBY152 | 91289.2 | 10.6 | 0.04 | 40 | 173.8 | 0.08 | 37 |
| LBY123 | 91427.1 | 9.12 | 0.11 | 21 | 170.6 | 0.07 | 35 |
| CONT. | — | 7.56 | — | — | 126.4 | — | — |
| LBY203 | 92841.2 | 9.28 | 0.05 | 14 | 209.4 | 0.13 | 49 |
| LBY180 | 92578.5 | 9.38 | 0.02 | 15 | — | — | — |
| LBY177 | 92497.1 | — | — | — | 195.0 | 0.15 | 39 |
| LBY144 | 93061.6 | 9.75 | L | 19 | 193.8 | 0.03 | 38 |
| LBY111 | 92797.3 | 10.1 | 0.08 | 24 | — | — | — |
| CONT. | — | 8.16 | — | — | 140.5 | — | — |
| LGN47 | 91174.2 | 9.65 | 0.22 | 20 | 179.3 | 0.26 | 17 |
| LGN47 | 91174.3 | 10.3 | 0.17 | 20 | — | — | — |
| LGN47 | 91174.4 | 9.67 | 0.21 | 12 | 170.8 | 0.21 | 11 |
| CONT. | — | 8.64 | — | — | 177.7 | — | — |
| LGN42 | 92204.2 | 11.1 | 0.12 | 23 | — | — | — |
| CONT. | — | 9.00 | — | — | — | — | — |
| LBY203 | 92841.2 | — | — | — | 143.4 | 0.20 | 14 |
| LBY203 | 92842.4 | — | — | — | 165.9 | L | 32 |
| LBY191 | 92519.1 | — | — | — | 200.1 | 0.07 | 59 |
| LBY191 | 92519.2 | 10.1 | 0.17 | 25 | 169.4 | 0.15 | 34 |
| LBY191 | 92522.1 | — | — | — | 151.0 | 0.16 | 20 |
| LBY191 | 92523.3 | — | — | — | 176.1 | 0.26 | 40 |
| LBY167 | 92772.1 | — | — | — | 190.1 | 0.21 | 51 |
| LBY167 | 92773.4 | 9.67 | 0.08 | 20 | 168.5 | 0.02 | 34 |

TABLE 265-continued

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LBY144 | 93059.3 | 10.1 | 0.03 | 25 | 202.9 | 0.02 | 61 |
| LBY144 | 93061.4 | — | — | — | 167.1 | 0.12 | 33 |
| LBY144 | 93061.5 | 8.72 | 0.21 | 8 | 181.0 | L | 44 |
| LBY144 | 93061.6 | 11.1 | L | 37 | 190.3 | L | 51 |
| LBY144 | 93062.2 | — | — | — | 164.4 | 0.19 | 31 |
| LBY111 | 92797.3 | 8.95 | 0.25 | 11 | 160.0 | 0.17 | 27 |
| LBY111 | 92798.1 | 9.45 | 0.18 | 17 | — | — | — |
| CONT. | — | 8.08 | — | — | 126.0 | — | — |
| LGN41 | 92102.2 | 6.50 | 0.02 | 31 | 113.5 | 0.27 | 11 |
| LGN41 | 92102.3 | 6.47 | 0.23 | 30 | 152.8 | 0.24 | 49 |
| CONT. | — | 4.98 | — | — | 102.3 | — | — |
| NUE3 | 88975.2 | 4.70 | 0.05 | 17 | — | — | — |
| NUE3 | 88977.2 | 5.20 | 0.12 | 29 | 93.5 | 0.05 | 27 |
| NUE3 | 88977.5 | — | — | — | 95.2 | 0.03 | 29 |
| LGN7 | 89181.1 | 5.07 | 0.19 | 26 | — | — | — |
| LGN7 | 89183.2 | 4.42 | 0.19 | 10 | — | — | — |
| LGN14 | 89165.3 | 4.98 | 0.12 | 24 | 84.5 | 0.15 | 15 |
| LGN14 | 89167.3 | 5.40 | 0.06 | 34 | 92.1 | 0.03 | 25 |
| LGN14 | 89168.1 | 4.47 | 0.20 | 11 | — | — | — |
| LGN14 | 89168.2 | 4.53 | 0.13 | 12 | 86.0 | 0.15 | 17 |
| LGN14 | 89168.5 | — | — | — | 86.7 | 0.12 | 18 |
| CONT. | — | 4.03 | — | — | 73.6 | — | — |
| LGN4 | 89075.2 | 5.77 | 0.13 | 22 | 111.9 | 0.03 | 19 |
| CONT. | — | 4.75 | — | — | 93.9 | — | — |
| LGN49 | 89079.1 | — | — | — | 185.7 | 0.23 | 23 |
| LGN49 | 89081.3 | 14.6 | 0.02 | 65 | 265.8 | 0.04 | 76 |
| LGN49 | 89081.4 | 10.8 | 0.03 | 23 | 190.3 | 0.03 | 26 |
| LGN49 | 89081.6 | — | — | — | 174.2 | 0.21 | 16 |
| CONT. | — | 8.82 | — | — | 150.7 | — | — |
| LGN34 | 90403.2 | 9.70 | 0.26 | 14 | — | — | — |
| CONT. | — | 8.47 | — | — | — | — | — |
| LGN52 | 90581.4 | — | — | — | 148.5 | 0.04 | 26 |
| CONT. | — | — | — | — | 117.5 | — | — |
| LBY71 | 93769.2 | 7.25 | 0.08 | 24 | 131.9 | 0.08 | 26 |
| LBY71 | 93769.3 | 7.10 | 0.13 | 22 | 128.9 | 0.14 | 23 |
| LBY71 | 93773.2 | 8.02 | 0.06 | 37 | 139.7 | 0.04 | 33 |
| LBY68 | 93860.3 | 7.28 | 0.06 | 25 | 137.0 | 0.09 | 31 |
| LBY68 | 93862.1 | 7.65 | 0.11 | 31 | 139.1 | 0.08 | 33 |
| LBY68 | 93862.2 | 6.88 | 0.19 | 18 | 124.4 | 0.18 | 19 |
| LBY61 | 94019.1 | 6.65 | 0.27 | 14 | — | — | — |
| LBY61 | 94023.2 | 6.80 | 0.18 | 16 | 128.2 | 0.10 | 22 |
| LBY6 | 94111.3 | — | — | — | 128.5 | 0.20 | 23 |
| LBY52 | 93946.2 | 6.92 | 0.23 | 19 | 128.8 | 0.23 | 23 |
| LBY5 | 93941.3 | 7.58 | 0.14 | 30 | 135.2 | 0.21 | 29 |
| LBY44 | 92492.1 | 6.72 | 0.19 | 15 | — | — | — |
| LBY34_H2 | 93855.2 | 8.38 | 0.03 | 43 | 145.2 | 0.01 | 39 |
| LBY34_H2 | 93857.1 | 8.47 | 0.03 | 45 | 142.5 | 0.06 | 36 |
| LBY34_H2 | 93857.2 | 8.30 | 0.02 | 42 | 152.4 | 0.05 | 45 |
| LBY181 | 92479.3 | 7.17 | 0.14 | 23 | 137.1 | 0.02 | 31 |
| LBY181 | 92480.5 | 7.10 | 0.10 | 22 | 123.9 | 0.18 | 18 |
| LBY181 | 92482.1 | 7.15 | 0.11 | 22 | 127.9 | 0.08 | 22 |
| LBY142 | 93199.1 | 7.28 | 0.06 | 25 | 136.8 | 0.01 | 31 |
| LBY142 | 93203.3 | 8.82 | 0.02 | 51 | 153.2 | 0.02 | 46 |
| LBY142 | 93203.4 | 8.40 | L | 44 | 148.9 | L | 42 |
| CONT. | — | 5.84 | — | — | 104.8 | — | — |
| LBY41 | 91621.2 | 8.18 | 0.04 | 21 | — | — | — |
| LBY41 | 91623.1 | 7.83 | 0.23 | 16 | — | — | — |
| LBY41 | 91623.2 | 8.05 | 0.07 | 19 | 149.5 | 0.11 | 22 |
| LBY173 | 91652.1 | 11.4 | L | 69 | 198.8 | L | 63 |
| LBY173 | 91652.2 | 7.75 | 0.26 | 15 | 143.2 | 0.15 | 17 |
| LBY173 | 91652.5 | 16.3 | 0.02 | 142 | 256.3 | 0.05 | 110 |
| LBY173 | 91653.1 | 7.75 | 0.20 | 15 | — | — | — |
| LBY166 | 91542.5 | 10.7 | 0.04 | 58 | 188.8 | 0.08 | 54 |
| LBY166 | 91544.5 | 9.60 | 0.12 | 42 | 165.3 | 0.25 | 35 |
| CONT. | — | 6.75 | — | — | 122.3 | — | — |
| LBY85 | 92064.1 | 8.05 | 0.19 | 10 | 210.5 | 0.18 | 33 |
| LBY85 | 92066.2 | 8.40 | 0.27 | 15 | 183.0 | 0.19 | 16 |
| LBY85 | 92066.3 | 9.67 | 0.04 | 32 | 225.5 | 0.05 | 43 |
| LBY85 | 92066.5 | 9.62 | 0.02 | 32 | 213.3 | 0.04 | 35 |
| LBY85 | 92068.3 | 8.93 | 0.28 | 22 | — | — | — |
| LBY64 | 91340.4 | 8.02 | 0.22 | 10 | 178.5 | 0.13 | 13 |
| LBY64 | 91342.3 | 8.20 | 0.13 | 12 | 193.4 | 0.01 | 23 |
| LBY46 | 92200.3 | 8.35 | 0.09 | 14 | — | — | — |

TABLE 265-continued

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LBY46 | 92201.4 | 8.70 | 0.23 | 19 | — | — | — |
| LBY207 | 92155.1 | 9.40 | 0.06 | 29 | 189.7 | 0.28 | 20 |
| LBY207 | 92158.2 | 9.30 | 0.20 | 27 | — | — | — |
| LBY185 | 91497.2 | 9.53 | L | 30 | 192.1 | 0.25 | 22 |
| LBY185 | 91498.2 | 8.00 | 0.27 | 9 | — | — | — |
| LBY185 | 91499.2 | 11.4 | 0.01 | 56 | 260.1 | 0.05 | 65 |
| LBY185 | 91499.3 | 8.85 | 0.07 | 21 | 190.4 | 0.06 | 21 |
| LBY17 | 92215.4 | 9.03 | 0.06 | 23 | 215.6 | 0.07 | 37 |
| LBY17 | 92216.2 | 11.8 | 0.04 | 61 | 241.7 | L | 53 |
| LBY155 | 92015.1 | 10.1 | L | 38 | 227.4 | 0.04 | 44 |
| LBY155 | 92016.4 | 9.48 | 0.25 | 30 | — | — | — |
| LBY155 | 92016.5 | 8.25 | 0.24 | 13 | 177.9 | 0.13 | 13 |
| LBY122 | 91370.2 | 11.0 | 0.05 | 51 | 257.8 | L | 63 |
| LBY122 | 91371.3 | — | — | — | 192.8 | 0.14 | 22 |
| LBY122 | 91371.6 | 11.2 | 0.02 | 54 | 243.3 | 0.05 | 54 |
| LBY122 | 91374.1 | 8.57 | 0.15 | 17 | 194.1 | 0.18 | 23 |
| CONT. | — | 7.31 | — | — | 157.8 | — | — |
| LBY50 | 91319.2 | — | — | — | 178.2 | 0.12 | 17 |
| LBY24 | 91220.6 | 10.2 | 0.21 | 12 | 175.8 | 0.24 | 16 |
| LBY24 | 91221.2 | 11.3 | 0.05 | 24 | 183.2 | 0.28 | 21 |
| LBY21 | 90978.4 | — | — | — | 172.7 | 0.09 | 14 |
| LBY21 | 90980.1 | 11.2 | 0.08 | 23 | — | — | — |
| LBY152 | 91286.1 | 9.97 | 0.16 | 9 | 186.0 | 0.03 | 23 |
| LBY152 | 91289.4 | — | — | — | 166.7 | 0.25 | 10 |
| LBY123 | 91428.2 | 10.8 | 0.03 | 18 | 184.8 | 0.02 | 22 |
| LBY123 | 91429.2 | 10.1 | 0.25 | 11 | — | — | — |
| LBY123 | 91429.3 | 10.5 | 0.07 | 15 | 195.1 | L | 29 |
| LBY114 | 91393.1 | 12.1 | 0.16 | 32 | 214.1 | 0.06 | 41 |
| LBY114 | 91393.2 | 13.2 | 0.04 | 45 | 199.1 | 0.02 | 31 |
| CONT. | — | 9.11 | — | — | 151.7 | — | — |
| LGN24 | 89096.3 | 7.80 | 0.13 | 25 | — | — | — |
| CONT. | — | 6.24 | — | — | — | — | — |
| LGN23 | 92316.2 | 10.4 | L | 37 | 208.5 | 0.08 | 21 |
| LGN23 | 92317.2 | 8.93 | 0.02 | 17 | — | — | — |
| CONT. | — | 7.60 | — | — | 172.5 | — | — |
| LBY93 | 92656.1 | — | — | — | 200.3 | 0.28 | 14 |
| LBY93 | 92657.3 | — | — | — | 227.9 | 0.24 | 29 |
| LBY76 | 92642.1 | 12.6 | L | 40 | 233.2 | 0.01 | 32 |
| LBY76 | 92642.2 | 11.3 | 0.20 | 25 | — | — | — |
| LBY76 | 92642.3 | 12.7 | L | 40 | 234.7 | 0.01 | 33 |
| LBY76 | 92642.4 | 10.3 | 0.25 | 14 | 241.8 | 0.30 | 37 |
| LBY70 | 92684.2 | 13.5 | L | 49 | 290.3 | 0.05 | 65 |
| LBY70 | 92685.5 | 11.1 | 0.08 | 23 | 217.6 | 0.11 | 23 |
| LBY70 | 92686.2 | 12.4 | L | 38 | 237.9 | 0.22 | 35 |
| LBY227 | 92851.1 | 11.1 | 0.17 | 23 | 223.8 | 0.26 | 27 |
| LBY227 | 92852.3 | 10.6 | 0.24 | 18 | 240.6 | 0.03 | 36 |
| LBY227 | 92853.1 | 13.0 | L | 44 | — | — | — |
| LBY183 | 92516.2 | 11.0 | 0.11 | 21 | — | — | — |
| LBY180 | 92578.5 | — | — | — | 200.7 | 0.24 | 14 |
| LBY159 | 92150.4 | 10.6 | 0.07 | 17 | 226.2 | 0.16 | 28 |
| LBY159 | 92152.1 | 10.3 | 0.21 | 14 | — | — | — |
| LBY159 | 92152.2 | 13.6 | L | 50 | 271.5 | 0.03 | 54 |
| LBY159 | 92152.3 | 10.9 | 0.14 | 21 | — | — | — |
| LBY159 | 92153.1 | 10.7 | 0.21 | 18 | — | — | — |
| LBY156 | 92294.1 | 13.6 | L | 50 | 233.4 | 0.10 | 32 |
| LBY156 | 92294.2 | 10.7 | 0.05 | 18 | — | — | — |
| LBY156 | 92294.3 | 12.7 | 0.07 | 41 | 239.4 | 0.16 | 36 |
| LBY156 | 92298.1 | 11.3 | 0.23 | 25 | — | — | — |
| LBY156 | 92298.2 | 11.8 | 0.23 | 30 | — | — | — |
| LBY145 | 92604.1 | — | — | — | 233.8 | 0.17 | 33 |
| LBY145 | 92607.1 | — | — | — | 238.0 | 0.22 | 35 |
| LBY145 | 92608.4 | 11.2 | 0.18 | 24 | — | — | — |
| CONT. | — | 9.04 | — | — | 176.3 | — | — |
| LGN47 | 91174.3 | 10.1 | 0.06 | 30 | 163.8 | 0.06 | 23 |
| LGN47 | 91174.6 | 9.40 | L | 22 | — | — | — |
| CONT. | — | 7.73 | — | — | 133.1 | — | — |
| LGN1 | 92185.1 | 9.05 | 0.21 | 27 | — | — | — |
| LGN1 | 92185.2 | 8.70 | 0.28 | 23 | — | — | — |
| LGN1 | 92187.1 | 7.75 | 0.29 | 8 | 163.1 | 0.24 | 18 |
| LGN1 | 92188.1 | 10.6 | 0.05 | 48 | 210.0 | 0.12 | 52 |
| CONT. | — | 7.15 | — | — | 138.4 | — | — |
| LGN33 | 91572.1 | — | — | — | 156.2 | 0.06 | 32 |
| CONT. | — | — | — | — | 117.9 | — | — |

TABLE 265-continued

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LGN45 | 91575.3 | 14.2 | 0.02 | 70 | 275.9 | L | 82 |
| LGN45 | 91579.4 | 10.4 | 0.24 | 24 | — | — | — |
| LGN45 | 91579.5 | 10.7 | L | 28 | 215.8 | 0.13 | 42 |
| CONT. | — | 8.36 | — | — | 151.9 | — | — |
| LBY44 | 92491.2 | — | — | — | 152.8 | 0.26 | 18 |
| LBY43 | 92680.1 | 8.97 | 0.09 | 13 | — | — | — |
| LBY181 | 92479.3 | 11.7 | 0.01 | 47 | 172.8 | 0.04 | 34 |
| LBY181 | 92480.4 | 9.80 | 0.27 | 23 | — | — | — |
| LBY181 | 92480.5 | 12.6 | L | 58 | 199.9 | 0.02 | 55 |
| LBY181 | 92482.1 | 10.6 | L | 33 | 171.7 | 0.05 | 33 |
| LBY167 | 92770.4 | 10.7 | 0.02 | 34 | 180.9 | 0.16 | 40 |
| LBY167 | 92772.2 | 10.3 | 0.08 | 29 | 196.0 | 0.02 | 52 |
| LBY167 | 92773.1 | 9.53 | 0.12 | 20 | 163.6 | 0.12 | 26 |
| LBY157 | 92799.3 | 10.6 | 0.17 | 33 | 165.5 | 0.16 | 28 |
| LBY157 | 92802.2 | 10.1 | 0.21 | 27 | — | — | — |
| LBY157 | 92802.3 | 9.50 | 0.04 | 19 | — | — | — |
| LBY157 | 92803.1 | 11.7 | 0.01 | 47 | 177.2 | 0.13 | 37 |
| LBY157 | 92803.2 | 11.5 | 0.05 | 45 | 214.5 | 0.21 | 66 |
| CONT. | — | 7.96 | — | — | 129.4 | — | — |
| LBY53 | 92414.1 | 9.65 | 0.19 | 31 | 187.2 | 0.28 | 34 |
| LBY53 | 92416.1 | 10.7 | 0.10 | 46 | 212.1 | 0.18 | 52 |
| LBY53 | 92417.3 | 8.88 | 0.17 | 21 | — | — | — |
| LBY31 | 92344.2 | — | — | — | 186.1 | 0.20 | 33 |
| LBY31 | 92347.1 | — | — | — | 166.8 | 0.16 | 19 |
| LBY208 | 92358.2 | 9.30 | 0.29 | 26 | 211.8 | 0.04 | 51 |
| LBY208 | 92358.4 | 9.32 | 0.14 | 27 | 177.9 | 0.14 | 27 |
| LBY207 | 92154.1 | 8.95 | 0.19 | 22 | 195.9 | 0.12 | 40 |
| LBY207 | 92155.1 | 9.65 | 0.09 | 31 | 189.6 | 0.12 | 36 |
| LBY207 | 92157.3 | 10.0 | 0.07 | 36 | — | — | — |
| LBY175 | 92179.3 | 9.10 | 0.29 | 24 | — | — | — |
| LBY175 | 92180.3 | 10.8 | 0.16 | 46 | 213.7 | 0.24 | 53 |
| LBY175 | 92181.3 | 10.5 | 0.18 | 42 | 210.2 | 0.24 | 50 |
| LBY175 | 92181.4 | 12.1 | 0.07 | 65 | 213.9 | 0.10 | 53 |
| LBY140 | 92265.2 | 10.6 | L | 43 | 181.4 | 0.06 | 30 |
| LBY140 | 92266.3 | 8.60 | 0.26 | 17 | 161.8 | 0.30 | 16 |
| LBY116 | 92136.3 | 10.1 | 0.03 | 37 | 185.6 | 0.04 | 33 |
| LBY116 | 92136.4 | 11.8 | 0.14 | 60 | 206.2 | 0.27 | 47 |
| LBY116 | 92138.6 | 11.0 | 0.04 | 49 | 200.2 | 0.09 | 43 |
| CONT. | — | 7.36 | — | — | 139.9 | — | — |
| LGN2 | 89029.2 | 11.2 | 0.03 | 46 | 218.5 | 0.13 | 58 |
| LGN2 | 89029.5 | 9.70 | L | 27 | 192.2 | 0.10 | 39 |
| LGN2 | 89032.2 | 9.07 | 0.28 | 19 | — | — | — |
| LGN2 | 89032.3 | 8.68 | 0.07 | 14 | 196.9 | 0.14 | 43 |
| LGN2 | 89033.1 | 9.83 | 0.09 | 29 | 166.9 | 0.18 | 21 |
| CONT. | — | 7.61 | — | — | 138.1 | — | — |
| LGN57 | 89064.2 | 9.28 | L | 45 | 184.3 | L | 41 |
| LGN57 | 89067.3 | 7.85 | L | 23 | 139.2 | 0.15 | 9 |
| CONT. | — | 6.39 | — | — | 131.1 | — | — |
| LGN42 | 92204.3 | 8.62 | 0.06 | 17 | — | — | — |
| CONT. | — | 7.35 | — | — | — | — | — |
| NUE102 | 90004.2 | 11.4 | 0.19 | 22 | 190.5 | 0.24 | 29 |
| NUE102 | 90004.3 | 10.6 | 0.07 | 14 | 169.4 | 0.06 | 15 |
| NUE102 | 90005.1 | 11.9 | 0.13 | 28 | 189.8 | 0.12 | 28 |
| NUE102 | 90005.3 | 11.5 | 0.03 | 24 | 181.9 | 0.03 | 23 |
| CONT. | — | 9.30 | — | — | 147.8 | — | — |
| LBY85 | 92064.1 | 9.97 | L | 27 | 178.8 | L | 26 |
| LBY85 | 92066.3 | 8.90 | 0.06 | 13 | 170.1 | 0.15 | 20 |
| LBY85 | 92066.5 | 9.28 | 0.12 | 18 | 177.7 | 0.05 | 25 |
| LBY64 | 91342.6 | 9.45 | 0.18 | 20 | 173.7 | 0.10 | 22 |
| LBY46 | 92200.3 | — | — | — | 247.5 | 0.05 | 74 |
| LBY46 | 92201.2 | 10.2 | 0.12 | 29 | 184.8 | 0.01 | 30 |
| LBY46 | 92201.4 | 10.4 | 0.08 | 32 | 197.7 | 0.07 | 39 |
| LBY46 | 92202.1 | 8.93 | 0.18 | 13 | 157.7 | 0.22 | 11 |
| LBY17 | 92215.4 | — | — | — | 205.7 | 0.18 | 45 |
| LBY17 | 92216.3 | 10.9 | L | 39 | 218.8 | 0.02 | 54 |
| LBY155 | 92015.1 | 9.85 | 0.07 | 25 | 211.3 | L | 49 |
| LBY155 | 92016.7 | 10.2 | 0.06 | 29 | 186.8 | 0.02 | 31 |
| LBY122 | 91371.2 | 8.72 | 0.15 | 11 | 172.9 | 0.23 | 22 |
| LBY122 | 91371.3 | — | — | — | 200.1 | 0.08 | 41 |
| LBY122 | 91371.4 | — | — | — | 170.1 | 0.12 | 20 |
| LBY122 | 91371.6 | — | — | — | 167.7 | 0.21 | 18 |
| LBY122 | 91374.1 | 9.72 | 0.23 | 23 | 190.0 | 0.23 | 33 |
| CONT. | — | 7.88 | — | — | 142.3 | — | — |

TABLE 265-continued

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LGN60 | 89174.2 | 9.32 | 0.04 | 27 | 170.0 | 0.19 | 14 |
| LGN60 | 89175.3 | 8.78 | 0.08 | 19 | 169.6 | 0.25 | 14 |
| LGN60 | 89176.1 | 10.2 | 0.16 | 38 | — | — | — |
| LGN60 | 89176.2 | 8.60 | 0.16 | 17 | — | — | — |
| CONT. | — | 7.35 | — | — | 148.5 | — | — |
| LBY92 | 93921.2 | 14.2 | 0.03 | 53 | 239.5 | L | 66 |
| LBY92 | 93923.3 | 12.4 | 0.21 | 33 | 197.2 | 0.18 | 37 |
| CONT. | — | 9.30 | — | — | 144.0 | — | — |

Table 265. "CONT."-Control; "Ave."-Average; "% Incr." = % increment; "p-val."-p-value, L-p < 0.01.

The genes presented in Table 264 showed a significant improvement as they produced larger plant biomass (plant fresh and dry weight) in T2 generation when grown under low nitrogen growth conditions, compared to control plants. The genes were cloned under the regulation of a constitutive promoter (At6669, SEQ ID NO: 10654). The evaluation of each gene was carried out by testing the performance of different number of events. Some of the genes were evaluated in more than one seedling assay. The results obtained in these second experiments were significantly positive as well.

TABLE 266

Genes showing improved plant performance at Low Nitrogen growth conditions under regulation of At6669 promoter

| Gene Name | Event # | Dry Weight [mg] | | | Fresh Weight [mg] | | |
|---|---|---|---|---|---|---|---|
| | | Ave. | P-VaL | % Incr. | Ave. | P-VaL | % Incr. |
| LBY186 | 91657.1 | 4.45 | 0.11 | 16 | — | — | — |
| LBY186 | 91659.1 | 4.15 | 0.23 | 8 | — | — | — |
| LBY186 | 91659.3 | 4.42 | 0.02 | 15 | 75.2 | 0.08 | 17 |
| LBY179 | 91549.1 | 4.25 | 0.27 | 10 | — | — | — |
| LBY152 | 91286.1 | 4.50 | 0.01 | 17 | — | — | — |
| LBY152 | 91288.2 | 4.45 | 0.05 | 16 | — | — | — |
| LBY123 | 91428.2 | 4.15 | 0.16 | 8 | — | — | — |
| LBY123 | 91429.2 | 4.10 | 0.19 | 6 | — | — | — |
| LBY123 | 91429.3 | 4.20 | 0.15 | 9 | — | — | — |
| LBY114 | 91391.2 | 4.30 | 0.13 | 12 | 73.7 | 0.16 | 15 |
| CONT. | — | 3.85 | — | — | 64.1 | — | — |
| LBY203 | 92839.1 | 4.83 | 0.13 | 10 | 73.0 | 0.14 | 20 |
| LBY203 | 92841.2 | — | — | — | 80.9 | 0.03 | 33 |
| LBY203 | 92842.3 | — | — | — | 95.1 | 0.06 | 56 |
| LBY180 | 92576.2 | — | — | — | 75.8 | 0.10 | 25 |
| LBY180 | 92576.3 | 4.65 | 0.25 | 6 | 71.3 | 0.18 | 17 |
| LBY180 | 92578.5 | 4.85 | 0.04 | 11 | — | — | — |
| LBY177 | 92495.1 | — | — | — | 77.1 | 0.10 | 27 |
| LBY177 | 92497.3 | — | — | — | 72.2 | 0.29 | 19 |
| LBY144 | 93059.3 | — | — | — | 80.1 | 0.13 | 32 |
| LBY144 | 93061.4 | — | — | — | 78.3 | L | 29 |
| LBY144 | 93061.6 | 5.10 | 0.29 | 16 | 82.5 | 0.15 | 36 |
| LBY111 | 92794.4 | 5.00 | 0.11 | 14 | 72.2 | 0.17 | 19 |
| LBY111 | 92797.1 | — | — | — | 80.7 | 0.02 | 33 |
| LBY111 | 92798.1 | — | — | — | 69.0 | 0.11 | 13 |
| LBY111 | 92798.4 | — | — | — | 70.5 | 0.18 | 16 |
| CONT. | — | 4.39 | — | — | 60.9 | — | — |
| LBY191 | 92523.3 | 4.72 | 0.08 | 7 | — | — | — |
| LBY167 | 92773.4 | 4.62 | 0.26 | 5 | — | — | — |
| LBY144 | 93059.3 | 4.80 | 0.09 | 8 | — | — | — |
| CONT. | — | 4.42 | — | — | — | — | — |
| LBY78 | 92311.4 | 4.88 | 0.22 | 10 | — | — | — |
| LBY31 | 92344.1 | 5.00 | 0.08 | 13 | 99.2 | 0.04 | 31 |
| LBY31 | 92345.4 | 5.20 | 0.15 | 18 | — | — | — |
| LBY175 | 92179.1 | 5.05 | 0.07 | 14 | — | — | — |
| LBY175 | 92181.2 | 5.22 | L | 18 | 87.0 | 0.11 | 15 |
| LBY175 | 92181.4 | 5.55 | 0.09 | 26 | 91.9 | 0.20 | 21 |
| LBY140 | 92268.2 | — | — | — | 81.6 | 0.18 | 8 |
| LBY116 | 92136.4 | 4.95 | 0.18 | 12 | 84.8 | 0.19 | 12 |
| CONT. | — | 4.41 | — | — | 75.7 | — | — |
| LBY5 | 93939.4 | 5.95 | 0.19 | 35 | 100.7 | 0.17 | 44 |
| LBY34_H2 | 93856.1 | 4.90 | 0.08 | 11 | — | — | — |
| LBY27_H4 | 93930.1 | — | — | — | 93.3 | 0.22 | 34 |
| LBY183 | 92516.5 | 5.70 | 0.14 | 29 | 87.6 | 0.03 | 26 |
| LBY159 | 92152.3 | — | — | — | 83.5 | 0.04 | 20 |

TABLE 266-continued

Genes showing improved plant performance at Low Nitrogen growth conditions under regulation of At6669 promoter

| Gene Name | Event # | Dry Weight [mg] | | | Fresh Weight [mg] | | |
|---|---|---|---|---|---|---|---|
| | | Ave. | P-VaL | % Incr. | Ave. | P-VaL | % Incr. |
| LBY159 | 92153.1 | 4.95 | 0.21 | 12 | — | — | — |
| LBY157 | 92803.1 | 5.58 | L | 26 | — | — | — |
| LBY148 | 93767.2 | — | — | — | 81.2 | 0.09 | 16 |
| LBY148 | 93768.1 | 4.85 | 0.11 | 10 | — | — | — |
| CONT. | — | 4.41 | — | — | 69.7 | — | — |
| LBY80 | 92269.3 | 4.60 | L | 17 | 66.8 | 0.05 | 25 |
| LBY80 | 92270.1 | 4.55 | 0.01 | 16 | 68.1 | 0.21 | 28 |
| LBY80 | 92272.2 | 4.42 | 0.20 | 13 | 67.3 | 0.27 | 26 |
| LBY80 | 92273.1 | 4.55 | L | 16 | 86.4 | 0.19 | 62 |
| LBY185 | 91497.1 | 4.70 | L | 20 | 73.8 | 0.26 | 38 |
| LBY185 | 91497.2 | 4.42 | 0.03 | 13 | 60.6 | 0.03 | 14 |
| LBY185 | 91498.2 | 5.03 | 0.04 | 28 | 69.2 | 0.23 | 30 |
| LBY185 | 91499.2 | 5.30 | L | 35 | — | — | — |
| LBY179 | 91545.2 | 4.60 | 0.01 | 17 | — | — | — |
| LBY179 | 91547.2 | 4.88 | 0.03 | 24 | — | — | — |
| LBY179 | 91549.1 | 4.95 | 0.11 | 26 | — | — | — |
| LBY173 | 91651.2 | 4.28 | 0.21 | 9 | — | — | — |
| LBY173 | 91652.1 | 5.58 | 0.07 | 42 | 75.0 | 0.02 | 41 |
| LBY173 | 91652.2 | 5.58 | L | 42 | 79.7 | L | 49 |
| LBY173 | 91652.3 | — | — | — | 69.7 | 0.08 | 31 |
| LBY173 | 91653.1 | 4.92 | 0.07 | 25 | 74.4 | 0.14 | 39 |
| LBY153 | 92249.2 | — | — | — | 59.0 | 0.11 | 11 |
| LBY153 | 92253.2 | 4.53 | 0.07 | 15 | — | — | — |
| LBY121 | 92290.3 | 4.30 | 0.09 | 10 | 60.2 | 0.27 | 13 |
| LBY121 | 92291.2 | — | — | — | 59.0 | 0.20 | 11 |
| LBY121 | 92291.4 | 4.25 | 0.09 | 8 | 60.7 | 0.18 | 14 |
| CONT. | — | 3.92 | — | — | 53.4 | — | — |
| LBY71 | 93773.2 | — | — | — | 69.4 | 0.24 | 12 |
| LBY68 | 93862.1 | — | — | — | 71.4 | 0.12 | 15 |
| LBY52 | 93946.2 | — | — | — | 77.7 | L | 26 |
| LBY44 | 92491.2 | — | — | — | 71.7 | 0.24 | 16 |
| LBY216 | 94080.3 | — | — | — | 71.2 | 0.03 | 15 |
| LBY20 | 94085.1 | 4.58 | 0.08 | 15 | 75.1 | 0.05 | 21 |
| LBY181 | 92479.3 | — | — | — | 74.3 | 0.10 | 20 |
| LBY142 | 93199.1 | — | — | — | 72.0 | 0.03 | 16 |
| LBY142 | 93203.4 | 4.45 | 0.06 | 12 | 76.5 | 0.11 | 23 |
| CONT. | — | 3.98 | — | — | 61.9 | — | — |
| LBY41 | 91621.1 | 4.00 | L | 13 | 66.4 | 0.18 | 10 |
| LBY41 | 91621.2 | 4.00 | L | 13 | — | — | — |
| LBY41 | 91623.2 | 4.03 | 0.03 | 13 | 65.1 | 0.30 | 8 |
| LBY173 | 91651.2 | 3.85 | 0.11 | 8 | — | — | — |
| LBY173 | 91652.1 | 4.60 | L | 30 | 75.3 | 0.10 | 24 |
| LBY173 | 91652.5 | 5.75 | L | 62 | 76.6 | 0.08 | 26 |
| LBY166 | 91542.5 | 4.05 | 0.03 | 14 | 70.6 | 0.09 | 17 |
| LBY166 | 91544.4 | — | — | — | 64.6 | 0.25 | 7 |
| LBY166 | 91544.5 | 4.05 | 0.18 | 14 | — | — | — |
| CONT. | — | 3.55 | — | — | 60.6 | — | — |
| LBY85 | 92064.1 | 3.95 | 0.28 | 7 | — | — | — |
| LBY85 | 92066.2 | 4.22 | 0.13 | 15 | — | — | — |
| LBY85 | 92066.3 | 4.72 | L | 29 | — | — | — |
| LBY85 | 92066.5 | 4.75 | L | 29 | — | — | — |
| LBY85 | 92068.3 | 4.33 | 0.16 | 18 | — | — | — |
| LBY64 | 91340.4 | 4.05 | 0.14 | 10 | — | — | — |
| LBY64 | 91342.3 | 4.40 | 0.02 | 20 | 101.0 | 0.29 | 21 |
| LBY46 | 92200.3 | 4.60 | 0.07 | 25 | — | — | — |
| LBY207 | 92155.1 | 4.58 | 0.01 | 24 | — | — | — |
| LBY207 | 92157.3 | 4.25 | 0.07 | 16 | — | — | — |
| LBY207 | 92158.2 | 4.65 | 0.05 | 27 | 109.4 | 0.30 | 31 |
| LBY185 | 91497.1 | 4.25 | 0.14 | 16 | — | — | — |
| LBY185 | 91497.2 | 4.42 | 0.01 | 20 | — | — | — |
| LBY185 | 91498.2 | 4.42 | 0.02 | 20 | — | — | — |
| LBY185 | 91499.2 | 4.85 | 0.17 | 32 | — | — | — |
| LBY17 | 92216.2 | 4.38 | 0.09 | 19 | — | — | — |
| LBY155 | 92015.1 | 4.38 | 0.05 | 19 | — | — | — |
| LBY155 | 92016.4 | 4.33 | 0.02 | 18 | — | — | — |
| LBY122 | 91370.2 | 4.75 | 0.01 | 29 | — | — | — |
| LBY122 | 91371.3 | 4.20 | 0.20 | 14 | — | — | — |
| LBY122 | 91371.6 | 4.75 | L | 29 | — | — | — |
| LBY122 | 91374.1 | 4.45 | 0.01 | 21 | — | — | — |
| CONT. | — | 3.67 | — | — | 83.3 | — | — |
| LBY50 | 91317.3 | — | — | — | 73.0 | 0.15 | 14 |
| LBY50 | 91318.1 | 4.83 | 0.18 | 11 | 75.2 | 0.26 | 17 |
| LBY50 | 91318.2 | 4.90 | 0.17 | 13 | 78.7 | 0.05 | 23 |

TABLE 266-continued

Genes showing improved plant performance at Low Nitrogen growth conditions under regulation of At6669 promoter

| Gene Name | Event # | Dry Weight [mg] Ave. | P-VaL | % Incr. | Fresh Weight [mg] Ave. | P-VaL | % Incr. |
|---|---|---|---|---|---|---|---|
| LBY50 | 91318.4 | — | — | — | 75.6 | 0.03 | 18 |
| LBY50 | 91319.2 | 5.05 | 0.02 | 16 | 80.6 | 0.13 | 26 |
| LBY24 | 91220.6 | 4.72 | 0.06 | 9 | 81.2 | 0.08 | 27 |
| LBY24 | 91221.1 | 4.77 | 0.26 | 10 | 79.2 | L | 23 |
| LBY24 | 91221.2 | 5.00 | 0.09 | 15 | 78.0 | 0.07 | 22 |
| LBY24 | 91223.2 | — | — | — | 86.6 | 0.17 | 35 |
| LBY21 | 90977.1 | — | — | — | 79.2 | 0.12 | 23 |
| LBY21 | 90980.1 | 4.80 | 0.19 | 11 | 73.1 | 0.15 | 14 |
| LBY161 | 91292.1 | — | — | — | 76.1 | 0.02 | 19 |
| LBY161 | 91292.5 | 4.92 | L | 14 | 76.2 | 0.02 | 19 |
| LBY161 | 91293.3 | 5.33 | L | 23 | 81.4 | 0.02 | 27 |
| LBY152 | 91286.1 | — | — | — | 74.3 | 0.04 | 16 |
| LBY152 | 91287.1 | 4.83 | 0.02 | 11 | 81.2 | L | 27 |
| LBY152 | 91288.2 | — | — | — | 72.3 | 0.11 | 13 |
| LBY152 | 91289.2 | 5.33 | 0.06 | 23 | 73.5 | 0.22 | 15 |
| LBY152 | 91289.4 | 4.55 | 0.28 | 5 | — | — | — |
| LBY15 | 91143.1 | — | — | — | 76.5 | 0.21 | 19 |
| LBY15 | 91144.1 | 4.80 | 0.03 | 11 | 70.2 | 0.27 | 10 |
| LBY15 | 91144.2 | 4.58 | 0.24 | 5 | 88.8 | L | 39 |
| LBY15 | 91144.3 | 4.92 | 0.08 | 14 | — | — | — |
| LBY123 | 91429.3 | 5.00 | 0.26 | 15 | — | — | — |
| LBY114 | 91391.2 | — | — | — | 77.0 | 0.02 | 20 |
| LBY114 | 91393.1 | 4.62 | 0.16 | 7 | — | — | — |
| CONT. | — | 4.34 | — | — | 64.1 | — | — |
| LBY80 | 92269.4 | 4.85 | 0.19 | 14 | — | — | — |
| LBY53 | 92418.1 | — | — | — | 106.3 | 0.15 | 35 |
| LBY153 | 92252.2 | 4.62 | 0.23 | 9 | 109.9 | 0.18 | 40 |
| LBY149 | 92246.3 | 5.00 | 0.08 | 18 | — | — | — |
| CONT. | — | 4.24 | — | — | 78.5 | — | — |
| LBY180 | 92576.2 | — | — | — | 149.2 | 0.30 | 54 |
| LBY156 | 92294.3 | 5.33 | 0.17 | 5 | — | — | — |
| CONT. | — | 5.07 | — | — | 96.7 | — | — |
| LBY20 | 94085.1 | 5.33 | 0.26 | 10 | — | — | — |
| LBY106_H3 | 93918.1 | 5.72 | 0.29 | 18 | — | — | — |
| CONT. | — | 4.86 | — | — | — | — | — |
| LBY53 | 92415.1 | 5.62 | L | 23 | — | — | — |
| LBY31 | 92344.1 | 5.33 | 0.13 | 16 | 101.1 | 0.14 | 26 |
| LBY208 | 92358.2 | 5.47 | 0.04 | 19 | — | — | — |
| LBY207 | 92155.1 | 5.40 | 0.11 | 18 | — | — | — |
| LBY207 | 92157.3 | 5.72 | L | 25 | — | — | — |
| LBY175 | 92179.1 | 5.20 | 0.23 | 13 | — | — | — |
| LBY175 | 92181.3 | 5.15 | 0.22 | 12 | 95.0 | 0.10 | 18 |
| LBY175 | 92181.4 | 5.03 | 0.25 | 10 | — | — | — |
| LBY140 | 92265.2 | 5.12 | 0.01 | 12 | — | — | — |
| LBY140 | 92266.3 | 5.35 | 0.05 | 17 | 89.6 | 0.26 | 11 |
| LBY116 | 92136.3 | 5.50 | 0.02 | 20 | — | — | — |
| LBY116 | 92138.6 | 5.17 | 0.10 | 13 | — | — | — |
| CONT. | — | 4.59 | — | — | 80.4 | — | — |
| LBY44 | 92491.2 | — | — | — | 62.9 | 0.11 | 15 |
| LBY181 | 92482.1 | 4.98 | 0.04 | 8 | — | — | — |
| LBY167 | 92770.4 | — | — | — | 68.0 | 0.20 | 24 |
| LBY167 | 92773.1 | 5.28 | L | 15 | 67.2 | 0.15 | 22 |
| LBY167 | 92773.4 | 4.85 | 0.15 | 5 | 66.4 | 0.09 | 21 |
| LBY157 | 92802.2 | 5.10 | 0.16 | 11 | 70.3 | 0.08 | 28 |
| LBY157 | 92802.3 | 5.30 | 0.23 | 15 | 68.7 | 0.13 | 25 |
| LBY157 | 92803.1 | 5.03 | 0.21 | 9 | 72.3 | L | 32 |
| LBY157 | 92803.2 | — | — | — | 63.8 | 0.29 | 16 |
| CONT. | — | 4.60 | — | — | 54.9 | — | — |
| LBY41 | 91621.2 | 5.15 | 0.17 | 9 | — | — | — |
| LBY41 | 91623.1 | 5.10 | 0.20 | 8 | — | — | — |
| LBY41 | 91623.2 | — | — | — | 94.7 | 0.28 | 14 |
| CONT. | — | 4.71 | — | — | 83.1 | — | — |
| LBY85 | 92066.3 | 4.30 | 0.12 | 7 | — | — | — |
| LBY64 | 91342.3 | 4.42 | 0.03 | 10 | 86.1 | 0.04 | 16 |
| LBY46 | 92200.3 | 4.38 | 0.22 | 9 | — | — | — |
| LBY46 | 92201.2 | 4.68 | L | 16 | — | — | — |
| LBY46 | 92201.4 | 4.65 | 0.19 | 16 | — | — | — |
| LBY122 | 91371.2 | 4.75 | L | 18 | — | — | — |
| LBY122 | 91371.6 | 4.42 | 0.30 | 10 | — | — | — |
| LBY122 | 91374.1 | — | — | — | 78.2 | 0.25 | 5 |
| CONT. | — | 4.03 | — | — | 74.3 | — | — |

Table 266. "CONT."-Control; "Ave."-Average; "% Incr." = % increment; "p-val."-p-value, L-p < 0.01.

The genes presented in Tables 267 and 268 below show a significant improvement in plant performance since they produced a larger leaf biomass (leaf area) and root biomass (root length and root coverage) (Table 267) and a higher relative growth rate of leaf area, root coverage and root length (Table 268) when grown under normal growth conditions, compared to control plants. Plants producing larger root biomass have better possibilities to absorb larger amount of nitrogen from soil. Plants producing larger leaf biomass have better ability to produce assimilates. The genes were cloned under the regulation of a constitutive promoter (At6669). The evaluation of each gene was performed by testing the performance of different number of events. Some of the genes were evaluated in more than one seedling analysis. This second experiment confirmed the significant increment in leaf and root performance. Event with p-value <0.1 was considered statistically significant.

TABLE 267

Genes showing improved plant performance at Normal growth conditions under regulation of At6669 promoter

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LBY200 | 92754.1 | 0.888 | L | 26 | 11.9 | 0.01 | 22 | — | — | — |
| LBY200 | 92754.3 | — | — | — | 11.4 | 0.15 | 17 | — | — | — |
| LBY200 | 92757.1 | 0.871 | 0.04 | 23 | 12.9 | 0.01 | 31 | — | — | — |
| LBY200 | 92757.2 | 0.819 | 0.03 | 16 | 12.2 | L | 25 | — | — | — |
| LBY141 | 92564.1 | 0.907 | 0.10 | 28 | — | — | — | — | — | — |
| LBY141 | 92565.2 | 0.808 | 0.01 | 14 | — | — | — | — | — | — |
| LBY141 | 92566.3 | 0.790 | 0.28 | 12 | — | — | — | — | — | — |
| CONT. | — | 0.706 | — | — | 9.78 | — | — | — | — | — |
| LGN35 | 89043.2 | 0.791 | 0.14 | 14 | — | — | — | — | — | — |
| LGN35 | 89043.3 | — | — | — | 9.81 | 0.21 | 18 | 7.62 | L | 11 |
| LGN35 | 89043.4 | 0.896 | 0.03 | 29 | 10.3 | 0.10 | 24 | — | — | — |
| CONT. | — | 0.693 | — | — | 8.29 | — | — | 6.85 | — | — |
| LBY78 | 92311.4 | — | — | — | 13.8 | 0.18 | 18 | 7.88 | 0.04 | 7 |
| LBY78 | 92312.2 | — | — | — | — | — | — | 7.77 | 0.25 | 5 |
| LBY78 | 92313.1 | — | — | — | — | — | — | 7.79 | 0.14 | 5 |
| LBY31 | 92344.1 | — | — | — | — | — | — | 7.58 | 0.29 | 3 |
| LBY175 | 92179.1 | 0.968 | 0.29 | 15 | — | — | — | 7.84 | 0.04 | 6 |
| LBY175 | 92179.3 | 0.949 | 0.19 | 12 | — | — | — | — | — | — |
| LBY175 | 92181.2 | 1.01 | L | 19 | 13.3 | 0.16 | 14 | 7.83 | 0.09 | 6 |
| LBY175 | 92181.3 | — | — | — | — | — | — | 7.65 | 0.27 | 4 |
| LBY175 | 92181.4 | — | — | — | — | — | — | 7.75 | 0.14 | 5 |
| LBY140 | 92265.1 | — | — | — | — | — | — | 7.76 | 0.28 | 5 |
| LBY140 | 92265.2 | 0.971 | 0.04 | 15 | — | — | — | 7.82 | 0.03 | 6 |
| LBY140 | 92266.1 | — | — | — | — | — | — | 7.77 | 0.13 | 5 |
| LBY116 | 92136.4 | 0.958 | 0.12 | 13 | — | — | — | — | — | — |
| LBY116 | 92138.6 | 1.10 | L | 30 | — | — | — | — | — | — |
| CONT. | — | 0.845 | — | — | 11.7 | — | — | 7.39 | — | — |
| LGN39 | 89931.3 | — | — | — | 8.07 | 0.27 | 18 | — | — | — |
| LGN39 | 89931.4 | 0.603 | 0.11 | 28 | — | — | — | — | — | — |
| LGN34 | 90400.2 | 0.763 | L | 62 | 9.34 | 0.06 | 37 | — | — | — |
| LGN34 | 90403.3 | 0.568 | 0.07 | 21 | 8.90 | 0.14 | 30 | — | — | — |
| CONT. | — | 0.470 | — | — | 6.83 | — | — | — | — | — |
| NUE3 | 88975.1 | — | — | — | 9.37 | 0.18 | 26 | — | — | — |
| NUE3 | 88975.2 | — | — | — | 9.73 | L | 31 | 7.65 | L | 14 |
| NUE3 | 88977.1 | 0.789 | 0.08 | 25 | 10.1 | 0.06 | 35 | 7.80 | L | 16 |
| NUE3 | 88977.2 | 0.700 | 0.19 | 11 | 9.43 | L | 27 | 7.60 | 0.02 | 13 |
| NUE3 | 88977.4 | — | — | — | — | — | — | 7.21 | 0.19 | 7 |
| LGN9 | 89186.1 | 0.702 | 0.18 | 11 | 9.11 | 0.16 | 22 | — | — | — |
| LGN9 | 89186.2 | — | — | — | 8.81 | 0.05 | 18 | 7.77 | L | 16 |
| LGN9 | 89187.2 | — | — | — | 9.44 | L | 27 | 7.16 | 0.05 | 7 |
| LGN7 | 89181.2 | — | — | — | — | — | — | 7.20 | 0.04 | 7 |
| LGN7 | 89183.3 | — | — | — | — | — | — | 7.39 | 0.04 | 10 |
| LGN7 | 89183.8 | 0.692 | 0.29 | 10 | 8.84 | 0.29 | 19 | 7.28 | 0.08 | 9 |
| LGN14 | 89167.3 | — | — | — | 10.3 | 0.06 | 38 | 7.46 | 0.04 | 11 |
| LGN14 | 89168.2 | 0.685 | 0.27 | 9 | 9.24 | 0.01 | 24 | 7.14 | 0.07 | 6 |
| LGN14 | 89168.5 | — | — | — | 8.73 | 0.22 | 17 | — | — | — |
| CONT. | — | 0.630 | — | — | 7.45 | — | — | 6.71 | — | — |
| LBY68 | 93862.2 | — | — | — | 12.0 | 0.04 | 18 | 8.20 | 0.16 | 6 |
| LBY52 | 93946.2 | 0.876 | 0.29 | 12 | — | — | — | — | — | — |
| LBY52 | 93946.3 | 0.901 | 0.27 | 15 | — | — | — | — | — | — |
| LBY34_H2 | 93856.1 | 0.940 | L | 20 | 13.3 | 0.05 | 31 | 8.30 | 0.10 | 8 |
| LBY27_H4 | 93931.4 | 0.937 | 0.11 | 19 | — | — | — | — | — | — |
| LBY183 | 92516.5 | 0.920 | 0.03 | 17 | 11.3 | 0.18 | 12 | — | — | — |
| LBY159 | 92153.1 | — | — | — | 12.6 | 0.26 | 24 | 8.15 | 0.26 | 6 |
| LBY157 | 92803.1 | 0.963 | 0.06 | 23 | — | — | — | — | — | — |
| LBY148 | 93764.3 | — | — | — | — | — | — | 8.14 | 0.26 | 5 |
| LBY148 | 93767.2 | — | — | — | 11.5 | 0.13 | 13 | 8.11 | 0.29 | 5 |
| LBY148 | 93768.1 | 0.884 | 0.14 | 13 | — | — | — | — | — | — |
| CONT. | — | 0.785 | — | — | 10.2 | — | — | 7.72 | — | — |

TABLE 267-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGN26 | 89037.2 | 0.849 | 0.29 | 12 | — | — | — | — | — | — |
| LGN26 | 89037.3 | 1.04 | L | 37 | — | — | — | — | — | — |
| LGN26 | 89037.4 | 1.13 | L | 49 | — | — | — | — | — | — |
| CONT. | — | 0.755 | — | — | — | — | — | — | — | — |
| LGN46 | 89101.1 | — | — | — | 13.2 | 0.11 | 13 | 7.92 | 0.16 | 2 |
| LGN46 | 89101.7 | 0.935 | 0.23 | 12 | — | — | — | 7.84 | 0.23 | 3 |
| CONT. | — | 0.833 | — | — | 11.7 | — | — | 7.73 | — | — |
| LGN57 | 89064.2 | 0.863 | 0.29 | 21 | 12.0 | 0.03 | 29 | 7.78 | 0.14 | 9 |
| LGN57 | 89065.1 | 0.907 | 0.05 | 27 | 10.6 | 0.23 | 13 | — | — | — |
| LGN57 | 89067.1 | 0.834 | 0.16 | 17 | — | — | — | — | — | — |
| CONT. | — | 0.714 | — | — | 9.36 | — | — | 7.15 | — | — |
| LGN36 | 89044.1 | 0.878 | 0.22 | 11 | — | — | — | — | — | — |
| CONT. | — | 0.791 | — | — | — | — | — | — | — | — |
| LBY80 | 92273.1 | — | — | — | — | — | — | 7.81 | 0.18 | 4 |
| LBY185 | 91497.2 | — | — | — | — | — | — | 7.74 | 0.22 | 3 |
| LBY185 | 91498.2 | 0.956 | 0.09 | 16 | — | — | — | — | — | — |
| LBY179 | 91545.2 | 0.929 | 0.07 | 12 | 12.7 | 0.09 | 14 | 7.97 | 0.02 | 6 |
| LBY179 | 91545.4 | — | — | — | — | — | — | 8.11 | L | 8 |
| LBY179 | 91549.3 | — | — | — | — | — | — | 8.02 | 0.03 | 7 |
| LBY173 | 91652.1 | 0.986 | 0.08 | 19 | — | — | — | 7.72 | 0.17 | 3 |
| LBY121 | 92290.4 | 0.914 | 0.07 | 10 | — | — | — | — | — | — |
| LBY121 | 92291.4 | 0.943 | 0.17 | 14 | — | — | — | — | — | — |
| CONT. | — | 0.827 | — | — | 11.2 | — | — | 7.52 | — | — |
| LGN54 | 88206.1 | — | — | — | — | — | — | 7.94 | 0.07 | 5 |
| LGN54 | 88206.4 | — | — | — | — | — | — | 7.83 | 0.22 | 4 |
| LGN54 | 88207.1 | — | — | — | — | — | — | 7.76 | 0.29 | 3 |
| LGN54 | 88208.2 | 0.963 | 0.02 | 17 | — | — | — | — | — | — |
| CONT. | — | 0.820 | — | — | — | — | — | 7.53 | — | — |
| LBY80 | 92269.3 | — | — | — | 9.36 | 0.01 | 20 | 7.82 | 0.03 | 9 |
| LBY80 | 92270.1 | 0.784 | 0.02 | 25 | 9.40 | 0.04 | 21 | 7.69 | 0.08 | 7 |
| LBY78 | 92311.3 | 0.704 | 0.12 | 12 | 9.96 | 0.08 | 28 | 7.81 | 0.07 | 9 |
| LBY78 | 92311.4 | 0.723 | L | 15 | 10.2 | 0.11 | 31 | 8.09 | 0.04 | 13 |
| LBY78 | 92312.2 | — | — | — | 9.28 | 0.06 | 19 | 7.99 | 0.07 | 12 |
| LBY78 | 92313.5 | — | — | — | 9.38 | L | 21 | 7.88 | 0.06 | 10 |
| LBY53 | 92414.1 | 0.689 | 0.09 | 10 | 9.14 | 0.04 | 18 | 7.69 | 0.08 | 7 |
| LBY53 | 92418.1 | 0.688 | 0.04 | 10 | — | — | — | 7.57 | 0.26 | 6 |
| LBY208 | 92356.1 | 0.680 | 0.07 | 8 | 8.62 | 0.11 | 11 | — | — | — |
| LBY208 | 92357.1 | 0.750 | 0.07 | 20 | 9.20 | 0.05 | 18 | — | — | — |
| LBY208 | 92358.2 | 0.705 | L | 12 | 8.45 | 0.25 | 9 | — | — | — |
| LBY153 | 92249.2 | 0.779 | L | 24 | 9.51 | 0.09 | 22 | — | — | — |
| LBY153 | 92252.2 | — | — | — | 8.82 | 0.12 | 14 | 7.55 | 0.23 | 5 |
| LBY153 | 92253.2 | 0.709 | 0.23 | 13 | 9.77 | 0.02 | 26 | 7.77 | 0.05 | 8 |
| LBY149 | 92246.3 | — | — | — | 11.3 | 0.14 | 45 | 7.76 | 0.08 | 8 |
| LBY149 | 92247.3 | 0.686 | 0.12 | 9 | 8.68 | 0.21 | 12 | 7.65 | 0.08 | 7 |
| LBY121 | 92290.3 | 0.738 | 0.09 | 18 | 9.44 | L | 22 | 7.93 | 0.02 | 11 |
| LBY121 | 92291.4 | 0.709 | 0.02 | 13 | — | — | — | — | — | — |
| LBY121 | 92293.2 | 0.710 | 0.05 | 13 | — | — | — | — | — | — |
| CONT. | — | 0.627 | — | — | 7.77 | — | — | 7.16 | — | — |
| LGN4 | 89075.2 | 0.780 | 0.25 | 14 | — | — | — | — | — | — |
| CONT. | — | 0.682 | — | — | — | — | — | — | — | — |
| LGN52 | 90578.6 | — | — | — | 9.04 | 0.26 | 17 | — | — | — |
| LGN52 | 90581.1 | — | — | — | 8.96 | 0.29 | 16 | 7.88 | 0.15 | 5 |
| LGN52 | 90581.4 | — | — | — | 11.0 | 0.13 | 43 | — | — | — |
| CONT. | — | — | — | — | 7.72 | — | — | 7.53 | — | — |
| LGN41 | 92101.1 | 0.768 | 0.18 | 18 | — | — | — | — | — | — |
| LGN41 | 92102.1 | 0.731 | 0.17 | 13 | — | — | — | — | — | — |
| LGN41 | 92102.3 | 0.813 | 0.05 | 25 | — | — | — | — | — | — |
| CONT. | — | 0.649 | — | — | — | — | — | — | — | — |
| LGN46 | 89101.4 | — | — | — | 13.2 | 0.04 | 38 | 8.67 | 0.07 | 10 |
| LGN46 | 89101.9 | 0.698 | 0.16 | 17 | — | — | — | — | — | — |
| CONT. | — | 0.594 | — | — | 9.53 | — | — | 7.91 | — | — |
| LGN45 | 91575.2 | 0.926 | 0.02 | 17 | — | — | — | — | — | — |
| LGN45 | 91575.3 | 0.912 | L | 15 | — | — | — | 7.68 | 0.19 | 4 |
| LGN45 | 91579.3 | 0.887 | 0.30 | 12 | — | — | — | — | — | — |
| LGN45 | 91579.4 | 0.860 | 0.22 | 9 | — | — | — | — | — | — |
| CONT. | — | 0.791 | — | — | — | — | — | 7.39 | — | — |
| LBY95 | 94683.4 | 0.894 | 0.27 | 14 | — | — | — | 8.26 | 0.09 | 6 |
| LBY92 | 93921.2 | 1.09 | 0.01 | 39 | 20.5 | L | 86 | — | — | — |
| LBY92 | 93923.3 | 0.931 | 0.30 | 19 | 19.6 | 0.06 | 78 | 8.16 | 0.19 | 5 |
| LBY6 | 94111.3 | — | — | — | — | — | — | 8.09 | 0.21 | 4 |
| LBY201 | 93925.1 | — | — | — | 12.4 | 0.06 | 13 | — | — | — |

TABLE 267-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY148 | 93765.1 | — | — | — | — | — | — | 8.08 | 0.27 | 4 |
| LBY148 | 93767.2 | — | — | — | 12.4 | 0.28 | 12 | 8.16 | 0.18 | 5 |
| LBY106_H3 | 93918.1 | 0.927 | 0.20 | 18 | — | — | — | — | — | — |
| CONT. | — | 0.786 | — | — | 11.0 | — | — | 7.80 | — | — |
| LBY50 | 91317.3 | 0.872 | L | 49 | 11.1 | L | 39 | 7.74 | 0.03 | 5 |
| LBY50 | 91318.2 | 0.766 | 0.17 | 31 | — | — | — | — | — | — |
| LBY50 | 91319.2 | — | — | — | 9.31 | 0.05 | 16 | — | — | — |
| LBY24 | 91220.6 | — | — | — | 10.2 | 0.04 | 27 | 7.79 | 0.01 | 6 |
| LBY24 | 91221.2 | 0.758 | 0.11 | 30 | — | — | — | — | — | — |
| LBY24 | 91223.1 | 0.680 | 0.25 | 16 | — | — | — | — | — | — |
| LBY24 | 91223.3 | — | — | — | — | — | — | 7.62 | 0.04 | 4 |
| LBY21 | 90977.1 | — | — | — | 9.48 | 0.10 | 18 | 7.76 | 0.04 | 6 |
| LBY21 | 90978.4 | 0.661 | 0.14 | 13 | 8.73 | 0.26 | 9 | 7.54 | 0.24 | 3 |
| LBY21 | 90979.2 | 0.645 | 0.11 | 10 | — | — | — | — | — | — |
| LBY161 | 91292.1 | 0.653 | 0.21 | 12 | — | — | — | — | — | — |
| LBY161 | 91292.5 | 0.722 | 0.03 | 24 | 9.51 | 0.09 | 19 | — | — | — |
| LBY161 | 91293.3 | 0.789 | L | 35 | 8.87 | 0.21 | 11 | — | — | — |
| LBY161 | 91294.1 | 0.789 | 0.02 | 35 | 10.6 | 0.08 | 32 | 7.65 | 0.03 | 4 |
| LBY161 | 91294.2 | 0.719 | L | 23 | 9.21 | 0.30 | 15 | — | — | — |
| LBY15 | 91142.2 | 0.729 | L | 25 | 9.57 | 0.10 | 19 | 7.64 | 0.03 | 4 |
| LBY15 | 91143.1 | — | — | — | — | — | — | 7.83 | 0.08 | 7 |
| LBY15 | 91144.2 | 0.668 | 0.22 | 14 | 9.73 | 0.18 | 21 | 7.59 | 0.21 | 3 |
| LBY15 | 91144.3 | 0.653 | 0.06 | 12 | 9.28 | 0.12 | 16 | — | — | — |
| CONT. | — | 0.584 | — | — | 8.03 | — | — | 7.35 | — | — |
| LGN23 | 92316.2 | 0.781 | 0.10 | 10 | — | — | — | — | — | — |
| LGN23 | 92317.2 | 0.861 | 0.02 | 21 | — | — | — | — | — | — |
| CONT. | — | 0.711 | — | — | — | — | — | — | — | — |
| LGN48 | 89060.1 | 0.919 | 0.06 | 24 | — | — | — | — | — | — |
| LGN48 | 89061.2 | — | — | — | — | — | — | 7.38 | 0.25 | 4 |
| CONT. | — | 0.743 | — | — | — | — | — | 7.20 | — | — |
| LGN18 | 92466.3 | 0.967 | 0.06 | 21 | — | — | — | — | — | — |
| CONT. | — | 0.797 | — | — | — | — | — | — | — | — |
| LBY41 | 91620.4 | 1.06 | L | 36 | 14.1 | L | 31 | 8.13 | 0.29 | 2 |
| LBY41 | 91621.1 | 0.947 | 0.05 | 21 | — | — | — | — | — | — |
| LBY41 | 91623.2 | 0.982 | 0.07 | 25 | — | — | — | 8.09 | 0.28 | 2 |
| LBY186 | 91657.1 | 1.01 | 0.11 | 29 | 13.2 | 0.06 | 23 | — | — | — |
| LBY186 | 91659.1 | 1.19 | L | 52 | 14.9 | L | 38 | 8.22 | 0.09 | 3 |
| LBY186 | 91659.3 | 0.996 | L | 27 | 14.4 | L | 34 | 8.22 | 0.08 | 3 |
| LBY186 | 91659.4 | 0.967 | 0.11 | 24 | — | — | — | — | — | — |
| LBY166 | 91542.5 | 0.890 | 0.09 | 14 | — | — | — | — | — | — |
| LBY166 | 91544.3 | 1.17 | 0.03 | 49 | 14.1 | 0.12 | 32 | — | — | — |
| LBY166 | 91544.5 | 0.896 | 0.07 | 14 | — | — | — | — | — | — |
| CONT. | — | 0.782 | — | — | 10.8 | — | — | 7.96 | — | — |
| LGN35 | 89043.1 | 1.06 | 0.07 | 21 | 12.3 | L | 29 | 7.77 | 0.25 | 6 |
| LGN35 | 89043.4 | 1.02 | 0.16 | 17 | 10.9 | 0.22 | 14 | — | — | — |
| CONT. | — | 0.873 | — | — | 9.53 | — | — | 7.35 | — | — |
| LGN33 | 91572.1 | 0.691 | 0.04 | 16 | 8.93 | 0.17 | 21 | — | — | — |
| LGN33 | 91572.3 | 0.709 | 0.04 | 19 | — | — | — | — | — | — |
| LGN33 | 91574.2 | 0.697 | 0.12 | 17 | — | — | — | — | — | — |
| LGN33 | 91574.4 | 0.671 | 0.12 | 13 | — | — | — | — | — | — |
| CONT. | — | 0.596 | — | — | 7.39 | — | — | — | — | — |
| LGN18 | 92466.3 | 0.797 | 0.21 | 15 | — | — | — | — | — | — |
| LGN18 | 92468.3 | 0.883 | 0.01 | 27 | 12.3 | 0.12 | 13 | — | — | — |
| LGN18 | 92468.5 | 0.840 | 0.13 | 21 | — | — | — | — | — | — |
| CONT. | — | 0.695 | — | — | 10.9 | — | — | — | — | — |
| LBY186 | 91657.1 | 0.851 | 0.14 | 17 | — | — | — | — | — | — |
| LBY186 | 91659.1 | 0.932 | 0.01 | 28 | 11.8 | 0.04 | 34 | — | — | — |

TABLE 267-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY186 | 91659.4 | 0.827 | 0.07 | 14 | — | — | — | — | — | — |
| LBY179 | 91549.1 | 0.910 | L | 25 | 10.6 | 0.03 | 20 | — | — | — |
| LBY152 | 91286.1 | 0.866 | 0.16 | 19 | — | — | — | — | — | — |
| LBY152 | 91288.2 | — | — | — | — | — | — | 7.85 | 0.06 | 5 |
| LBY152 | 91289.2 | 0.861 | 0.07 | 18 | 10.9 | 0.13 | 24 | — | — | — |
| LBY123 | 91427.1 | — | — | — | 10.8 | 0.03 | 23 | 7.85 | 0.24 | 5 |
| LBY123 | 91429.3 | — | — | — | 11.2 | 0.09 | 26 | — | — | — |
| CONT. | — | 0.727 | — | — | 8.83 | — | — | 7.45 | — | — |
| LBY180 | 92578.5 | 0.944 | 0.06 | 12 | — | — | — | — | — | — |
| LBY144 | 93061.5 | — | — | — | — | — | — | 8.44 | 0.16 | 5 |
| LBY144 | 93061.6 | 0.942 | 0.04 | 12 | — | — | — | — | — | — |
| LBY111 | 92794.4 | — | — | — | — | — | — | 8.14 | 0.27 | 2 |
| LBY111 | 92797.1 | 0.918 | 0.29 | 9 | — | — | — | — | — | — |
| CONT. | — | 0.842 | — | — | — | — | — | 8.01 | — | — |
| LGN47 | 91171.4 | — | — | — | 12.3 | 0.24 | 12 | 7.91 | 0.26 | 2 |
| LGN47 | 91174.3 | — | — | — | 12.1 | 0.04 | 11 | — | — | — |
| LGN47 | 91174.4 | 0.948 | 0.25 | 8 | 12.9 | 0.20 | 18 | 7.81 | 0.03 | 3 |
| CONT. | — | 0.916 | — | — | 12.2 | — | — | 7.75 | — | — |
| LGN42 | 92204.1 | 0.810 | 0.28 | 11 | 11.7 | 0.13 | 24 | 7.93 | 0.02 | 10 |
| LGN42 | 92204.3 | — | — | — | 11.4 | 0.20 | 21 | 7.82 | 0.07 | 9 |
| LGN42 | 92204.5 | — | — | — | — | — | — | 7.87 | 0.02 | 9 |
| LGN42 | 92207.1 | — | — | — | — | — | — | 7.94 | 0.19 | 10 |
| CONT. | — | 0.732 | — | — | 9.44 | — | — | 7.20 | — | — |
| LBY191 | 92519.2 | 0.832 | 0.14 | 21 | — | — | — | — | — | — |
| LBY191 | 92523.3 | — | — | — | 10.9 | 0.28 | 8 | — | — | — |
| LBY144 | 93059.3 | 0.773 | 0.05 | 13 | — | — | — | — | — | — |
| LBY144 | 93061.6 | 0.846 | L | 23 | — | — | — | — | — | — |
| LBY111 | 92797.1 | — | — | — | — | — | — | 7.73 | 0.22 | 4 |
| LBY111 | 92797.3 | — | — | — | — | — | — | 7.83 | 0.12 | 6 |
| LBY111 | 92798.1 | — | — | — | 11.4 | 0.04 | 13 | 7.97 | 0.06 | 8 |
| CONT. | — | 0.686 | — | — | 10.1 | — | — | 7.41 | — | — |
| LGN41 | 92102.3 | 0.676 | 0.28 | 21 | — | — | — | — | — | — |
| CONT. | — | 0.559 | — | — | — | — | — | — | — | — |
| NUE3 | 88975.2 | 0.423 | 0.15 | 13 | — | — | — | — | — | — |
| NUE3 | 88977.1 | — | — | — | 6.65 | 0.10 | 31 | — | — | — |
| NUE3 | 88977.2 | 0.450 | 0.11 | 21 | 6.91 | 0.04 | 36 | 6.31 | 0.24 | 8 |
| NUE3 | 88977.5 | 0.477 | 0.09 | 28 | 5.86 | 0.12 | 16 | — | — | — |
| LGN9 | 89186.2 | 0.411 | 0.08 | 10 | — | — | — | 6.47 | 0.07 | 11 |
| LGN7 | 89181.1 | 0.456 | 0.14 | 22 | — | — | — | 6.59 | 0.07 | 13 |
| LGN7 | 89183.2 | 0.440 | 0.04 | 18 | — | — | — | — | — | — |
| LGN14 | 89165.3 | 0.408 | 0.25 | 9 | 5.87 | 0.27 | 16 | — | — | — |
| LGN14 | 89167.3 | 0.430 | 0.12 | 15 | — | — | — | — | — | — |
| LGN14 | 89168.1 | 0.434 | 0.16 | 16 | — | — | — | — | — | — |
| LGN14 | 89168.2 | 0.420 | 0.08 | 13 | — | — | — | — | — | — |
| LGN14 | 89168.5 | 0.398 | 0.30 | 7 | — | — | — | — | — | — |
| CONT. | — | 0.373 | — | — | 5.07 | — | — | 5.82 | — | — |
| LGN1 | 92185.1 | — | — | — | — | — | — | 8.22 | 0.01 | 4 |
| LGN1 | 92185.2 | — | — | — | 13.3 | 0.21 | 15 | 8.35 | 0.02 | 6 |
| LGN1 | 92187.1 | — | — | — | — | — | — | 8.33 | 0.03 | 5 |
| LGN1 | 92188.1 | 1.08 | 0.26 | 12 | 14.5 | 0.15 | 25 | 8.20 | 0.28 | 4 |
| CONT. | — | 0.963 | — | — | 11.6 | — | — | 7.91 | — | — |
| LGN4 | 89075.2 | 0.594 | 0.02 | 24 | 9.30 | 0.17 | 20 | 7.28 | 0.20 | 8 |
| CONT. | — | 0.478 | — | — | 7.77 | — | — | 6.74 | — | — |
| LGN49 | 89081.3 | 1.000 | L | 36 | 12.8 | 0.18 | 18 | — | — | — |
| LGN49 | 89081.4 | 0.879 | 0.02 | 20 | — | — | — | — | — | — |
| CONT. | — | 0.735 | — | — | 10.8 | — | — | — | — | — |
| LGN39 | 89930.2 | — | — | — | 11.0 | 0.04 | 28 | 7.70 | 0.04 | 13 |
| LGN34 | 90403.4 | — | — | — | 11.2 | 0.23 | 29 | — | — | — |
| CONT. | — | — | — | — | 8.63 | — | — | 6.84 | — | — |
| LGN52 | 90581.1 | — | — | — | — | — | — | 7.66 | 0.20 | 5 |
| CONT. | — | — | — | — | — | — | — | 7.27 | — | — |
| LBY71 | 93769.2 | 0.714 | 0.16 | 17 | — | — | — | — | — | — |
| LBY71 | 93769.3 | 0.697 | 0.22 | 14 | — | — | — | — | — | — |
| LBY71 | 93773.2 | 0.766 | 0.04 | 25 | 10.5 | 0.02 | 35 | 7.52 | 0.01 | 6 |
| LBY68 | 93860.3 | 0.710 | 0.05 | 16 | 9.31 | 0.12 | 19 | 7.45 | 0.27 | 5 |
| LBY68 | 93862.1 | 0.716 | 0.10 | 17 | 9.81 | 0.04 | 26 | 7.53 | 0.24 | 7 |
| LBY68 | 93862.2 | 0.680 | 0.15 | 11 | 10.6 | L | 35 | 7.36 | 0.26 | 4 |
| LBY68 | 93862.4 | — | — | — | 9.68 | 0.07 | 24 | 7.97 | L | 13 |
| LBY68 | 93862.5 | — | — | — | 9.38 | 0.09 | 20 | — | — | — |
| LBY61 | 94019.1 | 0.719 | 0.09 | 18 | — | — | — | — | — | — |
| LBY61 | 94019.4 | 0.780 | 0.11 | 27 | 9.76 | 0.10 | 25 | — | — | — |

TABLE 267-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY61 | 94023.2 | 0.698 | 0.15 | 14 | — | — | — | — | — | — |
| LBY6 | 94108.3 | — | — | — | 8.80 | 0.24 | 13 | — | — | — |
| LBY52 | 93944.1 | — | — | — | 9.38 | 0.06 | 20 | 7.28 | 0.30 | 3 |
| LBY52 | 93944.2 | — | — | — | 9.81 | 0.04 | 26 | 7.67 | 0.18 | 9 |
| LBY52 | 93946.2 | 0.759 | 0.01 | 24 | — | — | — | — | — | — |
| LBY5 | 93939.4 | — | — | — | — | — | — | 7.28 | 0.25 | 3 |
| LBY5 | 93940.2 | — | — | — | 9.42 | 0.07 | 21 | 7.53 | 0.08 | 7 |
| LBY5 | 93941.3 | 0.736 | 0.20 | 20 | 10.1 | 0.05 | 30 | 7.54 | 0.13 | 7 |
| LBY5 | 93941.4 | — | — | — | — | — | — | 7.52 | 0.06 | 6 |
| LBY44 | 92491.2 | — | — | — | 8.70 | 0.29 | 11 | — | — | — |
| LBY44 | 92492.1 | 0.671 | 0.21 | 10 | — | — | — | — | — | — |
| LBY34_H2 | 93855.2 | 0.708 | 0.18 | 16 | — | — | — | — | — | — |
| LBY34_H2 | 93856.1 | — | — | — | 9.22 | 0.17 | 18 | 7.40 | 0.18 | 5 |
| LBY34_H2 | 93857.1 | 0.728 | 0.06 | 19 | 10.4 | 0.02 | 33 | 7.54 | 0.15 | 7 |
| LBY34_H2 | 93857.2 | 0.754 | 0.05 | 23 | 10.6 | L | 35 | 7.52 | 0.02 | 6 |
| LBY34_H2 | 93857.4 | — | — | — | — | — | — | 7.73 | 0.01 | 9 |
| LBY216 | 94082.2 | — | — | — | 10.2 | L | 30 | 7.48 | 0.26 | 6 |
| LBY20 | 94084.1 | — | — | — | — | — | — | 7.30 | 0.20 | 3 |
| LBY20 | 94087.3 | — | — | — | — | — | — | 7.44 | 0.22 | 5 |
| LBY181 | 92479.3 | 0.697 | 0.18 | 14 | — | — | — | — | — | — |
| LBY181 | 92480.5 | 0.706 | 0.09 | 15 | — | — | — | — | — | — |
| LBY181 | 92482.1 | 0.754 | 0.05 | 23 | 8.70 | 0.26 | 11 | — | — | — |
| LBY142 | 93199.1 | 0.690 | 0.11 | 13 | 9.24 | 0.12 | 18 | — | — | — |
| LBY142 | 93202.1 | — | — | — | 8.71 | 0.26 | 12 | 7.36 | 0.29 | 4 |
| LBY142 | 93203.3 | 0.854 | 0.01 | 40 | 10.6 | 0.11 | 36 | — | — | — |
| LBY142 | 93203.4 | 0.780 | 0.01 | 28 | 11.1 | L | 42 | 7.35 | 0.17 | 4 |
| CONT. | — | 0.612 | — | — | 7.81 | — | — | 7.06 | — | — |
| LBY41 | 91621.1 | 0.739 | 0.22 | 17 | — | — | — | 7.76 | 0.09 | 5 |
| LBY41 | 91621.2 | 0.722 | 0.17 | 14 | — | — | — | — | — | — |
| LBY41 | 91623.1 | 0.737 | 0.22 | 16 | 10.3 | 0.13 | 16 | 7.90 | L | 7 |
| LBY41 | 91623.2 | 0.747 | 0.10 | 18 | 9.61 | 0.27 | 8 | — | — | — |
| LBY173 | 91651.2 | 0.713 | 0.23 | 12 | — | — | — | — | — | — |
| LBY173 | 91652.1 | 0.985 | L | 55 | 11.3 | 0.02 | 27 | — | — | — |
| LBY173 | 91652.2 | 0.737 | 0.09 | 16 | — | — | — | — | — | — |
| LBY173 | 91652.5 | 1.04 | 0.02 | 64 | 13.8 | L | 55 | 7.83 | 0.13 | 6 |
| LBY173 | 91653.1 | 0.699 | 0.26 | 10 | — | — | — | — | — | — |
| LBY166 | 91542.5 | 0.979 | 0.02 | 54 | — | — | — | — | — | — |
| LBY166 | 91544.5 | 0.865 | 0.06 | 36 | 9.83 | 0.26 | 10 | — | — | — |
| CONT. | — | 0.634 | — | — | 8.91 | — | — | 7.36 | — | — |
| LBY85 | 92066.2 | — | — | — | — | — | — | 7.91 | 0.17 | 5 |
| LBY64 | 91340.4 | — | — | — | — | — | — | 7.80 | 0.23 | 3 |
| LBY64 | 91342.2 | — | — | — | — | — | — | 7.78 | 0.23 | 3 |
| LBY46 | 92201.4 | — | — | — | 13.4 | L | 22 | — | — | — |
| LBY207 | 92157.3 | — | — | — | — | — | — | 7.91 | 0.08 | 5 |
| LBY207 | 92158.2 | 1.04 | 0.16 | 22 | 14.2 | 0.11 | 29 | 8.01 | 0.09 | 6 |
| LBY185 | 91497.2 | 1.03 | 0.03 | 21 | — | — | — | — | — | — |
| LBY185 | 91499.2 | 1.01 | 0.03 | 18 | 14.0 | 0.12 | 27 | — | — | — |
| LBY17 | 92216.2 | 1.10 | 0.04 | 29 | 14.3 | 0.03 | 30 | — | — | — |
| LBY17 | 92216.4 | — | — | — | — | — | — | 7.86 | 0.11 | 4 |
| LBY155 | 92015.1 | 0.990 | 0.07 | 16 | 12.7 | 0.17 | 15 | — | — | — |
| LBY122 | 91370.2 | 1.02 | 0.13 | 20 | — | — | — | — | — | — |
| LBY122 | 91371.6 | 1.02 | 0.02 | 20 | 12.4 | 0.23 | 13 | — | — | — |
| CONT. | — | 0.851 | — | — | 11.0 | — | — | 7.57 | — | — |
| LBY50 | 91319.2 | — | — | — | 14.3 | 0.08 | 19 | — | — | — |
| LBY24 | 91220.6 | 1.03 | 0.07 | 18 | 13.8 | 0.07 | 15 | 8.04 | 0.28 | 4 |
| LBY24 | 91221.2 | 1.11 | 0.15 | 26 | — | — | — | — | — | — |
| LBY21 | 90978.4 | — | — | — | 13.3 | 0.19 | 12 | — | — | — |
| LBY21 | 90979.1 | — | — | — | 13.5 | 0.21 | 13 | — | — | — |
| LBY21 | 90980.1 | 1.02 | 0.16 | 16 | 13.7 | 0.14 | 14 | — | — | — |
| LBY161 | 91293.3 | — | — | — | 13.1 | 0.23 | 10 | — | — | — |
| LBY161 | 91294.1 | 0.975 | 0.15 | 11 | 14.9 | 0.26 | 25 | 8.16 | 0.18 | 5 |
| LBY152 | 91289.4 | — | — | — | 13.0 | 0.26 | 9 | 8.06 | 0.25 | 4 |
| LBY15 | 91144.1 | — | — | — | 13.5 | 0.16 | 13 | — | — | — |
| LBY123 | 91428.2 | 0.944 | 0.17 | 7 | — | — | — | — | — | — |
| LBY123 | 91429.2 | 1.06 | 0.08 | 20 | — | — | — | — | — | — |
| LBY123 | 91429.3 | 1.000 | 0.13 | 14 | 13.9 | 0.11 | 16 | 8.03 | 0.28 | 3 |
| LBY114 | 91393.1 | — | — | — | 13.8 | 0.14 | 15 | — | — | — |
| LBY114 | 91393.2 | 1.15 | 0.02 | 31 | 13.4 | 0.22 | 12 | — | — | — |
| CONT. | — | 0.880 | — | — | 12.0 | — | — | 7.76 | — | — |
| LGN24 | 89096.3 | 0.799 | 0.12 | 20 | 10.8 | 0.17 | 17 | — | — | — |
| CONT. | — | 0.668 | — | — | 9.18 | — | — | — | — | — |

TABLE 267-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGN23 | 92316.2 | 0.966 | 0.02 | 26 | 11.8 | 0.09 | 14 | — | — | — |
| LGN23 | 92317.2 | 0.857 | 0.07 | 12 | — | — | — | — | — | — |
| CONT. | — | 0.767 | — | — | 10.3 | — | — | — | — | — |
| LBY93 | 92656.1 | 0.838 | 0.28 | 14 | — | — | — | — | — | — |
| LBY93 | 92657.1 | 0.901 | 0.23 | 22 | 11.7 | 0.23 | 22 | 7.81 | 0.20 | 7 |
| LBY76 | 92642.1 | 0.927 | 0.01 | 26 | 11.9 | 0.06 | 23 | 7.56 | 0.29 | 4 |
| LBY76 | 92642.2 | 0.828 | 0.18 | 12 | — | — | — | — | — | — |
| LBY76 | 92642.3 | 0.870 | 0.03 | 18 | — | — | — | — | — | — |
| LBY76 | 92642.4 | 0.829 | 0.24 | 12 | — | — | — | — | — | — |
| LBY70 | 92684.2 | 1.03 | L | 39 | 11.7 | 0.09 | 21 | — | — | — |
| LBY70 | 92685.5 | 0.875 | 0.10 | 19 | — | — | — | 7.51 | 0.28 | 3 |
| LBY70 | 92685.6 | 0.831 | 0.28 | 13 | — | — | — | — | — | — |
| LBY70 | 92686.2 | 0.949 | 0.01 | 29 | 12.9 | 0.02 | 34 | 7.71 | 0.06 | 6 |
| LBY70 | 92686.3 | 0.833 | 0.16 | 13 | — | — | — | — | — | — |
| LBY227 | 92851.1 | 0.868 | 0.13 | 18 | 11.0 | 0.29 | 14 | — | — | — |
| LBY227 | 92852.2 | — | — | — | 10.7 | 0.16 | 11 | — | — | — |
| LBY227 | 92852.3 | 0.846 | 0.18 | 15 | — | — | — | 7.65 | 0.10 | 5 |
| LBY227 | 92853.1 | 0.999 | L | 36 | 13.5 | L | 40 | 7.84 | 0.03 | 8 |
| LBY209 | 92499.7 | — | — | — | 11.1 | 0.09 | 15 | — | — | — |
| LBY209 | 92500.1 | — | — | — | — | — | — | 7.67 | 0.09 | 5 |
| LBY183 | 92516.2 | 0.885 | 0.08 | 20 | 11.0 | 0.14 | 15 | 7.59 | 0.26 | 4 |
| LBY180 | 92578.5 | 0.941 | 0.06 | 28 | — | — | — | — | — | — |
| LBY159 | 92150.4 | 0.839 | 0.08 | 14 | — | — | — | — | — | — |
| LBY159 | 92152.1 | 0.823 | 0.21 | 12 | 11.0 | 0.08 | 14 | 7.62 | 0.10 | 5 |
| LBY159 | 92152.2 | 0.972 | L | 32 | — | — | — | — | — | — |
| LBY159 | 92152.3 | 0.861 | 0.06 | 17 | 12.0 | 0.14 | 24 | 7.66 | 0.06 | 5 |
| LBY159 | 92153.1 | 0.893 | 0.05 | 21 | 12.1 | 0.03 | 26 | 7.90 | 0.06 | 9 |
| LBY156 | 92294.1 | 0.987 | L | 34 | 11.7 | 0.20 | 21 | — | — | — |
| LBY156 | 92294.2 | 0.847 | 0.05 | 15 | — | — | — | — | — | — |
| LBY156 | 92294.3 | 0.915 | 0.05 | 24 | 13.0 | 0.02 | 35 | 8.07 | L | 11 |
| LBY156 | 92298.1 | 0.886 | 0.06 | 20 | — | — | — | 7.57 | 0.25 | 4 |
| LBY156 | 92298.2 | 0.909 | 0.16 | 23 | — | — | — | — | — | — |
| LBY145 | 92604.1 | 0.837 | 0.09 | 13 | — | — | — | — | — | — |
| LBY145 | 92606.2 | — | — | — | 10.4 | 0.29 | 8 | — | — | — |
| LBY145 | 92608.4 | — | — | — | 11.8 | 0.06 | 22 | 7.84 | 0.06 | 8 |
| CONT. | — | 0.737 | — | — | 9.65 | — | — | 7.27 | — | — |
| LGN48 | 89060.1 | — | — | — | — | — | — | 7.71 | 0.26 | 4 |
| LGN48 | 89063.2 | — | — | — | — | — | — | 7.83 | 0.14 | 6 |
| CONT. | — | — | — | — | — | — | — | 7.41 | — | — |
| LGN5 | 88198.1 | 0.819 | 0.29 | 5 | — | — | — | — | — | — |
| CONT. | — | 0.812 | — | — | — | — | — | — | — | — |
| LGN47 | 91174.3 | 0.858 | 0.08 | 18 | 9.30 | 0.19 | 14 | 7.64 | 0.22 | 3 |
| LGN47 | 91174.6 | 0.899 | L | 24 | 9.52 | 0.05 | 17 | — | — | — |
| CONT. | — | 0.725 | — | — | 8.13 | — | — | 7.41 | — | — |
| LGN1 | 92184.1 | — | — | — | — | — | — | 7.96 | 0.23 | 4 |
| LGN1 | 92185.1 | 0.789 | 0.20 | 22 | 9.86 | 0.18 | 21 | 7.65 | 0.16 | 7 |
| LGN1 | 92185.2 | 0.786 | 0.26 | 22 | — | — | — | — | — | — |
| LGN1 | 92187.1 | — | — | — | 9.86 | 0.05 | 21 | 8.02 | 0.19 | 4 |
| LGN1 | 92188.1 | 0.885 | 0.04 | 37 | 9.91 | 0.12 | 22 | 7.43 | 0.27 | 4 |
| CONT. | — | 0.646 | — | — | 8.15 | — | — | 7.68 | — | — |
| LGN45 | 91575.3 | 1.02 | L | 51 | 11.7 | 0.20 | 24 | — | — | — |
| LGN45 | 91579.3 | 0.748 | 0.19 | 10 | — | — | — | — | — | — |
| LGN45 | 91579.5 | 0.821 | 0.06 | 21 | 11.6 | L | 23 | 7.73 | 0.20 | 5 |
| CONT. | — | 0.678 | — | — | 9.47 | — | — | 7.35 | — | — |
| LBY44 | 92491.2 | 0.769 | 0.06 | 16 | — | — | — | 7.42 | 0.11 | 7 |
| LBY44 | 92492.1 | 0.730 | 0.22 | 10 | 10.7 | 0.20 | 15 | — | — | — |
| LBY43 | 92680.1 | 0.748 | 0.14 | 12 | — | — | — | 7.77 | L | 12 |
| LBY181 | 92479.3 | 0.843 | 0.05 | 27 | 10.6 | 0.27 | 14 | — | — | — |
| LBY181 | 92480.5 | 0.881 | L | 33 | 11.2 | 0.07 | 21 | — | — | — |
| LBY181 | 92482.1 | 0.816 | L | 23 | — | — | — | — | — | — |
| LBY167 | 92770.4 | 0.760 | 0.05 | 14 | 12.7 | 0.02 | 37 | 7.45 | 0.21 | 7 |
| LBY167 | 92772.2 | 0.739 | 0.30 | 11 | — | — | — | — | — | — |
| LBY167 | 92773.1 | 0.723 | 0.30 | 9 | — | — | — | — | — | — |
| LBY157 | 92799.3 | 0.791 | 0.21 | 19 | — | — | — | — | — | — |
| LBY157 | 92802.2 | 0.747 | 0.29 | 12 | 11.2 | 0.06 | 20 | 7.48 | 0.07 | 8 |
| LBY157 | 92802.3 | 0.781 | 0.03 | 18 | 11.1 | 0.09 | 20 | 7.35 | 0.08 | 6 |
| LBY157 | 92803.1 | 0.859 | 0.07 | 29 | 11.1 | 0.14 | 19 | 7.69 | L | 11 |
| LBY157 | 92803.2 | 0.838 | 0.04 | 26 | — | — | — | — | — | — |
| CONT. | — | 0.665 | — | — | 9.30 | — | — | 6.95 | — | — |
| LBY53 | 92414.1 | 0.750 | 0.29 | 12 | 11.7 | 0.13 | 20 | 7.96 | 0.15 | 6 |
| LBY53 | 92415.1 | — | — | — | 12.1 | 0.26 | 23 | 7.91 | 0.16 | 6 |

TABLE 267-continued

Genes showing improved plant performance at Normal growth conditions under regulation of At6669 promoter

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LBY53 | 92416.1 | 0.807 | 0.25 | 20 | — | — | — | — | — | — |
| LBY53 | 92417.3 | 0.777 | 0.24 | 16 | — | — | — | — | — | — |
| LBY53 | 92418.1 | — | — | — | — | — | — | 8.03 | 0.04 | 7 |
| LBY31 | 92344.2 | 0.772 | 0.22 | 15 | — | — | — | 7.85 | 0.25 | 5 |
| LBY31 | 92347.2 | 0.818 | 0.05 | 22 | 11.6 | 0.04 | 18 | — | — | — |
| LBY208 | 92358.4 | 0.870 | 0.10 | 30 | 11.8 | 0.19 | 20 | — | — | — |
| LBY207 | 92154.1 | 0.788 | 0.12 | 18 | 12.1 | 0.23 | 23 | — | — | — |
| LBY207 | 92155.1 | 0.806 | 0.13 | 20 | 12.0 | 0.23 | 23 | 8.12 | 0.02 | 9 |
| LBY207 | 92157.3 | 0.862 | 0.02 | 29 | 13.4 | 0.04 | 37 | 8.16 | 0.02 | 9 |
| LBY207 | 92158.2 | 0.757 | 0.22 | 13 | 12.2 | 0.05 | 25 | — | — | — |
| LBY175 | 92179.3 | 0.776 | 0.27 | 16 | — | — | — | — | — | — |
| LBY175 | 92180.3 | 0.807 | 0.17 | 20 | — | — | — | — | — | — |
| LBY175 | 92181.3 | 0.855 | 0.20 | 27 | 13.4 | 0.03 | 37 | 7.93 | 0.25 | 6 |
| LBY175 | 92181.4 | 0.904 | 0.02 | 35 | 11.7 | 0.23 | 20 | 7.82 | 0.25 | 5 |
| LBY140 | 92265.2 | 0.884 | 0.02 | 32 | 13.9 | L | 42 | — | — | — |
| LBY140 | 92265.5 | — | — | — | 10.8 | 0.25 | 11 | 7.74 | 0.28 | 4 |
| LBY140 | 92266.1 | 0.760 | 0.27 | 13 | — | — | — | — | — | — |
| LBY140 | 92268.2 | — | — | — | 10.9 | 0.19 | 11 | 7.96 | 0.07 | 7 |
| LBY116 | 92136.3 | 0.868 | 0.02 | 29 | — | — | — | — | — | — |
| LBY116 | 92136.4 | 0.881 | 0.19 | 31 | 12.5 | 0.19 | 27 | — | — | — |
| LBY116 | 92138.6 | 0.924 | 0.02 | 38 | 13.7 | L | 40 | 7.92 | 0.10 | 6 |
| CONT. | — | 0.670 | — | — | 9.79 | — | — | 7.48 | — | — |
| LGN2 | 89029.2 | 1.06 | 0.03 | 36 | 12.8 | 0.02 | 40 | 7.95 | 0.21 | 6 |
| LGN2 | 89029.5 | 0.976 | L | 25 | 12.3 | L | 35 | 7.83 | 0.28 | 4 |
| LGN2 | 89032.2 | 0.935 | 0.17 | 19 | 12.0 | 0.16 | 31 | — | — | — |
| LGN2 | 89032.3 | 0.879 | 0.09 | 12 | 10.7 | 0.20 | 17 | — | — | — |
| LGN2 | 89033.1 | 0.933 | 0.09 | 19 | 13.2 | 0.08 | 45 | — | — | — |
| CONT. | — | 0.784 | — | — | 9.14 | — | — | 7.49 | — | — |
| LGN57 | 89064.2 | 0.786 | L | 28 | 9.46 | L | 48 | 7.33 | L | 19 |
| LGN57 | 89067.3 | 0.665 | 0.18 | 8 | — | — | — | — | — | — |
| CONT. | — | 0.615 | — | — | 6.40 | — | — | 6.15 | — | — |
| LGN42 | 92204.3 | 0.717 | 0.20 | 10 | — | — | — | — | — | — |
| LGN42 | 92204.5 | 0.720 | 0.17 | 10 | — | — | — | — | — | — |
| CONT. | — | 0.652 | — | — | — | — | — | — | — | — |
| NUE102 | 90004.2 | 1.01 | 0.10 | 17 | — | — | — | — | — | — |
| NUE102 | 90005.1 | 0.946 | 0.12 | 9 | 13.2 | 0.29 | 12 | — | — | — |
| NUE102 | 90005.3 | 0.930 | 0.20 | 7 | — | — | — | — | — | — |
| CONT. | — | 0.867 | — | — | 11.9 | — | — | — | — | — |
| LBY85 | 92064.1 | 0.764 | 0.05 | 16 | 11.3 | L | 27 | 8.12 | 0.06 | 4 |
| LBY85 | 92066.3 | 0.749 | 0.05 | 13 | — | — | — | — | — | — |
| LBY85 | 92066.5 | 0.778 | 0.05 | 18 | 9.97 | 0.18 | 12 | — | — | — |
| LBY64 | 91342.2 | 0.750 | 0.14 | 13 | — | — | — | — | — | — |
| LBY64 | 91342.6 | 0.744 | 0.13 | 13 | — | — | — | — | — | — |
| LBY46 | 92200.3 | 0.793 | 0.10 | 20 | — | — | — | — | — | — |
| LBY46 | 92201.2 | 0.841 | 0.02 | 27 | — | — | — | 7.99 | 0.24 | 2 |
| LBY46 | 92201.4 | 0.841 | 0.02 | 27 | 10.6 | 0.02 | 20 | — | — | — |
| LBY17 | 92215.4 | 0.876 | 0.15 | 33 | — | — | — | — | — | — |
| LBY17 | 92216.2 | — | — | — | — | — | — | 8.00 | 0.17 | 3 |
| LBY17 | 92216.3 | 0.769 | 0.03 | 16 | 11.8 | L | 33 | 8.16 | 0.03 | 5 |
| LBY17 | 92216.4 | — | — | — | — | — | — | 8.05 | 0.25 | 3 |
| LBY155 | 92015.1 | 0.796 | 0.01 | 20 | — | — | — | — | — | — |
| LBY155 | 92016.7 | 0.810 | 0.02 | 23 | 9.85 | 0.18 | 11 | 7.96 | 0.25 | 2 |
| LBY122 | 91371.2 | 0.746 | 0.09 | 13 | 10.4 | 0.14 | 17 | 8.07 | 0.14 | 3 |
| LBY122 | 91371.3 | 0.758 | 0.14 | 15 | 10.8 | L | 22 | 8.05 | 0.15 | 3 |
| LBY122 | 91371.4 | 0.723 | 0.13 | 9 | 10.7 | 0.19 | 20 | — | — | — |
| LBY122 | 91371.6 | 0.732 | 0.24 | 11 | — | — | — | — | — | — |
| CONT. | — | 0.661 | — | — | 8.89 | — | — | 7.80 | — | — |
| LGN60 | 89174.2 | 0.928 | 0.03 | 26 | — | — | — | — | — | — |
| LGN60 | 89175.3 | 0.868 | 0.09 | 18 | — | — | — | — | — | — |
| LGN60 | 89176.1 | 0.933 | 0.08 | 27 | 11.3 | 0.21 | 20 | — | — | — |
| LGN60 | 89176.2 | 0.824 | 0.21 | 12 | 11.5 | 0.04 | 22 | — | — | — |
| CONT. | — | 0.737 | — | — | 9.46 | — | — | — | — | — |
| LBY92 | 93921.2 | 1.09 | 0.01 | 39 | 20.5 | L | 86 | — | — | — |
| LBY92 | 93923.3 | 0.931 | 0.30 | 19 | 19.6 | 0.06 | 78 | 8.16 | 0.19 | 5 |
| CONT. | — | 0.786 | — | — | 11.0 | — | — | 7.80 | — | — |

Table 267. "CONT."-Control; "Ave."-Average; "% Incr." = % increment; "p-val." = p-value, L = p < 0.01.

TABLE 268

Genes showing improved plant performance at Normal growth conditions under regulation of At6669 promoter

| Game Names | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LBY200 | 92754.1 | 0.0926 | 0.03 | 28 | 1.42 | 0.09 | 24 | — | — | — |
| LBY200 | 92754.3 | — | — | — | 1.35 | 0.21 | 18 | — | — | — |
| LBY200 | 92757.1 | 0.0899 | 0.05 | 25 | 1.51 | 0.02 | 32 | — | — | — |
| LBY200 | 92757.2 | 0.0844 | 0.14 | 17 | 1.45 | 0.05 | 26 | — | — | — |
| LBY141 | 92564.1 | 0.0981 | 0.02 | 36 | — | — | — | 0.728 | 0.07 | 15 |
| LBY141 | 92565.2 | 0.0836 | 0.14 | 16 | — | — | — | — | — | — |
| CONT. | — | 0.0722 | — | — | 1.15 | — | — | 0.631 | — | — |
| LGN35 | 89042.4 | — | — | — | — | — | — | 0.705 | 0.12 | 5 |
| LGN35 | 89043.1 | — | — | — | — | — | — | 0.712 | 0.23 | 6 |
| LGN35 | 89043.2 | 0.0825 | 0.11 | 17 | — | — | — | — | — | — |
| LGN35 | 89043.3 | — | — | — | 1.20 | 0.22 | 18 | 0.727 | 0.05 | 8 |
| LGN35 | 89043.4 | 0.0963 | 0.02 | 37 | 1.27 | 0.09 | 25 | 0.711 | 0.19 | 6 |
| CONT. | — | 0.0703 | — | — | 1.01 | — | — | 0.672 | — | — |
| LBY78 | 92311.3 | — | — | — | — | — | — | 0.707 | 0.30 | 11 |
| LBY78 | 92311.4 | — | — | — | 1.66 | 0.13 | 20 | 0.708 | 0.26 | 11 |
| LBY175 | 92179.1 | 0.102 | 0.17 | 17 | — | — | — | — | — | — |
| LBY175 | 92181.2 | 0.104 | 0.03 | 20 | 1.58 | 0.23 | 14 | — | — | — |
| LBY175 | 92181.3 | — | — | — | — | — | — | 0.707 | 0.28 | 11 |
| LBY149 | 92245.2 | 0.0994 | 0.26 | 14 | — | — | — | — | — | — |
| LBY149 | 92247.1 | — | — | — | — | — | — | 0.731 | 0.14 | 15 |
| LBY140 | 92265.2 | 0.0996 | 0.12 | 14 | — | — | — | 0.713 | 0.26 | 12 |
| LBY140 | 92266.1 | — | — | — | — | — | — | 0.770 | 0.04 | 21 |
| LBY140 | 92268.2 | — | — | — | — | — | — | 0.729 | 0.13 | 14 |
| LBY116 | 92136.3 | — | — | — | — | — | — | 0.721 | 0.17 | 13 |
| LBY116 | 92136.4 | 0.0999 | 0.14 | 15 | — | — | — | 0.740 | 0.10 | 16 |
| LBY116 | 92138.6 | 0.112 | L | 29 | — | — | — | 0.735 | 0.15 | 15 |
| CONT. | — | 0.0871 | — | — | 1.39 | — | — | 0.638 | — | — |
| LGN39 | 89931.3 | — | — | — | 0.927 | 0.24 | 20 | — | — | — |
| LGN39 | 89931.4 | 0.0566 | 0.23 | 21 | — | — | — | — | — | — |
| LGN34 | 90400.2 | 0.0757 | L | 62 | 1.09 | 0.03 | 41 | — | — | — |
| LGN34 | 90403.3 | 0.0580 | 0.13 | 24 | 1.03 | 0.08 | 34 | — | — | — |
| CONT. | — | 0.0467 | — | — | 0.770 | — | — | — | — | — |
| NUE3 | 88975.1 | — | — | — | 1.12 | 0.09 | 26 | — | — | — |
| NUE3 | 88975.2 | — | — | — | 1.16 | 0.02 | 30 | 0.719 | 0.06 | 13 |
| NUE3 | 88977.1 | 0.0810 | 0.07 | 25 | 1.21 | 0.02 | 36 | 0.745 | 0.03 | 18 |
| NUE3 | 88977.2 | — | — | — | 1.12 | 0.04 | 26 | 0.711 | 0.11 | 12 |
| LGN9 | 89186.1 | — | — | — | 1.08 | 0.14 | 22 | — | — | — |
| LGN9 | 89186.2 | — | — | — | 1.06 | 0.14 | 19 | 0.718 | 0.07 | 13 |
| LGN9 | 89187.2 | — | — | — | 1.12 | 0.04 | 26 | — | — | — |
| LGN14 | 89165.3 | — | — | — | — | — | — | 0.678 | 0.28 | 7 |
| LGN14 | 89167.3 | — | — | — | 1.22 | 0.02 | 37 | 0.708 | 0.10 | 12 |
| LGN14 | 89168.1 | — | — | — | — | — | — | 0.686 | 0.23 | 8 |
| LGN14 | 89168.2 | — | — | — | 1.13 | 0.05 | 26 | 0.711 | 0.07 | 12 |
| LGN14 | 89168.5 | — | — | — | 1.04 | 0.21 | 17 | — | — | — |
| CONT. | — | 0.0648 | — | — | 0.890 | — | — | 0.634 | — | — |
| LBY68 | 93862.2 | — | — | — | 1.50 | 0.11 | 19 | — | — | — |
| LBY52 | 93946.2 | 0.0951 | 0.23 | 14 | — | — | — | — | — | — |
| LBY52 | 93946.3 | 0.0996 | 0.13 | 19 | — | — | — | — | — | — |
| LBY34_H2 | 93856.1 | 0.104 | 0.03 | 25 | 1.65 | 0.02 | 31 | — | — | — |
| LBY27_H4 | 93931.4 | 0.102 | 0.07 | 22 | — | — | — | — | — | — |
| LBY183 | 92516.5 | 0.0998 | 0.09 | 20 | — | — | — | — | — | — |
| LBY159 | 92153.1 | — | — | — | 1.57 | 0.10 | 24 | — | — | — |
| LBY157 | 92803.1 | 0.104 | 0.04 | 25 | — | — | — | — | — | — |
| LBY148 | 93767.2 | — | — | — | 1.43 | 0.25 | 13 | — | — | — |
| LBY148 | 93768.1 | 0.0937 | 0.26 | 12 | — | — | — | — | — | — |
| CONT. | — | 0.0833 | — | — | 1.26 | — | — | — | — | — |
| LGN26 | 89037.2 | 0.0893 | 0.19 | 20 | — | — | — | — | — | — |
| LGN26 | 89037.3 | 0.112 | L | 49 | — | — | — | — | — | — |
| LGN26 | 89037.4 | 0.120 | L | 61 | — | — | — | — | — | — |
| CONT. | — | 0.0747 | — | — | — | — | — | — | — | — |
| LGN46 | 89101.1 | — | — | — | 1.58 | 0.12 | 13 | — | — | — |
| LGN46 | 89101.7 | 0.0975 | 0.22 | 15 | — | — | — | 0.723 | 0.15 | 5 |
| LGN46 | 89103.1 | — | — | — | — | — | — | 0.705 | 0.23 | 2 |
| CONT. | — | 0.0851 | — | — | 1.40 | — | — | 0.690 | — | — |
| LGN57 | 89064.2 | — | — | — | 1.46 | 0.03 | 29 | 0.766 | 0.07 | 13 |
| LGN57 | 89065.1 | 0.0941 | 0.06 | 31 | 1.29 | 0.22 | 14 | — | — | — |
| LGN57 | 89067.1 | 0.0859 | 0.14 | 20 | — | — | — | — | — | — |
| CONT. | — | 0.0717 | — | — | 1.13 | — | — | 0.681 | — | — |
| LGN36 | 89044.1 | 0.0904 | 0.25 | 11 | — | — | — | — | — | — |
| LGN36 | 89047.2 | — | — | — | — | — | — | 0.770 | 0.14 | 8 |
| CONT. | — | 0.0812 | — | — | — | — | — | 0.716 | — | — |

TABLE 268-continued

Genes showing improved plant performance at Normal growth conditions under regulation of At6669 promoter

| Game Names | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LBY80 | 92273.1 | — | — | — | — | — | — | 0.728 | 0.06 | 6 |
| LBY185 | 91497.2 | — | — | — | — | — | — | 0.736 | 0.02 | 7 |
| LBY185 | 91498.2 | 0.0986 | 0.19 | 16 | — | — | — | — | — | — |
| LBY185 | 91499.2 | — | — | — | — | — | — | 0.738 | 0.22 | 7 |
| LBY185 | 91499.3 | 0.0959 | 0.26 | 13 | — | — | — | 0.735 | 0.24 | 7 |
| LBY179 | 91545.2 | 0.0991 | 0.16 | 16 | 1.53 | 0.27 | 15 | 0.755 | 0.09 | 10 |
| LBY179 | 91545.4 | — | — | — | — | — | — | 0.732 | L | 6 |
| LBY179 | 91547.2 | — | — | — | — | — | — | 0.745 | 0.14 | 8 |
| LBY179 | 91549.1 | — | — | — | — | — | — | 0.729 | 0.20 | 6 |
| LBY179 | 91549.3 | — | — | — | — | — | — | 0.776 | 0.03 | 13 |
| LBY173 | 91651.2 | — | — | — | — | — | — | 0.764 | 0.06 | 11 |
| LBY173 | 91652.1 | 0.0999 | 0.16 | 17 | — | — | — | 0.777 | 0.02 | 13 |
| LBY173 | 91653.1 | — | — | — | — | — | — | 0.740 | 0.25 | 7 |
| LBY121 | 92290.4 | 0.0992 | 0.02 | 17 | — | — | — | 0.743 | 0.18 | 8 |
| LBY121 | 92291.2 | — | — | — | — | — | — | 0.735 | 0.29 | 6 |
| LBY121 | 92291.4 | 0.0982 | 0.23 | 15 | — | — | — | — | — | — |
| CONT. | — | 0.0852 | — | — | 1.34 | — | — | 0.690 | — | — |
| LGN54 | 88206.4 | — | — | — | — | — | — | 0.714 | L | 10 |
| LGN54 | 88207.1 | — | — | — | — | — | — | 0.730 | L | 12 |
| LGN54 | 88208.2 | 0.104 | 0.02 | 17 | — | — | — | 0.787 | L | 21 |
| CONT. | — | 0.0885 | — | — | — | — | — | 0.650 | — | — |
| LBY80 | 92269.3 | — | — | — | 1.13 | 0.06 | 21 | — | — | — |
| LBY80 | 92270.1 | 0.0790 | 0.03 | 23 | 1.14 | 0.06 | 21 | — | — | — |
| LBY78 | 92311.3 | — | — | — | 1.21 | 0.03 | 29 | — | — | — |
| LBY78 | 92311.4 | 0.0738 | 0.11 | 15 | 1.22 | 0.03 | 30 | — | — | — |
| LBY78 | 92312.2 | — | — | — | 1.12 | 0.09 | 20 | — | — | — |
| LBY78 | 92313.1 | — | — | — | — | — | — | 0.763 | 0.26 | 10 |
| LBY78 | 92313.5 | 0.0735 | 0.18 | 14 | 1.13 | 0.06 | 20 | 0.782 | 0.20 | 12 |
| LBY53 | 92414.1 | 0.0718 | 0.20 | 12 | 1.10 | 0.10 | 18 | — | — | — |
| LBY53 | 92415.1 | — | — | — | 1.07 | 0.28 | 13 | — | — | — |
| LBY53 | 92418.1 | 0.0712 | 0.22 | 11 | — | — | — | — | — | — |
| LBY208 | 92356.1 | 0.0706 | 0.27 | 10 | — | — | — | — | — | — |
| LBY208 | 92357.1 | 0.0752 | 0.10 | 17 | 1.11 | 0.09 | 18 | — | — | — |
| LBY208 | 92358.2 | 0.0715 | 0.19 | 11 | — | — | — | — | — | — |
| LBY153 | 92249.2 | 0.0820 | L | 27 | 1.15 | 0.08 | 22 | — | — | — |
| LBY153 | 92252.2 | — | — | — | 1.07 | 0.20 | 14 | — | — | — |
| LBY153 | 92253.2 | 0.0724 | 0.23 | 12 | 1.18 | 0.02 | 26 | 0.768 | 0.25 | 10 |
| LBY149 | 92246.3 | — | — | — | 1.38 | L | 47 | 0.766 | 0.30 | 10 |
| LBY149 | 92247.3 | — | — | — | 1.05 | 0.26 | 12 | — | — | — |
| LBY121 | 92290.3 | 0.0774 | 0.05 | 20 | 1.14 | 0.04 | 21 | 0.760 | 0.30 | 9 |
| LBY121 | 92291.4 | 0.0728 | 0.13 | 13 | — | — | — | — | — | — |
| LBY121 | 92293.2 | 0.0758 | 0.06 | 18 | — | — | — | — | — | — |
| CONT. | — | 0.0644 | — | — | 0.940 | — | — | 0.697 | — | — |
| LGN4 | 89075.2 | 0.0827 | 0.21 | 15 | — | — | — | — | — | — |
| CONT. | — | 0.0719 | — | — | — | — | — | — | — | — |
| LGN52 | 90578.6 | — | — | — | 1.09 | 0.25 | 18 | — | — | — |
| LGN52 | 90581.1 | — | — | — | — | — | — | 0.772 | 0.08 | 7 |
| LGN52 | 90581.4 | — | — | — | 1.35 | 0.12 | 46 | — | — | — |
| CONT. | — | — | — | — | 0.921 | — | — | 0.723 | — | — |
| LGN41 | 92101.1 | 0.0803 | 0.16 | 22 | — | — | — | — | — | — |
| LGN41 | 92102.1 | 0.0764 | 0.13 | 16 | — | — | — | — | — | — |
| LGN41 | 92102.3 | 0.0841 | 0.05 | 28 | — | — | — | — | — | — |
| CONT. | — | 0.0657 | — | — | — | — | — | — | — | — |
| LGN46 | 89101.4 | — | — | — | 1.62 | 0.04 | 40 | 0.861 | 0.09 | 10 |
| LGN46 | 89101.9 | 0.0714 | 0.24 | 16 | — | — | — | — | — | — |
| LGN46 | 89103.1 | 0.0673 | 0.29 | 9 | — | — | — | — | — | — |
| CONT. | — | 0.0616 | — | — | 1.16 | — | — | 0.781 | — | — |
| LGN45 | 91575.2 | 0.0957 | 0.02 | 19 | — | — | — | 0.781 | 0.02 | 11 |
| LGN45 | 91575.3 | 0.0925 | 0.02 | 15 | — | — | — | 0.738 | 0.24 | 5 |
| LGN45 | 91579.3 | 0.0920 | 0.26 | 14 | — | — | — | — | — | — |
| LGN45 | 91579.4 | 0.0885 | 0.18 | 10 | — | — | — | — | — | — |
| CONT. | — | 0.0806 | — | — | — | — | — | 0.701 | — | — |
| LBY92 | 93921.2 | 0.115 | 0.01 | 37 | 2.52 | L | 89 | 0.808 | 0.18 | 7 |
| LBY92 | 93923.3 | 0.0977 | 0.29 | 16 | 2.41 | L | 81 | — | — | — |
| LBY201 | 93925.1 | — | — | — | 1.51 | 0.27 | 14 | — | — | — |
| LBY20 | 94087.1 | — | — | — | — | — | — | 0.856 | 0.06 | 13 |
| LBY106_H3 | 93918.1 | 0.0964 | 0.29 | 15 | — | — | — | — | — | — |
| CONT. | — | 0.0840 | — | — | 1.33 | — | — | 0.755 | — | — |
| LBY50 | 91317.3 | 0.0930 | L | 59 | 1.36 | L | 42 | 0.773 | 0.03 | 13 |
| LBY50 | 91318.1 | — | — | — | — | — | — | 0.760 | 0.05 | 12 |
| LBY50 | 91318.2 | 0.0809 | 0.03 | 38 | — | — | — | — | — | — |

TABLE 268-continued

Genes showing improved plant performance at Normal growth conditions under regulation of At6669 promoter

| Game Names | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LBY50 | 91319.2 | 0.0660 | 0.28 | 12 | 1.14 | 0.11 | 19 | 0.744 | 0.09 | 9 |
| LBY24 | 91220.6 | — | — | — | 1.26 | 0.02 | 30 | 0.781 | L | 15 |
| LBY24 | 91221.1 | — | — | — | — | — | — | 0.739 | 0.22 | 8 |
| LBY24 | 91221.2 | 0.0790 | 0.02 | 35 | — | — | — | — | — | — |
| LBY24 | 91223.1 | 0.0691 | 0.19 | 18 | 1.11 | 0.26 | 15 | — | — | — |
| LBY24 | 91223.3 | — | — | — | — | — | — | 0.720 | 0.25 | 6 |
| LBY21 | 90977.1 | — | — | — | 1.17 | 0.09 | 21 | 0.776 | 0.02 | 14 |
| LBY21 | 90978.4 | 0.0679 | 0.18 | 16 | — | — | — | 0.718 | 0.26 | 5 |
| LBY21 | 90979.2 | 0.0700 | 0.09 | 19 | — | — | — | — | — | — |
| LBY161 | 91292.1 | 0.0677 | 0.20 | 16 | — | — | — | — | — | — |
| LBY161 | 91292.5 | 0.0733 | 0.05 | 25 | 1.14 | 0.12 | 19 | 0.731 | 0.22 | 7 |
| LBY161 | 91293.3 | 0.0838 | L | 43 | 1.09 | 0.30 | 13 | 0.718 | 0.29 | 5 |
| LBY161 | 91294.1 | 0.0841 | L | 43 | 1.30 | 0.02 | 35 | 0.739 | 0.10 | 8 |
| LBY161 | 91294.2 | 0.0764 | 0.01 | 30 | 1.14 | 0.18 | 18 | 0.749 | 0.06 | 10 |
| LBY15 | 91142.2 | 0.0781 | L | 33 | 1.18 | 0.07 | 22 | 0.756 | 0.04 | 11 |
| LBY15 | 91143.1 | 0.0667 | 0.29 | 14 | — | — | — | 0.786 | L | 15 |
| LBY15 | 91144.2 | 0.0693 | 0.15 | 18 | 1.20 | 0.08 | 24 | 0.765 | 0.02 | 12 |
| LBY15 | 91144.3 | 0.0667 | 0.21 | 14 | 1.14 | 0.14 | 18 | 0.774 | 0.01 | 14 |
| CONT. | — | 0.0586 | — | — | 0.964 | — | — | 0.681 | — | — |
| LGN23 | 92316.2 | 0.0822 | 0.17 | 10 | — | — | — | — | — | — |
| LGN23 | 92317.2 | 0.0924 | 0.03 | 23 | — | — | — | 0.743 | 0.10 | 5 |
| LGN23 | 92318.2 | | — | — | — | — | — | 0.731 | 0.19 | 4 |
| CONT. | — | 0.0749 | — | — | — | — | — | 0.705 | — | — |
| LGN48 | 89060.1 | 0.0997 | 0.05 | 27 | — | — | — | — | — | — |
| CONT. | — | 0.0784 | — | — | — | — | — | — | — | — |
| LGN18 | 92466.3 | 0.101 | 0.05 | 24 | — | — | — | — | — | — |
| LGN18 | 92468.3 | — | — | — | — | — | — | 0.729 | 0.14 | 3 |
| CONT. | — | 0.0817 | — | — | — | — | — | 0.706 | — | — |
| LBY41 | 91620.4 | 0.111 | L | 38 | 1.66 | 0.02 | 32 | — | — | — |
| LBY41 | 91621.1 | 0.0986 | 0.06 | 22 | — | — | — | — | — | — |
| LBY41 | 91623.2 | 0.100 | 0.06 | 24 | — | — | — | — | — | — |
| LBY186 | 91657.1 | 0.108 | 0.02 | 33 | 1.58 | 0.06 | 26 | 0.765 | 0.19 | 10 |
| LBY186 | 91659.1 | 0.128 | L | 58 | 1.77 | L | 41 | 0.778 | 0.15 | 12 |
| LBY186 | 91659.3 | 0.105 | L | 29 | 1.74 | L | 38 | 0.761 | 0.19 | 12 |
| LBY186 | 91659.4 | 0.103 | 0.04 | 27 | — | — | — | 0.788 | 0.09 | 14 |
| LBY166 | 91542.5 | 0.0953 | 0.10 | 18 | — | — | — | — | — | — |
| LBY166 | 91544.3 | 0.126 | L | 56 | 1.70 | 0.03 | 36 | 0.792 | 0.10 | 14 |
| LBY166 | 91544.4 | — | — | — | — | — | — | 0.761 | 0.19 | 10 |
| LBY166 | 91544.5 | 0.0939 | 0.13 | 16 | — | — | — | — | — | — |
| CONT. | — | 0.0808 | — | — | 1.26 | — | — | 0.694 | — | — |
| LGN35 | 89043.1 | 0.107 | 0.11 | 21 | 1.47 | L | 30 | — | — | — |
| LGN35 | 89043.4 | 0.105 | 0.19 | 18 | 1.29 | 0.24 | 14 | 0.739 | 0.15 | 9 |
| CONT. | — | 0.0890 | — | — | 1.13 | — | — | 0.676 | — | — |
| LGN33 | 91572.1 | 0.0715 | 0.06 | 16 | 1.10 | 0.17 | 21 | — | — | — |
| LGN33 | 91572.3 | 0.0744 | 0.05 | 20 | — | — | — | — | — | — |
| LGN33 | 91574.2 | 0.0739 | 0.11 | 20 | — | — | — | — | — | — |
| LGN33 | 91574.4 | 0.0684 | 0.22 | 11 | — | — | — | — | — | — |
| CONT. | — | 0.0618 | — | — | 0.907 | — | — | — | — | — |
| LGN18 | 92465.1 | 0.0838 | 0.24 | 15 | — | — | — | — | — | — |
| LGN18 | 92466.3 | 0.0837 | 0.23 | 15 | — | — | — | — | — | — |
| LGN18 | 92468.3 | 0.0928 | 0.01 | 28 | 1.49 | 0.12 | 14 | 0.792 | 0.11 | 7 |
| LGN18 | 92468.5 | 0.0880 | 0.16 | 21 | — | — | — | — | — | — |
| CONT. | — | 0.0727 | — | — | 1.31 | — | — | 0.740 | — | — |
| LBY186 | 91657.1 | 0.0895 | 0.15 | 19 | — | — | — | 0.777 | 0.16 | 8 |
| LBY186 | 91659.1 | 0.101 | 0.01 | 35 | 1.44 | 0.02 | 34 | 0.782 | 0.22 | 9 |
| LBY186 | 91659.4 | 0.0882 | 0.17 | 18 | — | — | — | — | — | — |
| LBY179 | 91545.4 | — | — | — | — | — | — | 0.774 | 0.17 | 7 |
| LBY179 | 91549.1 | 0.0979 | 0.02 | 31 | 1.29 | 0.11 | 20 | — | — | — |
| LBY179 | 91549.3 | — | — | — | — | — | — | 0.783 | 0.12 | 9 |
| LBY152 | 91286.1 | 0.0911 | 0.13 | 22 | — | — | — | — | — | — |
| LBY152 | 91288.2 | — | — | — | — | — | — | 0.793 | 0.08 | 10 |
| LBY152 | 91289.2 | 0.0936 | 0.07 | 25 | 1.33 | 0.08 | 24 | — | — | — |
| LBY123 | 91427.1 | — | — | — | 1.32 | 0.07 | 22 | 0.807 | 0.06 | 12 |
| LBY123 | 91429.3 | — | — | — | 1.37 | 0.06 | 27 | — | — | — |
| CONT. | — | 0.0749 | — | — | 1.08 | — | — | 0.720 | — | — |
| LBY180 | 92576.3 | 0.0960 | 0.26 | 12 | — | — | — | — | — | — |
| LBY180 | 92578.5 | 0.0972 | 0.14 | 13 | — | — | — | — | — | — |
| LBY144 | 93061.6 | 0.0956 | 0.17 | 11 | — | — | — | — | — | — |
| CONT. | — | 0.0859 | — | — | — | — | — | — | — | — |
| LGN47 | 91171.4 | — | — | — | 1.45 | 0.25 | 12 | 0.672 | 0.29 | 3 |
| LGN47 | 91174.2 | — | — | — | — | — | — | 0.737 | 0.10 | 11 |

TABLE 268-continued

Genes showing improved plant performance at Normal growth conditions under regulation of At6669 promoter

| Game Names | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LGN47 | 91174.3 | — | — | — | 1.46 | 0.02 | 12 | 0.696 | 0.29 | 5 |
| LGN47 | 91174.4 | — | — | — | 1.52 | 0.24 | 17 | — | — | — |
| LGN47 | 91174.6 | — | — | — | — | — | — | 0.676 | 0.30 | 3 |
| CONT. | — | — | — | — | 1.44 | — | — | 0.665 | — | — |
| LGN42 | 92204.1 | — | — | — | 1.41 | 0.14 | 24 | 0.705 | 0.05 | 8 |
| LGN42 | 92204.2 | — | — | — | — | — | — | 0.720 | 0.30 | 10 |
| LGN42 | 92204.3 | — | — | — | 1.38 | 0.21 | 21 | 0.696 | 0.12 | 6 |
| LGN42 | 92204.5 | — | — | — | — | — | — | 0.697 | 0.18 | 6 |
| LGN42 | 92207.1 | — | — | — | — | — | — | 0.763 | 0.15 | 16 |
| CONT. | — | — | — | — | 1.14 | — | — | 0.656 | — | — |
| LBY191 | 92519.2 | 0.0858 | 0.14 | 21 | — | — | — | — | — | — |
| LBY144 | 93059.3 | 0.0815 | 0.21 | 15 | — | — | — | — | — | — |
| LBY144 | 93061.6 | 0.0902 | 0.03 | 27 | — | — | — | — | — | — |
| LBY111 | 92798.1 | — | — | — | 1.38 | 0.23 | 14 | 0.771 | 0.12 | 9 |
| CONT. | — | 0.0710 | — | — | 1.21 | — | — | 0.707 | — | — |
| LGN41 | 92102.2 | — | — | — | 0.989 | 0.28 | 9 | — | — | — |
| LGN41 | 92102.3 | 0.0673 | 0.27 | 25 | — | — | — | — | — | — |
| CONT. | — | 0.0537 | — | — | 0.910 | — | — | — | — | — |
| NUE3 | 88977.1 | — | — | — | 0.782 | 0.14 | 28 | — | — | — |
| NUE3 | 88977.2 | 0.0420 | 0.27 | 18 | 0.834 | 0.05 | 37 | — | — | — |
| NUE3 | 88977.5 | 0.0454 | 0.12 | 28 | — | — | — | — | — | — |
| LGN7 | 89181.1 | 0.0442 | 0.18 | 24 | — | — | — | 0.662 | 0.04 | 22 |
| LGN7 | 89183.2 | 0.0421 | 0.26 | 19 | — | — | — | — | — | — |
| LGN14 | 89165.3 | 0.0413 | 0.30 | 16 | — | — | — | 0.602 | 0.29 | 11 |
| LGN14 | 89167.3 | 0.0423 | 0.24 | 19 | — | — | — | — | — | — |
| CONT. | — | 0.0355 | — | — | 0.611 | — | — | 0.542 | — | — |
| LGN1 | 92185.2 | — | — | — | 1.58 | 0.22 | 15 | 0.739 | 0.05 | 6 |
| LGN1 | 92185.4 | — | — | — | — | — | — | 0.762 | 0.07 | 9 |
| LGN1 | 92188.1 | 0.114 | 0.20 | 13 | 1.73 | 0.15 | 26 | — | — | — |
| CONT. | — | 0.101 | — | — | 1.37 | — | — | 0.701 | — | — |
| LGN4 | 89075.2 | 0.0579 | 0.01 | 25 | 1.11 | 0.08 | 22 | 0.628 | 0.25 | 9 |
| CONT. | — | 0.0462 | — | — | 0.909 | — | — | 0.577 | — | — |
| LGN49 | 89081.3 | 0.104 | L | 37 | 1.56 | 0.18 | 19 | — | — | — |
| LGN49 | 89081.4 | 0.0913 | 0.04 | 20 | — | — | — | — | — | — |
| CONT. | — | 0.0760 | — | — | 1.31 | — | — | — | — | — |
| LGN39 | 89930.2 | — | — | — | 1.29 | 0.04 | 31 | 0.656 | 0.13 | 20 |
| LGN34 | 90403.4 | — | — | — | 1.30 | 0.10 | 32 | — | — | — |
| CONT. | — | — | — | — | 0.982 | — | — | 0.549 | — | — |
| LGN52 | 90578.6 | — | — | — | — | — | — | 0.697 | 0.14 | 7 |
| LGN52 | 90581.1 | — | — | — | — | — | — | 0.712 | 0.09 | 9 |
| CONT. | — | — | — | — | — | — | — | 0.650 | — | — |
| LBY71 | 93769.2 | 0.0828 | 0.19 | 20 | — | — | — | — | — | — |
| LBY71 | 93769.3 | 0.0798 | 0.29 | 16 | — | — | — | — | — | — |
| LBY71 | 93773.2 | 0.0874 | 0.07 | 27 | 1.37 | 0.04 | 35 | — | — | — |
| LBY68 | 93860.3 | 0.0809 | 0.21 | 17 | 1.21 | 0.22 | 20 | — | — | — |
| LBY68 | 93862.1 | 0.0814 | 0.23 | 18 | 1.27 | 0.12 | 26 | — | — | — |
| LBY68 | 93862.2 | 0.0791 | 0.29 | 15 | 1.39 | 0.03 | 37 | — | — | — |
| LBY68 | 93862.4 | — | — | — | 1.24 | 0.15 | 23 | 0.777 | 0.18 | 10 |
| LBY68 | 93862.5 | — | — | — | 1.23 | 0.19 | 21 | — | — | — |
| LBY61 | 94019.1 | 0.0814 | 0.21 | 18 | — | — | — | — | — | — |
| LBY61 | 94019.4 | 0.0891 | 0.10 | 29 | 1.26 | 0.14 | 25 | — | — | — |
| LBY6 | 94108.3 | — | — | — | 1.18 | 0.30 | 16 | — | — | — |
| LBY52 | 93944.1 | — | — | — | 1.25 | 0.13 | 23 | — | — | — |
| LBY52 | 93944.2 | — | — | — | 1.29 | 0.09 | 28 | 0.771 | 0.26 | 10 |
| LBY52 | 93946.2 | 0.0851 | 0.10 | 24 | — | — | — | — | — | — |
| LBY5 | 93940.1 | — | — | — | — | — | — | 0.783 | 0.10 | 11 |
| LBY5 | 93940.2 | — | — | — | 1.24 | 0.15 | 22 | — | — | — |
| LBY5 | 93941.3 | 0.0827 | 0.23 | 20 | 1.35 | 0.05 | 33 | 0.761 | 0.25 | 8 |
| LBY5 | 93941.4 | — | — | — | — | — | — | 0.761 | 0.27 | 8 |
| LBY34_H2 | 93855.2 | 0.0807 | 0.27 | 17 | — | — | — | — | — | — |
| LBY34_H2 | 93856.1 | — | — | — | 1.21 | 0.24 | 19 | — | — | — |
| LBY34_H2 | 93857.1 | 0.0837 | 0.14 | 22 | 1.38 | 0.04 | 36 | 0.795 | 0.09 | 13 |
| LBY34_H2 | 93857.2 | 0.0848 | 0.13 | 23 | 1.40 | 0.02 | 39 | — | — | — |
| LBY34_H2 | 93857.4 | — | — | — | 0.780 | 0.11 | 11 | — | — | — |
| LBY216 | 94082.2 | — | — | — | 1.34 | 0.04 | 32 | — | — | — |
| LBY20 | 94087.3 | — | — | — | — | — | — | 0.803 | 0.05 | 14 |
| LBY181 | 92480.5 | 0.0817 | 0.19 | 19 | — | — | — | 0.772 | 0.22 | 10 |
| LBY181 | 92482.1 | 0.0850 | 0.12 | 23 | — | — | — | — | — | — |
| LBY142 | 93199.1 | 0.0792 | 0.26 | 15 | 1.22 | 0.17 | 21 | — | — | — |
| LBY142 | 93203.3 | 0.0999 | L | 45 | 1.43 | 0.04 | 42 | 0.760 | 0.29 | 8 |
| LBY142 | 93203.4 | 0.0865 | 0.09 | 26 | 1.47 | L | 45 | — | — | — |

TABLE 268-continued

Genes showing improved plant performance at Normal growth conditions under regulation of At6669 promoter

| Game Names | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 0.0689 | — | — | 1.01 | — | — | 0.704 | — | — |
| LBY41 | 91621.1 | 0.0768 | 0.14 | 18 | — | — | — | — | — | — |
| LBY41 | 91621.2 | 0.0756 | 0.16 | 16 | — | — | — | — | — | — |
| LBY41 | 91623.1 | 0.0762 | 0.16 | 17 | 1.26 | 0.25 | 16 | — | — | — |
| LBY41 | 91623.2 | 0.0788 | 0.07 | 21 | — | — | — | — | — | — |
| LBY173 | 91651.2 | 0.0737 | 0.23 | 13 | — | — | — | — | — | — |
| LBY173 | 91652.1 | 0.102 | L | 56 | 1.39 | 0.06 | 28 | — | — | — |
| LBY173 | 91652.2 | 0.0779 | 0.09 | 19 | — | — | — | — | — | — |
| LBY173 | 91652.5 | 0.109 | L | 66 | 1.70 | L | 56 | 0.867 | 0.02 | 17 |
| LBY173 | 91653.1 | 0.0745 | 0.20 | 14 | — | — | — | — | — | — |
| LBY166 | 91542.5 | 0.104 | L | 60 | — | — | — | — | — | — |
| LBY166 | 91544.5 | 0.0933 | L | 43 | — | — | — | — | — | — |
| CONT. | — | 0.0653 | — | — | 1.09 | — | — | 0.741 | — | — |
| LBY85 | 92068.3 | 0.0968 | 0.30 | 12 | — | — | — | — | — | — |
| LBY64 | 91340.4 | — | — | — | — | — | — | 0.742 | 0.30 | 7 |
| LBY64 | 91342.2 | — | — | — | — | — | — | 0.762 | 0.12 | 10 |
| LBY46 | 92201.4 | — | — | — | 1.62 | 0.04 | 23 | — | — | — |
| LBY207 | 92155.1 | 0.0991 | 0.24 | 14 | — | — | — | — | — | — |
| LBY207 | 92157.3 | — | — | — | — | — | — | 0.752 | 0.22 | 8 |
| LBY207 | 92158.2 | 0.107 | 0.08 | 24 | 1.73 | 0.03 | 31 | — | — | — |
| LBY185 | 91497.2 | 0.104 | 0.07 | 20 | — | — | — | 0.753 | 0.23 | 9 |
| LBY185 | 91498.2 | — | — | — | — | — | — | 0.762 | 0.12 | 10 |
| LBY185 | 91499.2 | 0.103 | 0.08 | 19 | 1.71 | 0.02 | 30 | — | — | — |
| LBY17 | 92216.2 | 0.114 | 0.01 | 32 | 1.72 | 0.01 | 30 | — | — | — |
| LBY155 | 92015.1 | 0.101 | 0.14 | 16 | 1.52 | 0.15 | 16 | — | — | — |
| LBY122 | 91370.2 | 0.103 | 0.12 | 19 | — | — | — | — | — | — |
| LBY122 | 91371.6 | 0.103 | 0.08 | 19 | 1.50 | 0.21 | 13 | — | — | — |
| CONT. | — | 0.0867 | — | — | 1.32 | — | — | 0.693 | — | — |
| LBY50 | 91319.2 | — | — | — | 1.68 | 0.12 | 19 | — | — | — |
| LBY24 | 91220.6 | 0.111 | 0.15 | 15 | 1.60 | 0.21 | 14 | — | — | — |
| LBY24 | 91221.2 | 0.118 | 0.10 | 22 | — | — | — | — | — | — |
| LBY21 | 90978.4 | — | — | — | 1.59 | 0.28 | 13 | — | — | — |
| LBY21 | 90980.1 | 0.111 | 0.17 | 15 | 1.62 | 0.20 | 15 | — | — | — |
| LBY161 | 91294.1 | — | — | — | 1.74 | 0.14 | 23 | — | — | — |
| LBY15 | 91144.1 | — | — | — | 1.61 | 0.23 | 14 | — | — | — |
| LBY123 | 91429.2 | 0.116 | 0.07 | 21 | — | — | — | — | — | — |
| LBY123 | 91429.3 | 0.109 | 0.21 | 13 | 1.61 | 0.21 | 14 | — | — | — |
| LBY114 | 91393.1 | — | — | — | 1.66 | 0.16 | 18 | 0.781 | 0.12 | 14 |
| LBY114 | 91393.2 | 0.124 | 0.01 | 29 | 1.60 | 0.26 | 13 | 0.772 | 0.20 | 12 |
| CONT. | — | 0.0962 | — | — | 1.41 | — | — | 0.688 | — | — |
| LGN24 | 89096.1 | — | — | — | — | — | — | 0.701 | 0.05 | 4 |
| LGN24 | 89096.3 | 0.0816 | 0.27 | 15 | 1.30 | 0.16 | 18 | — | — | — |
| CONT. | — | 0.0708 | — | — | 1.10 | — | — | 0.674 | — | — |
| LGN23 | 92316.2 | 0.101 | 0.02 | 28 | 1.43 | 0.08 | 15 | 0.679 | 0.04 | 9 |
| LGN23 | 92317.2 | 0.0892 | 0.06 | 13 | — | — | — | 0.676 | 0.03 | 9 |
| CONT. | — | 0.0788 | — | — | 1.25 | — | — | 0.623 | — | — |
| LBY93 | 92657.1 | 0.0909 | 0.29 | 18 | 1.41 | 0.18 | 21 | — | — | — |
| LBY93 | 92657.4 | — | — | — | 1.36 | 0.30 | 16 | — | — | — |
| LBY76 | 92642.1 | 0.0983 | 0.06 | 27 | 1.45 | 0.10 | 24 | — | — | — |
| LBY76 | 92642.2 | 0.0890 | 0.27 | 15 | — | — | — | — | — | — |
| LBY76 | 92642.3 | 0.0970 | 0.07 | 25 | — | — | — | 0.750 | 0.18 | 7 |
| LBY70 | 92684.2 | 0.110 | L | 43 | 1.43 | 0.12 | 22 | — | — | — |
| LBY70 | 92685.5 | 0.0893 | 0.26 | 16 | — | — | — | — | — | — |
| LBY70 | 92686.2 | 0.0991 | 0.07 | 28 | 1.57 | 0.04 | 34 | 0.749 | 0.22 | 7 |
| LBY227 | 92851.1 | 0.0892 | 0.29 | 15 | — | — | — | — | — | — |
| LBY227 | 92852.3 | 0.0893 | 0.28 | 15 | — | — | — | — | — | — |
| LBY227 | 92853.1 | 0.106 | 0.01 | 37 | 1.65 | L | 41 | 0.789 | 0.03 | 13 |
| LBY209 | 92499.7 | — | — | — | 1.36 | 0.25 | 16 | — | — | — |
| LBY183 | 92516.2 | 0.0929 | 0.16 | 20 | 1.33 | 0.29 | 14 | — | — | — |
| LBY183 | 92516.4 | — | — | — | 1.40 | 0.20 | 20 | 0.762 | 0.18 | 9 |
| LBY183 | 92516.5 | — | — | — | 0.744 | 0.28 | 6 | — | — | — |
| LBY180 | 92578.5 | 0.101 | 0.07 | 30 | — | — | — | — | — | — |
| LBY159 | 92150.4 | 0.0891 | 0.25 | 15 | — | — | — | 0.769 | 0.08 | 10 |
| LBY159 | 92152.1 | — | — | — | 1.34 | 0.26 | 15 | — | — | — |
| LBY159 | 92152.2 | 0.104 | 0.02 | 35 | — | — | — | — | — | — |
| LBY159 | 92152.3 | 0.0897 | 0.23 | 16 | 1.46 | 0.11 | 24 | 0.755 | 0.13 | 8 |
| LBY159 | 92153.1 | 0.0947 | 0.12 | 22 | 1.45 | 0.10 | 24 | — | — | — |
| LBY156 | 92294.1 | 0.103 | 0.02 | 33 | 1.43 | 0.15 | 22 | 0.782 | 0.05 | 12 |
| LBY156 | 92294.2 | 0.0880 | 0.30 | 14 | — | — | — | — | — | — |
| LBY156 | 92294.3 | 0.0960 | 0.10 | 24 | 1.58 | 0.01 | 35 | — | — | — |
| LBY156 | 92298.1 | 0.0901 | 0.23 | 17 | — | — | — | — | — | — |

TABLE 268-continued

Genes showing improved plant performance at Normal growth conditions under regulation of At6669 promoter

| Game Names | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LBY156 | 92298.2 | 0.0942 | 0.17 | 22 | — | — | — | — | — | — |
| LBY145 | 92608.4 | — | — | — | 1.44 | 0.08 | 23 | 0.760 | 0.15 | 9 |
| CONT. | — | 0.0773 | — | — | 1.17 | — | — | 0.700 | — | — |
| LGN48 | 89060.1 | — | — | — | — | — | — | 0.724 | 0.06 | 7 |
| LGN48 | 89063.1 | — | — | — | — | — | — | 0.707 | 0.19 | 5 |
| CONT. | — | — | — | — | — | — | — | 0.674 | — | — |
| LGN5 | 88198.1 | 0.0832 | 0.23 | 5 | — | — | — | — | — | — |
| LGN5 | 88201.1 | — | — | — | — | — | — | 0.698 | 0.02 | 6 |
| LGN5 | 88201.3 | — | — | — | — | — | — | 0.697 | 0.10 | 6 |
| CONT. | — | 0.0824 | — | — | — | — | — | 0.708 | — | — |
| LGN47 | 91174.3 | 0.0897 | 0.08 | 21 | 1.14 | 0.17 | 16 | 0.784 | 0.02 | 7 |
| LGN47 | 91174.6 | 0.0925 | 0.01 | 25 | 1.16 | 0.04 | 18 | — | — | — |
| CONT. | — | 0.0741 | — | — | 0.980 | — | — | 0.731 | — | — |
| LGN1 | 92184.1 | — | — | — | — | — | — | 0.757 | 0.08 | 3 |
| LGN1 | 92185.1 | 0.0802 | 0.23 | 22 | 1.21 | 0.17 | 22 | 0.768 | 0.14 | 10 |
| LGN1 | 92185.2 | 0.0800 | 0.27 | 22 | — | — | — | — | — | — |
| LGN1 | 92187.1 | — | — | — | 1.20 | 0.05 | 21 | 0.740 | 0.02 | 6 |
| LGN1 | 92188.1 | 0.0924 | 0.03 | 41 | 1.22 | 0.10 | 23 | 0.723 | 0.22 | 3 |
| CONT. | — | 0.0655 | — | — | 0.990 | — | — | 0.732 | — | — |
| LGN33 | 91574.4 | — | — | — | — | — | — | 0.751 | 0.25 | 5 |
| CONT. | — | — | — | — | — | — | — | 0.717 | — | — |
| LGN45 | 91575.3 | 0.108 | L | 57 | 1.43 | 0.20 | 25 | 0.762 | 0.09 | 14 |
| LGN45 | 91579.3 | 0.0760 | 0.23 | 10 | — | — | — | — | — | — |
| LGN45 | 91579.5 | 0.0864 | 0.05 | 25 | 1.40 | L | 22 | 0.704 | 0.13 | 5 |
| CONT. | — | 0.0689 | — | — | 1.14 | — | — | 0.669 | — | — |
| LBY44 | 92491.2 | 0.0825 | 0.24 | 14 | — | — | — | 0.734 | 0.07 | 12 |
| LBY43 | 92680.1 | — | — | — | — | — | — | 0.750 | 0.03 | 14 |
| LBY181 | 92479.3 | 0.0922 | 0.05 | 27 | — | — | — | 0.714 | 0.30 | 9 |
| LBY181 | 92480.5 | 0.0969 | 0.01 | 33 | 1.38 | 0.16 | 23 | 0.726 | 0.11 | 10 |
| LBY181 | 92482.1 | 0.0891 | 0.06 | 23 | — | — | — | — | — | — |
| LBY167 | 92770.4 | 0.0815 | 0.30 | 12 | 1.53 | 0.04 | 37 | 0.727 | 0.13 | 11 |
| LBY157 | 92799.3 | 0.0858 | 0.19 | 18 | — | — | — | — | — | — |
| LBY157 | 92802.2 | — | — | — | 1.36 | 0.18 | 21 | 0.747 | 0.03 | 14 |
| LBY157 | 92802.3 | 0.0842 | 0.19 | 16 | 1.34 | 0.21 | 20 | 0.719 | 0.13 | 9 |
| LBY157 | 92803.1 | 0.0922 | 0.05 | 27 | 1.33 | 0.23 | 19 | 0.750 | 0.03 | 14 |
| LBY157 | 92803.2 | 0.0896 | 0.07 | 23 | — | — | — | — | — | — |
| CONT. | — | 0.0727 | — | — | 1.12 | — | — | 0.658 | — | — |
| LBY53 | 92414.1 | — | — | — | 1.42 | 0.14 | 22 | — | — | — |
| LBY53 | 92415.1 | — | — | — | 1.46 | 0.14 | 25 | — | — | — |
| LBY53 | 92416.1 | 0.0838 | 0.18 | 25 | — | — | — | 0.756 | 0.21 | 10 |
| LBY53 | 92417.3 | 0.0805 | 0.25 | 20 | — | — | — | — | — | — |
| LBY31 | 92344.2 | 0.0799 | 0.26 | 19 | — | — | — | — | — | — |
| LBY31 | 92347.2 | 0.0845 | 0.12 | 26 | 1.41 | 0.16 | 21 | — | — | — |
| LBY208 | 92358.1 | — | — | — | 1.39 | 0.25 | 19 | — | — | — |
| LBY208 | 92358.4 | 0.0910 | 0.06 | 36 | 1.43 | 0.16 | 22 | — | — | — |
| LBY207 | 92154.1 | 0.0813 | 0.21 | 21 | 1.46 | 0.14 | 25 | 0.754 | 0.21 | 10 |
| LBY207 | 92155.1 | 0.0823 | 0.19 | 23 | 1.45 | 0.14 | 24 | — | — | — |
| LBY207 | 92157.3 | 0.0873 | 0.07 | 30 | 1.63 | 0.01 | 39 | 0.759 | 0.18 | 11 |
| LBY207 | 92158.2 | — | — | — | 1.49 | 0.07 | 27 | — | — | — |
| LBY175 | 92179.1 | 0.0826 | 0.24 | 23 | — | — | — | — | — | — |
| LBY175 | 92180.3 | 0.0865 | 0.11 | 29 | — | — | — | — | — | — |
| LBY175 | 92181.3 | 0.0859 | 0.17 | 28 | 1.61 | 0.02 | 38 | — | — | — |
| LBY175 | 92181.4 | 0.0912 | 0.05 | 36 | 1.41 | 0.17 | 21 | — | — | — |
| LBY140 | 92265.2 | 0.0925 | 0.03 | 38 | 1.68 | L | 44 | — | — | — |
| LBY140 | 92266.1 | 0.0796 | 0.28 | 19 | — | — | — | 0.748 | 0.21 | 9 |
| LBY140 | 92268.2 | — | — | — | — | — | — | 0.753 | 0.16 | 10 |
| LBY116 | 92136.3 | 0.0900 | 0.05 | 35 | — | — | — | — | — | — |
| LBY116 | 92136.4 | 0.0911 | 0.09 | 36 | 1.53 | 0.08 | 31 | 0.740 | 0.27 | 8 |
| LBY116 | 92138.6 | 0.0961 | 0.02 | 44 | 1.66 | L | 43 | 0.753 | 0.22 | 10 |
| CONT. | — | 0.0669 | — | — | 1.17 | — | — | 0.685 | — | — |
| LGN2 | 89029.2 | 0.110 | 0.03 | 36 | 1.50 | 0.03 | 40 | — | — | — |
| LGN2 | 89029.5 | 0.104 | L | 30 | 1.44 | 0.01 | 35 | — | — | — |
| LGN2 | 89032.2 | 0.0994 | 0.11 | 24 | 1.40 | 0.19 | 31 | — | — | — |
| LGN2 | 89032.3 | 0.0909 | 0.11 | 13 | 1.29 | 0.14 | 21 | 0.727 | 0.09 | 9 |
| LGN2 | 89033.1 | 0.0965 | 0.10 | 20 | 1.55 | 0.09 | 45 | — | — | — |
| CONT. | — | 0.0804 | — | — | 1.07 | — | — | 0.667 | — | — |
| LGN57 | 89064.2 | 0.0798 | L | 28 | 1.16 | L | 49 | 0.769 | L | 23 |
| LGN57 | 89067.3 | 0.0701 | 0.10 | 13 | — | — | — | 0.664 | 0.07 | 6 |
| CONT. | — | 0.0622 | — | — | 0.782 | — | — | 0.625 | — | — |
| NUE102 | 90004.1 | — | — | — | — | — | — | 0.712 | 0.04 | 7 |
| NUE102 | 90004.2 | 0.109 | 0.11 | 17 | — | — | — | 0.711 | 0.02 | 7 |

TABLE 268-continued

Genes showing improved plant performance at Normal growth conditions under regulation of At6669 promoter

| Gene Names | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| NUE102 | 90005.1 | 0.101 | 0.13 | 9 | 1.61 | 0.17 | 17 | 0.781 | L | 17 |
| NUE102 | 90005.3 | 0.100 | 0.17 | 8 | — | — | — | 0.743 | L | 11 |
| CONT. | — | 0.0928 | — | — | 1.38 | — | — | 0.667 | — | — |
| LBY85 | 92064.1 | 0.0812 | 0.11 | 18 | 1.37 | L | 30 | 0.769 | 0.30 | 6 |
| LBY85 | 92066.3 | 0.0784 | 0.23 | 13 | — | — | — | — | — | — |
| LBY85 | 92066.5 | 0.0829 | 0.09 | 20 | 1.20 | 0.22 | 13 | — | — | — |
| LBY64 | 91340.4 | — | — | — | — | — | — | 0.788 | 0.12 | 8 |
| LBY64 | 91342.2 | 0.0794 | 0.20 | 15 | — | — | — | — | — | — |
| LBY64 | 91342.6 | 0.0788 | 0.22 | 14 | — | — | — | — | — | — |
| LBY46 | 92200.3 | 0.0825 | 0.12 | 20 | — | — | — | — | — | — |
| LBY46 | 92201.2 | 0.0890 | 0.02 | 29 | — | — | — | 0.767 | 0.27 | 5 |
| LBY46 | 92201.4 | 0.0904 | 0.02 | 31 | 1.28 | 0.06 | 21 | — | — | — |
| LBY17 | 92214.1 | — | — | — | — | — | — | 0.772 | 0.21 | 6 |
| LBY17 | 92215.4 | 0.0945 | 0.03 | 37 | — | — | — | — | — | — |
| LBY17 | 92216.3 | 0.0831 | 0.08 | 20 | 1.43 | L | 35 | 0.780 | 0.21 | 7 |
| LBY17 | 92216.4 | — | — | — | — | — | — | 0.770 | 0.22 | 6 |
| LBY155 | 92015.1 | 0.0847 | 0.05 | 23 | 1.21 | 0.24 | 14 | 0.771 | 0.22 | 6 |
| LBY155 | 92016.7 | 0.0868 | 0.03 | 26 | 1.19 | 0.25 | 12 | 0.771 | 0.20 | 6 |
| LBY122 | 91371.2 | 0.0800 | 0.14 | 16 | 1.26 | 0.10 | 19 | 0.777 | 0.18 | 7 |
| LBY122 | 91371.3 | 0.0815 | 0.13 | 18 | 1.32 | 0.03 | 24 | 0.800 | 0.05 | 10 |
| LBY122 | 91371.4 | — | — | — | 1.29 | 0.10 | 22 | 0.771 | 0.26 | 6 |
| LBY122 | 91371.6 | 0.0778 | 0.28 | 13 | — | — | — | 0.773 | 0.25 | 6 |
| LBY122 | 91374.1 | 0.0800 | 0.26 | 16 | — | — | — | — | — | — |
| CONT. | — | 0.0691 | — | — | 1.06 | — | — | 0.727 | — | — |
| LGN60 | 89174.2 | 0.0978 | 0.02 | 27 | — | — | — | — | — | — |
| LGN60 | 89175.3 | 0.0929 | 0.07 | 20 | — | — | — | — | — | — |
| LGN60 | 89176.1 | 0.0949 | 0.12 | 23 | 1.38 | 0.20 | 21 | 0.721 | 0.13 | 6 |
| LGN60 | 89176.2 | 0.0875 | 0.18 | 14 | 1.38 | 0.05 | 21 | — | — | — |
| CONT. | — | 0.0771 | — | — | 1.14 | — | — | 0.696 | — | — |
| LBY92 | 93921.2 | 0.115 | 0.01 | 37 | 2.52 | L | 89 | 0.808 | 0.18 | 7 |
| LBY92 | 93923.3 | 0.0977 | 0.29 | 16 | 2.41 | L | 81 | — | — | — |
| CONT. | — | 0.0840 | — | — | 1.33 | — | — | 0.755 | — | — |

Table 268. CONT.-Control; Ave.-Average; % Incr. = % increment; p-val. = p-value, L = p < 0.01.

The genes presented in Tables 269-272 below show a significant improvement in plant performance since they produced a larger leaf biomass (leaf area) and root biomass (root length and root coverage) (Tables 269 and 271) and a higher relative growth rate of leaf area, root coverage and root length (Tables 270 and 272) when grown under normal growth conditions, compared to control plants. Plants producing larger root biomass have better possibilities to absorb larger amount of nitrogen from soil. Plants producing larger leaf biomass have better ability to produce assimilates. The genes were cloned under the regulation of a constitutive promoter (At6669). The evaluation of each gene was performed by testing the performance of different number of events. Some of the genes were evaluated in more than one seedling analysis. This second experiment confirmed the significant increment in leaf and root performance. Event with p-value <0.1 was considered statistically significant.

TABLE 269

Genes showing improved plant performance at Low Nitrogen growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGN35 | 89043.1 | 0.394 | L | 16 | — | — | — | 7.47 | 0.07 | 8 |
| LGN35 | 89043.3 | — | — | — | — | — | — | 7.70 | L | 12 |
| LGN35 | 89043.4 | 0.370 | 0.06 | 9 | 15.2 | L | 35 | 7.69 | L | 12 |
| CONT. | — | 0.340 | — | — | 11.3 | — | — | 6.90 | — | — |
| LGN39 | 89931.3 | 0.441 | 0.24 | 9 | — | — | — | — | — | — |
| LGN39 | 89931.4 | 0.467 | L | 16 | — | — | — | 7.05 | 0.27 | 4 |
| LGN34 | 90400.2 | 0.465 | 0.10 | 15 | — | — | — | — | — | — |
| LGN34 | 90403.1 | 0.455 | 0.04 | 13 | — | — | — | — | — | — |
| LGN34 | 90403.3 | 0.480 | 0.04 | 19 | 12.4 | 0.26 | 24 | — | — | — |
| CONT. | — | 0.403 | — | — | 10.0 | — | — | 6.75 | — | — |
| NUE3 | 88975.1 | — | — | — | 12.8 | 0.24 | 16 | — | — | — |
| NUE3 | 88975.2 | — | — | — | 14.1 | L | 27 | 8.11 | L | 7 |
| NUE3 | 88977.1 | 0.431 | 0.26 | 4 | 14.2 | L | 28 | 7.93 | L | 5 |

TABLE 269-continued

Genes showing improved plant performance at Low Nitrogen
growth conditions under regulation of At6669 promoter

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| NUE3 | 88977.2 | — | — | — | 13.5 | 0.05 | 22 | 7.91 | 0.10 | 5 |
| NUE3 | 88977.4 | — | — | — | — | — | — | 7.92 | 0.05 | 5 |
| LGN9 | 89185.2 | — | — | — | 12.2 | 0.20 | 11 | — | — | — |
| LGN9 | 89186.1 | 0.441 | 0.17 | 7 | 12.4 | 0.28 | 12 | — | — | — |
| LGN9 | 89186.2 | — | — | — | 12.8 | 0.03 | 16 | 7.98 | 0.02 | 6 |
| LGN7 | 89183.3 | — | — | — | — | — | — | 7.95 | 0.03 | 5 |
| LGN7 | 89183.8 | — | — | — | 11.8 | 0.27 | 6 | — | — | — |
| LGN14 | 89165.3 | — | — | — | 14.3 | 0.03 | 29 | — | — | — |
| LGN14 | 89167.3 | — | — | — | 14.1 | 0.01 | 27 | 7.71 | 0.28 | 2 |
| LGN14 | 89168.1 | — | — | — | 12.1 | 0.24 | 9 | — | — | — |
| LGN14 | 89168.2 | — | — | — | 15.4 | L | 39 | 7.93 | 0.01 | 5 |
| LGN14 | 89168.5 | — | — | — | 13.9 | 0.08 | 25 | 7.92 | 0.17 | 5 |
| CONT. | — | 0.412 | — | — | 11.1 | — | — | 7.56 | — | — |
| LGN26 | 89037.2 | 0.415 | 0.23 | 9 | — | — | — | — | — | — |
| CONT. | — | 0.380 | — | — | — | — | — | — | — | — |
| LGN46 | 89101.1 | 0.441 | L | 14 | 17.1 | 0.01 | 21 | 8.33 | 0.02 | 4 |
| LGN46 | 89101.7 | 0.433 | 0.06 | 12 | 16.8 | L | 19 | 8.12 | 0.07 | 4 |
| CONT. | — | 0.428 | — | — | 16.4 | — | — | 8.03 | — | — |
| LGN57 | 89064.2 | 0.435 | L | 25 | 19.6 | L | 49 | 8.35 | 0.01 | 6 |
| LGN57 | 89065.1 | 0.401 | 0.09 | 15 | 18.2 | 0.11 | 38 | — | — | — |
| LGN57 | 89067.1 | 0.433 | L | 25 | 18.6 | L | 41 | 8.29 | 0.06 | 5 |
| LGN57 | 89067.2 | — | — | — | 17.1 | L | 30 | 8.09 | 0.13 | 2 |
| LGN57 | 89067.3 | 0.375 | 0.15 | 8 | — | — | — | — | — | — |
| CONT. | — | 0.348 | — | — | 13.2 | — | — | 7.90 | — | — |
| LGN36 | 89045.2 | 0.389 | 0.18 | 7 | — | — | — | 8.11 | 0.12 | 6 |
| LGN36 | 89047.1 | — | — | — | 14.6 | 0.27 | 12 | 8.03 | 0.04 | 5 |
| LGN36 | 89047.2 | — | — | — | — | — | — | 7.83 | 0.24 | 3 |
| CONT. | — | 0.364 | — | — | 13.0 | — | — | 7.62 | — | — |
| LGN54 | 88206.4 | 0.461 | 0.07 | 6 | — | — | — | — | — | — |
| LGN54 | 88207.1 | — | — | — | — | — | — | 8.21 | 0.12 | 2 |
| CONT. | — | 0.437 | — | — | — | — | — | 8.05 | — | — |
| LGN4 | 89074.3 | — | — | — | 16.4 | L | 33 | 8.14 | 0.04 | 9 |
| LGN4 | 89075.2 | — | — | — | 14.6 | 0.23 | 18 | 8.02 | 0.15 | 8 |
| CONT. | — | — | — | — | 12.3 | — | — | 7.45 | — | — |
| LGN52 | 90578.6 | — | — | — | — | — | — | 7.96 | 0.27 | 4 |
| LGN52 | 90581.1 | 0.398 | 0.29 | 5 | 15.4 | 0.03 | 22 | 7.89 | 0.05 | 8 |
| LGN52 | 90581.4 | — | — | — | 14.3 | 0.09 | 14 | — | — | — |
| CONT. | — | 0.383 | — | — | 12.6 | — | — | 7.66 | — | — |
| LGN41 | 92102.1 | — | — | — | 16.6 | 0.03 | 27 | 8.29 | L | 12 |
| CONT. | — | — | — | — | 13.1 | — | — | 7.39 | — | — |
| LGN46 | 89101.1 | — | — | — | — | — | — | 8.27 | 0.27 | 2 |
| LGN46 | 89101.4 | 0.382 | 0.27 | 3 | — | — | — | — | — | — |
| LGN46 | 89101.9 | 0.434 | 0.02 | 18 | 18.8 | 0.18 | 34 | — | — | — |
| CONT. | — | 0.369 | — | — | 14.0 | — | — | 8.07 | — | — |
| LGN45 | 91575.2 | — | — | — | 17.1 | 0.01 | 35 | 7.97 | 0.25 | 7 |
| LGN45 | 91579.3 | — | — | — | 14.6 | 0.09 | 15 | 8.00 | 0.13 | 7 |
| LGN45 | 91579.5 | — | — | — | 13.9 | 0.24 | 10 | — | — | — |
| CONT. | — | — | — | — | 12.7 | — | — | 7.47 | — | — |
| LGN23 | 92318.2 | — | — | — | — | — | — | 7.92 | 0.08 | 4 |
| CONT. | — | — | — | — | — | — | — | 7.64 | — | — |
| LGN48 | 89060.1 | 0.386 | 0.28 | 5 | — | — | — | — | — | — |
| LGN48 | 89063.2 | 0.423 | 0.25 | 8 | — | — | — | — | — | — |
| CONT. | — | 0.391 | — | — | — | — | — | — | — | — |
| LGN35 | 89043.3 | 0.437 | 0.17 | 9 | — | — | — | — | — | — |
| LGN35 | 89043.4 | — | — | — | — | — | — | 8.46 | 0.20 | 3 |
| CONT. | — | 0.400 | — | — | — | — | — | 8.19 | — | — |
| LGN33 | 91570.4 | 0.412 | 0.13 | 9 | 14.8 | 0.20 | 9 | — | — | — |
| LGN33 | 91572.1 | — | — | — | 17.9 | 0.02 | 32 | — | — | — |
| LGN33 | 91572.3 | — | — | — | 16.5 | L | 21 | — | — | — |
| CONT. | — | 0.378 | — | — | 13.6 | — | — | — | — | — |
| LGN18 | 92468.3 | 0.390 | 0.16 | 12 | 14.9 | 0.05 | 34 | 8.08 | 0.02 | 12 |
| CONT. | — | 0.347 | — | — | 11.1 | — | — | 7.24 | — | — |
| LGN47 | 91174.4 | 0.455 | 0.16 | 6 | — | — | — | — | — | — |
| LGN47 | 91174.6 | 0.465 | 0.19 | 5 | 16.4 | 0.24 | 5 | — | — | — |
| CONT. | — | 0.443 | — | — | 15.5 | — | — | — | — | — |
| LGN42 | 92204.1 | 0.396 | 0.03 | 10 | 13.7 | 0.10 | 21 | 7.76 | 0.06 | 7 |
| LGN42 | 92204.3 | 0.388 | 0.10 | 8 | 12.8 | 0.27 | 12 | 7.52 | 0.27 | 4 |
| LGN42 | 92204.5 | — | — | — | 14.5 | 0.18 | 28 | 7.86 | 0.09 | 8 |
| LGN42 | 92207.1 | 0.427 | 0.07 | 19 | 18.2 | 0.02 | 60 | 8.28 | L | 14 |
| CONT. | — | 0.359 | — | — | 11.4 | — | — | 7.26 | — | — |
| NUE3 | 88975.2 | — | — | — | 8.82 | 0.24 | 16 | 6.31 | 0.03 | 10 |
| NUE3 | 88977.1 | — | — | — | 8.77 | 0.30 | 15 | — | — | — |

TABLE 269-continued

Genes showing improved plant performance at Low Nitrogen
growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| NUE3 | 88977.2 | — | — | — | 9.81 | 0.02 | 28 | 6.48 | 0.11 | 13 |
| NUE3 | 88977.5 | 0.451 | 0.01 | 26 | 9.35 | 0.16 | 22 | 6.46 | 0.09 | 13 |
| LGN9 | 89186.1 | 0.405 | 0.03 | 13 | — | — | — | — | — | — |
| LGN7 | 89183.2 | 0.372 | 0.27 | 4 | — | — | — | 6.01 | 0.30 | 5 |
| CONT. | — | 0.358 | — | — | 7.64 | — | — | 5.73 | — | — |
| LGN1 | 92185.1 | 0.421 | 0.23 | 4 | — | — | — | — | — | — |
| LGN1 | 92185.2 | — | — | — | — | — | — | 8.56 | 0.08 | 3 |
| LGN1 | 92187.1 | — | — | — | — | — | — | 8.52 | 0.09 | 2 |
| LGN1 | 92188.1 | 0.437 | 0.05 | 8 | — | — | — | — | — | — |
| CONT. | — | 0.420 | — | — | — | — | — | 8.48 | — | — |
| LGN49 | 89079.1 | 0.431 | 0.25 | 3 | 17.3 | L | 21 | 8.16 | 0.17 | 3 |
| LGN49 | 89079.3 | — | — | — | 15.6 | 0.20 | 9 | — | — | — |
| LGN49 | 89081.3 | 0.463 | 0.02 | 10 | 17.9 | 0.11 | 26 | 8.32 | 0.16 | 5 |
| LGN49 | 89081.6 | 0.440 | 0.28 | 5 | 15.1 | 0.26 | 6 | — | — | — |
| CONT. | — | 0.420 | — | — | 14.3 | — | — | 7.95 | — | — |
| LGN4 | 89074.3 | 0.424 | 0.04 | 12 | — | — | — | 6.48 | 0.27 | 9 |
| LGN4 | 89074.4 | 0.409 | 0.25 | 8 | — | — | — | 6.45 | 0.15 | 8 |
| LGN4 | 89075.1 | — | — | — | 10.8 | 0.06 | 22 | 6.36 | 0.14 | 7 |
| LGN4 | 89075.2 | 0.451 | 0.04 | 19 | 11.3 | 0.03 | 29 | 6.69 | 0.01 | 12 |
| CONT. | — | 0.380 | — | — | 8.83 | — | — | 5.96 | — | — |
| LGN52 | 90578.6 | — | — | — | — | — | — | 7.99 | 0.17 | 5 |
| LGN52 | 90581.1 | — | — | — | 14.5 | 0.24 | 13 | 8.16 | 0.04 | 7 |
| LGN52 | 90581.4 | — | — | — | 15.2 | 0.14 | 19 | — | — | — |
| CONT. | — | — | — | — | 12.8 | — | — | 7.61 | — | — |
| LGN23 | 92316.2 | — | — | — | 14.1 | 0.23 | 11 | 8.00 | 0.18 | 4 |
| LGN23 | 92317.2 | — | — | — | — | — | — | 8.00 | 0.13 | 4 |
| CONT. | — | — | — | — | 12.7 | — | — | 7.71 | — | — |
| LGN24 | 89094.2 | 0.394 | 0.25 | 5 | — | — | — | — | — | — |
| LGN24 | 89096.1 | — | — | — | — | — | — | 8.14 | 0.24 | 3 |
| LGN24 | 89096.3 | — | — | — | 14.3 | 0.07 | 11 | — | — | — |
| CONT. | — | 0.374 | — | — | 12.9 | — | — | 7.88 | — | — |
| LGN5 | 88198.1 | 0.466 | 0.09 | 8 | — | — | — | — | — | — |
| LGN5 | 88198.4 | 0.495 | 0.03 | 15 | — | — | — | — | — | — |
| LGN5 | 88201.1 | 0.454 | 0.25 | 6 | 18.3 | 0.06 | 8 | 8.54 | 0.07 | 3 |
| LGN5 | 88201.3 | 0.497 | 0.01 | 15 | — | — | — | 8.39 | 0.15 | 2 |
| LGN5 | 88203.2 | 0.479 | 0.01 | 11 | 19.5 | 0.09 | 15 | 8.43 | 0.11 | 2 |
| CONT. | — | 0.431 | — | — | 16.9 | — | — | 8.26 | — | — |
| LGN48 | 89063.2 | 0.440 | 0.13 | 10 | — | — | — | 8.38 | L | 8 |
| CONT. | — | 0.402 | — | — | — | — | — | 7.79 | — | — |
| LGN47 | 91174.3 | — | — | — | 17.4 | 0.11 | 18 | 8.27 | 0.17 | 4 |
| LGN47 | 91174.4 | 0.451 | 0.06 | 8 | 16.2 | 0.22 | 10 | 8.31 | 0.05 | 4 |
| LGN47 | 91174.6 | 0.429 | 0.22 | 5 | 16.9 | 0.05 | 15 | 8.17 | 0.19 | 2 |
| CONT. | — | 0.417 | — | — | 14.7 | — | — | 7.98 | — | — |
| LGN1 | 92184.1 | 0.429 | 0.01 | 12 | 14.5 | 0.17 | 21 | 8.30 | 0.04 | 6 |
| LGN1 | 92185.1 | 0.414 | 0.22 | 8 | 15.2 | L | 27 | 8.17 | 0.07 | 5 |
| LGN1 | 92185.2 | 0.439 | 0.12 | 14 | 14.4 | 0.23 | 21 | 7.96 | 0.22 | 3 |
| LGN1 | 92187.1 | 0.419 | 0.04 | 9 | 14.4 | 0.04 | 20 | 8.37 | L | 7 |
| LGN1 | 92188.1 | 0.461 | 0.02 | 20 | 14.0 | 0.20 | 17 | 8.10 | 0.11 | 4 |
| CONT. | — | 0.385 | — | — | 12.0 | — | — | 7.80 | — | — |
| LGN2 | 89029.5 | 0.460 | 0.18 | 7 | 17.1 | 0.07 | 8 | — | — | — |
| LGN2 | 89032.2 | — | — | — | 18.6 | L | 18 | — | — | — |
| LGN2 | 89033.1 | — | — | — | 19.0 | 0.07 | 20 | — | — | — |
| CONT. | — | 0.430 | — | — | 15.8 | — | — | — | — | — |
| LGN45 | 91575.2 | 0.375 | 0.18 | 11 | 15.3 | 0.08 | 50 | 8.03 | L | 14 |
| LGN45 | 91575.3 | 0.405 | L | 19 | 13.9 | 0.12 | 36 | 7.50 | 0.19 | 7 |
| LGN45 | 91579.3 | 0.369 | 0.19 | 9 | — | — | — | 7.64 | 0.08 | 9 |
| LGN45 | 91579.4 | — | — | — | 13.0 | 0.10 | 28 | 7.53 | 0.09 | 7 |
| LGN45 | 91579.5 | 0.377 | 0.14 | 11 | 12.1 | 0.09 | 19 | 7.68 | 0.07 | 9 |
| CONT. | — | 0.339 | — | — | 10.2 | — | — | 7.03 | — | — |
| LGN33 | 91570.4 | — | — | — | — | — | — | 8.08 | 0.20 | 3 |
| CONT. | — | — | — | — | — | — | — | 7.84 | — | — |
| LGN57 | 89064.2 | 0.418 | 0.04 | 17 | 16.8 | 0.01 | 81 | 7.90 | L | 17 |
| LGN57 | 89065.1 | — | — | — | 12.3 | L | 33 | — | — | — |
| LGN57 | 89066.1 | 0.424 | 0.08 | 18 | 12.8 | 0.05 | 38 | 7.31 | 0.02 | 8 |
| LGN57 | 89067.3 | 0.373 | 0.01 | 4 | — | — | — | — | — | — |
| CONT. | — | 0.359 | — | — | 9.29 | — | — | 6.77 | — | — |
| NUE102 | 90004.1 | 0.416 | 0.26 | 9 | 15.5 | 0.27 | 8 | — | — | — |
| NUE102 | 90004.2 | — | — | — | 16.6 | 0.18 | 15 | 8.33 | 0.03 | 8 |
| NUE102 | 90005.3 | 0.408 | 0.14 | 7 | 18.0 | 0.09 | 25 | 8.33 | L | 8 |
| CONT. | — | 0.382 | — | — | 14.4 | — | — | 7.74 | — | — |
| LGN42 | 92204.2 | — | — | — | 16.5 | 0.03 | 19 | 8.52 | 0.14 | 4 |
| LGN42 | 92204.3 | — | — | — | 15.8 | 0.28 | 13 | — | — | — |

TABLE 269-continued

Genes showing improved plant performance at Low Nitrogen growth conditions under regulation of At6669 promoter

| Gene Name | Event # | Leaf Area [cm²] Ave. | Leaf Area [cm²] P-Val. | Leaf Area [cm²] % Incr. | Roots Coverage [cm²] Ave. | Roots Coverage [cm²] P-Val. | Roots Coverage [cm²] % Incr. | Roots Length [cm] Ave. | Roots Length [cm] P-Val. | Roots Length [cm] % Incr. |
|---|---|---|---|---|---|---|---|---|---|---|
| LGN42 | 92204.5 | — | — | — | 18.1 | 0.02 | 30 | 8.42 | 0.18 | 2 |
| CONT. | — | — | — | — | 13.9 | — | — | 8.23 | — | — |
| LGN60 | 89174.2 | 0.443 | 0.27 | 6 | 15.3 | 0.17 | 16 | — | — | — |
| LGN60 | 89175.3 | — | — | — | 14.3 | 0.21 | 8 | — | — | — |
| LGN60 | 89176.1 | 0.443 | 0.25 | 8 | 16.2 | 0.05 | 22 | — | — | — |
| LGN60 | 89176.2 | 0.435 | 0.29 | 6 | — | — | — | — | — | — |
| CONT. | — | 0.417 | — | — | 13.2 | — | — | — | — | — |
| LBY92 | 93921.2 | — | — | — | 36.6 | L | 139 | 8.93 | L | 7 |
| LBY92 | 93923.3 | — | — | — | 35.1 | L | 129 | 8.67 | 0.07 | 4 |
| CONT. | — | — | — | — | 15.3 | — | — | 8.32 | — | — |

Table 269. CONT.-Control; Ave.-Average; % Incr. = % increment; p-val.p-value, L-p < 0.01.

TABLE 270

Genes showing improved plant performance at Low Nitrogen growth conditions under regulation of At6669 promoter

| Gene Name | Event # | RGR Of Leaf Area Ave. | RGR Of Leaf Area P-Val. | RGR Of Leaf Area % Incr. | RGR Of Roots Coverage Ave. | RGR Of Roots Coverage P-Val. | RGR Of Roots Coverage % Incr. | RGR Of Root Length Ave. | RGR Of Root Length P-Val. | RGR Of Root Length % Incr. |
|---|---|---|---|---|---|---|---|---|---|---|
| LGN35 | 89042.4 | — | — | — | — | — | — | 0.775 | 0.22 | 11 |
| LGN35 | 89043.1 | 0.0319 | 0.02 | 13 | — | — | — | 0.770 | 0.03 | 10 |
| LGN35 | 89043.3 | — | — | — | — | — | — | 0.764 | 0.03 | 9 |
| LGN35 | 89043.4 | — | — | — | 1.88 | L | 36 | 0.795 | L | 13 |
| CONT. | — | 0.0282 | — | — | 1.39 | — | — | 0.701 | — | — |
| LGN39 | 89931.4 | 0.0431 | 0.21 | 12 | — | — | — | — | — | — |
| LGN34 | 90403.3 | 0.0456 | 0.08 | 18 | 1.47 | 0.17 | 25 | — | — | — |
| CONT. | — | 0.0386 | — | — | 1.18 | — | — | — | — | — |
| NUE3 | 88975.1 | — | — | — | 1.55 | 0.19 | 15 | — | — | — |
| NUE3 | 88975.2 | — | — | — | 1.72 | L | 28 | 0.801 | 0.08 | 8 |
| NUE3 | 88977.1 | — | — | — | 1.72 | L | 28 | — | — | — |
| NUE3 | 88977.2 | — | — | — | 1.63 | 0.05 | 21 | — | — | — |
| NUE3 | 88977.4 | — | — | — | — | — | — | 0.804 | 0.03 | 8 |
| LGN9 | 89185.2 | — | — | — | 1.50 | 0.28 | 12 | 0.794 | 0.22 | 7 |
| LGN9 | 89186.1 | 0.0414 | 0.10 | 8 | — | — | — | — | — | — |
| LGN9 | 89186.2 | — | — | — | 1.56 | 0.11 | 16 | — | — | — |
| LGN14 | 89165.3 | — | — | — | 1.75 | 0.01 | 30 | — | — | — |
| LGN14 | 89167.3 | — | — | — | 1.70 | 0.02 | 27 | — | — | — |
| LGN14 | 89168.2 | — | — | — | 1.90 | L | 41 | 0.820 | L | 10 |
| LGN14 | 89168.5 | — | — | — | 1.69 | 0.03 | 26 | 0.780 | 0.29 | 5 |
| CONT. | — | 0.0383 | — | — | 1.35 | — | — | 0.742 | — | — |
| LGN26 | 89037.3 | — | — | — | — | — | — | 0.866 | 0.01 | 10 |
| CONT. | — | — | — | — | — | — | — | 0.787 | — | — |
| LGN46 | 89101.1 | 0.0381 | 0.06 | 11 | 2.08 | 0.01 | 21 | 0.765 | 0.01 | 8 |
| LGN46 | 89101.3 | — | — | — | — | — | — | 0.806 | L | 13 |
| LGN46 | 89101.7 | 0.0366 | 0.23 | 7 | 2.03 | L | 19 | 0.773 | 0.01 | 9 |
| LGN46 | 89103.1 | — | — | — | — | — | — | 0.738 | 0.28 | 4 |
| CONT. | — | 0.0343 | — | — | 1.97 | — | — | 0.711 | — | — |
| LGN57 | 89064.2 | 0.0345 | 0.02 | 28 | 2.40 | 0.01 | 49 | 0.844 | 0.23 | 7 |
| LGN57 | 89065.1 | 0.0295 | 0.14 | 9 | 2.23 | 0.11 | 38 | 0.858 | 0.15 | 9 |
| LGN57 | 89067.1 | 0.0334 | 0.06 | 23 | 2.29 | L | 42 | 0.872 | L | 11 |
| LGN57 | 89067.2 | — | — | — | 2.11 | L | 31 | 0.864 | L | 10 |
| LGN57 | 89067.3 | 0.0319 | 0.03 | 18 | — | — | — | — | — | — |
| CONT. | — | 0.0271 | — | — | 1.61 | — | — | 0.786 | — | — |
| LGN36 | 89045.2 | 0.0302 | 0.10 | 9 | — | — | — | 0.837 | 0.06 | 12 |
| LGN36 | 89047.1 | — | — | — | 1.79 | 0.25 | 13 | 0.784 | 0.18 | 4 |
| LGN36 | 89047.2 | — | — | — | — | — | — | 0.845 | L | 13 |
| CONT. | — | 0.0277 | — | — | 1.59 | — | — | 0.750 | — | — |
| LGN54 | 88206.4 | 0.0409 | L | 12 | — | — | — | — | — | — |
| LGN54 | 88207.1 | — | — | — | 1.90 | 0.30 | 7 | 0.772 | 0.05 | 8 |
| LGN54 | 88208.2 | — | — | — | — | — | — | 0.799 | L | 12 |
| CONT. | — | 0.0418 | — | — | 1.77 | — | — | 0.713 | — | — |
| LGN4 | 89074.3 | — | — | — | 2.03 | 0.02 | 35 | 0.869 | 0.02 | 17 |
| LGN4 | 89075.1 | — | — | — | — | — | — | 0.803 | 0.23 | 9 |
| LGN4 | 89075.2 | — | — | — | 1.79 | 0.21 | 19 | 0.816 | 0.17 | 10 |
| CONT. | — | — | — | — | 1.50 | — | — | 0.740 | — | — |

TABLE 270-continued

Genes showing improved plant performance at Low Nitrogen growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LGN52 | 90578.6 | — | — | — | — | — | — | 0.771 | 0.24 | 7 |
| LGN52 | 90581.1 | — | — | — | 1.88 | 0.03 | 22 | 0.760 | 0.05 | 5 |
| LGN52 | 90581.4 | — | — | — | 1.76 | 0.07 | 14 | — | — | — |
| CONT. | — | — | — | — | 1.54 | — | — | 0.756 | — | — |
| LGN41 | 92099.1 | — | — | — | — | — | — | 0.767 | 0.25 | 4 |
| LGN41 | 92102.1 | — | — | — | 2.05 | 0.03 | 27 | 0.865 | L | 18 |
| CONT. | — | — | — | — | 1.61 | — | — | 0.735 | — | — |
| LGN46 | 89101.1 | — | — | — | — | — | — | 0.822 | 0.27 | 4 |
| LGN46 | 89101.3 | 0.0378 | 0.02 | 14 | — | — | — | 0.832 | 0.23 | 5 |
| LGN46 | 89101.4 | 0.0353 | 0.14 | 6 | — | — | — | — | — | — |
| LGN46 | 89101.9 | 0.0366 | 0.03 | 10 | 2.27 | 0.20 | 31 | — | — | — |
| CONT. | — | 0.0332 | — | — | 1.73 | — | — | 0.793 | — | — |
| LGN45 | 91575.2 | — | — | — | 2.10 | 0.01 | 36 | 0.830 | L | 18 |
| LGN45 | 91579.3 | — | — | — | 1.78 | 0.09 | 15 | 0.792 | 0.03 | 13 |
| LGN45 | 91579.5 | — | — | — | 1.69 | 0.28 | 9 | — | — | — |
| CONT. | — | — | — | — | 1.55 | — | — | 0.703 | — | — |
| LGN23 | 92317.2 | — | — | — | — | — | — | 0.839 | L | 13 |
| LGN23 | 9238.21 | — | — | — | — | — | — | 0.825 | 0.02 | 11 |
| CONT. | — | — | — | — | — | — | — | 0.745 | — | — |
| LGN48 | 89060.1 | 0.0332 | 0.10 | 9 | — | — | — | — | — | — |
| LGN48 | 89061.2 | 0.0341 | L | 12 | — | — | — | — | — | — |
| LGN48 | 89062.1 | — | — | — | — | — | — | 0.788 | 0.13 | 5 |
| LGN48 | 89063.1 | 0.0328 | 0.06 | 8 | — | — | — | — | — | — |
| LGN48 | 89063.2 | 0.0348 | 0.05 | 14 | — | — | — | — | — | — |
| CONT. | — | 0.0341 | — | — | — | — | — | 0.750 | — | — |
| LGN18 | 92466.3 | — | — | — | — | — | — | 0.773 | 0.02 | 13 |
| CONT. | — | — | — | — | — | — | — | 0.681 | — | — |
| LGN35 | 89043.3 | 0.0336 | 0.29 | 7 | — | — | — | — | — | — |
| LGN35 | 89043.4 | — | — | — | — | — | — | 0.811 | 0.18 | 5 |
| CONT. | — | 0.0316 | — | — | — | — | — | 0.773 | — | — |
| LGN33 | 91570.4 | 0.0366 | 0.28 | 6 | 1.83 | 0.21 | 9 | — | — | — |
| LGN33 | 91521.7 | — | — | — | 2.22 | 0.02 | 32 | — | — | — |
| LGN33 | 91572.3 | — | — | — | 2.04 | L | 22 | — | — | — |
| LGN33 | 91574.4 | — | — | — | — | — | — | 0.890 | 0.19 | 6 |
| CONT. | — | 0.0346 | — | — | 1.68 | — | — | 0.840 | — | — |
| LGN18 | 92466.3 | — | — | — | — | — | — | 0.727 | 0.09 | 11 |
| LGN18 | 92468.3 | — | — | — | 1.83 | 0.05 | 36 | 0.798 | L | 22 |
| LGN18 | 92468.5 | — | — | — | — | — | — | 0.731 | 0.27 | 12 |
| CONT. | — | — | — | — | 1.35 | — | — | 0.654 | — | — |
| LGN47 | 91174.2 | — | — | — | — | — | — | 0.797 | 0.01 | 8 |
| LGN47 | 91174.6 | — | — | — | 1.98 | 0.22 | 6 | — | — | — |
| CONT. | — | — | — | — | 1.87 | — | — | 0.731 | — | — |
| LGN42 | 92204.1 | 0.0322 | 0.07 | 19 | 1.65 | 0.15 | 20 | 0.675 | 0.03 | 7 |
| LGN42 | 92204.2 | — | — | — | — | — | — | 0.733 | 0.10 | 16 |
| LGN42 | 92204.3 | 0.0296 | 0.14 | 9 | — | — | — | 0.704 | 0.22 | 11 |
| LGN42 | 92204.5 | 0.0308 | 0.27 | 13 | 1.76 | 0.10 | 28 | 0.722 | 0.17 | 14 |
| LGN42 | 92207.1 | 0.0318 | 0.24 | 17 | 2.23 | L | 62 | 0.805 | L | 27 |
| CONT. | — | 0.0272 | — | — | 1.38 | — | — | 0.633 | — | — |
| NUE3 | 88975.2 | — | — | — | — | — | — | 0.583 | 0.19 | 11 |
| NUE3 | 88977.1 | — | — | — | — | — | — | 0.587 | 0.25 | 12 |
| NUE3 | 88977.2 | — | — | — | 1.20 | 0.12 | 29 | 0.603 | 0.12 | 15 |
| NUE3 | 88977.5 | 0.0402 | 0.18 | 20 | 1.14 | 0.26 | 22 | 0.589 | 0.24 | 12 |
| CONT. | — | 0.0334 | — | — | 0.931 | — | — | 0.524 | — | — |
| LGN1 | 92185.1 | 0.0364 | 0.14 | 9 | — | — | — | — | — | — |
| LGN1 | 92185.4 | — | — | — | — | — | — | 0.825 | 0.16 | 7 |
| LGN1 | 92188.1 | 0.0373 | 0.07 | 11 | — | — | — | — | — | — |
| CONT. | — | 0.0352 | — | — | — | — | — | 0.773 | — | — |
| LGN49 | 89079.1 | — | — | — | 2.13 | L | 22 | 0.826 | L | 8 |
| LGN49 | 89079.3 | — | — | — | 1.92 | 0.15 | 10 | 0.824 | L | 8 |
| LGN49 | 89081.3 | 0.0385 | 0.08 | 9 | 2.19 | 0.11 | 26 | 0.834 | 0.03 | 10 |
| LGN49 | 89081.4 | — | — | — | 1.97 | 0.26 | 13 | 0.899 | L | 18 |
| LGN49 | 89081.6 | — | — | — | 1.86 | 0.23 | 7 | — | — | — |
| CONT. | — | 0.0353 | — | — | 1.74 | — | — | 0.761 | | |
| LGN4 | 89074.3 | 0.0418 | L | 21 | — | — | — | — | — | — |
| LGN4 | 89074.4 | 0.0396 | 0.03 | 15 | — | — | — | 0.581 | 0.24 | 11 |
| LGN4 | 89075.1 | — | — | — | 1.31 | 0.11 | 23 | — | — | — |
| LGN4 | 89075.2 | 0.0387 | 0.08 | 12 | 1.37 | 0.05 | 29 | — | — | — |
| CONT. | — | 0.0344 | — | — | 1.06 | — | — | 0.526 | — | — |
| LGN52 | 90578.6 | — | — | — | — | — | — | 0.763 | 0.02 | 12 |
| LGN52 | 90581.1 | — | — | — | 1.76 | 0.20 | 15 | 0.764 | L | 13 |
| LGN52 | 90581.4 | — | — | — | 1.84 | 0.12 | 20 | — | — | — |

TABLE 270-continued

Genes showing improved plant performance at Low Nitrogen growth conditions under regulation of At6669 promoter

| Gene Name | Event # | RGR Of Leaf Area Ave. | P-Val. | % Incr. | RGR Of Roots Coverage Ave. | P-Val. | % Incr. | RGR Of Root Length Ave. | P-Val. | % Incr. |
|---|---|---|---|---|---|---|---|---|---|---|
| CONT. | — | — | — | — | 1.54 | — | — | 0.678 | — | — |
| LGN23 | 92316.2 | — | — | — | 1.72 | 0.21 | 12 | 0.795 | 0.03 | 10 |
| LGN23 | 92317.2 | — | — | — | — | — | — | 0.809 | 0.05 | 12 |
| LGN23 | 92318.1 | — | — | — | — | — | — | 0.749 | 0.16 | 4 |
| LGN23 | 9238.21 | — | — | — | — | — | — | 0.778 | L | 8 |
| CONT. | — | — | — | — | 1.54 | — | — | 0.722 | — | — |
| LGN24 | 89096.1 | — | — | — | — | — | — | 0.773 | 0.17 | 7 |
| LGN24 | 89096.3 | — | — | — | 1.74 | 0.06 | 12 | — | — | — |
| CONT. | — | — | — | — | 1.56 | — | — | 0.723 | — | — |
| LGN5 | 88198.1 | 0.0398 | 0.05 | 13 | — | — | — | — | — | — |
| LGN5 | 88198.4 | 0.0401 | L | 14 | — | — | — | 0.785 | 0.11 | 8 |
| LGN5 | 88201.1 | 0.0388 | 0.14 | 11 | 2.21 | 0.06 | 9 | 0.819 | 0.09 | 9 |
| LGN5 | 88201.3 | 0.0433 | 0.03 | 24 | — | — | — | 0.761 | 0.10 | 5 |
| LGN5 | 88203.2 | 0.0410 | L | 17 | 2.33 | 0.12 | 14 | — | — | — |
| CONT. | — | 0.0351 | — | — | 2.04 | — | — | 0.750 | — | — |
| LGN48 | 89060.1 | 0.0337 | L | 9 | — | — | — | — | — | — |
| LGN48 | 89061.2 | 0.0344 | 0.08 | 11 | — | — | — | — | — | — |
| LGN48 | 89063.1 | 0.0341 | 0.24 | 10 | — | — | — | — | — | — |
| LGN48 | 89063.2 | 0.0377 | 0.25 | 10 | — | — | — | 0.774 | 0.06 | 4 |
| CONT. | — | 0.0344 | — | — | — | — | — | 0.731 | — | — |
| LGN47 | 91171.4 | 0.0371 | 0.23 | 5 | — | — | — | — | — | — |
| LGN47 | 91174.3 | — | — | — | 2.15 | 0.10 | 19 | 0.859 | 0.09 | 6 |
| LGN47 | 91174.4 | 0.0393 | 0.02 | 12 | 2.01 | 0.20 | 11 | 0.873 | 0.04 | 8 |
| LGN47 | 91174.6 | — | — | — | 2.08 | 0.04 | 15 | 0.848 | 0.06 | 4 |
| CONT. | — | 0.0352 | — | — | 1.81 | — | — | 0.812 | — | — |
| LGN1 | 92184.1 | 0.0353 | 0.25 | 5 | 1.78 | 0.18 | 21 | 0.792 | 0.24 | 4 |
| LGN1 | 92185.1 | — | — | — | 1.88 | L | 28 | 0.827 | L | 8 |
| LGN1 | 92185.2 | 0.0369 | 0.19 | 14 | 1.78 | 0.23 | 21 | 0.786 | 0.13 | 3 |
| LGN1 | 92187.1 | 0.0363 | 0.12 | 8 | 1.76 | 0.19 | 9 | 0.793 | 0.06 | 4 |
| LGN1 | 92188.1 | 0.0390 | L | 16 | 1.71 | 0.23 | 17 | — | — | — |
| CONT. | — | 0.0335 | — | — | 1.47 | — | — | 0.765 | — | — |
| LGN2 | 89029.5 | — | — | — | 2.04 | 0.17 | 6 | — | — | — |
| LGN2 | 89032.2 | — | — | — | 2.21 | 0.02 | 15 | — | — | — |
| LGN2 | 89032.3 | — | — | — | — | — | — | 0.808 | 0.08 | 8 |
| LGN2 | 89033.1 | — | — | — | 2.27 | 0.08 | 19 | — | — | — |
| CONT. | — | — | — | — | 1.92 | — | — | 0.745 | — | — |
| LGN45 | 91575.2 | — | — | — | 1.88 | 0.08 | 51 | 0.833 | L | 30 |
| LGN45 | 91575.3 | 0.0300 | 0.04 | 14 | 1.70 | 0.12 | 36 | 0.748 | L | 17 |
| LGN45 | 91579.3 | 0.0291 | 0.26 | 11 | — | — | — | 0.709 | 0.08 | 11 |
| LGN45 | 91579.4 | — | — | — | 1.58 | 0.10 | 27 | 0.699 | 0.21 | 9 |
| LGN45 | 91579.5 | 0.0310 | 0.07 | 18 | 1.47 | 0.09 | 18 | 0.693 | 0.09 | 9 |
| CONT. | — | 0.0262 | — | — | 1.24 | — | — | 0.639 | — | — |
| LGN33 | 91570.4 | — | — | — | — | — | — | 0.813 | 0.11 | 6 |
| LGN33 | 91572.1 | — | — | — | — | — | — | 0.861 | 0.01 | 12 |
| LGN33 | 91572.3 | — | — | — | — | — | — | 0.811 | 0.11 | 6 |
| LGN33 | 9154.27 | — | — | — | — | — | — | 0.849 | 0.06 | 11 |
| LGN33 | 91574.4 | — | — | — | — | — | — | 0.859 | 0.02 | 12 |
| CONT. | — | — | — | — | — | — | — | 0.768 | — | — |
| LGN57 | 89064.2 | 0.0341 | 0.03 | 14 | 2.08 | 0.01 | 81 | 0.834 | L | 17 |
| LGN57 | 89065.1 | — | — | — | 1.53 | L | 33 | — | — | — |
| LGN57 | 89066.1 | — | — | — | 1.57 | 0.06 | 37 | 0.756 | 0.03 | 6 |
| LGN57 | 89067.3 | 0.0333 | L | 12 | — | — | — | — | — | — |
| CONT. | — | 0.0298 | — | — | 1.15 | — | — | 0.714 | — | — |
| NUE102 | 90004.1 | — | — | — | 1.88 | 0.18 | 10 | — | — | — |
| NUE102 | 90004.2 | — | — | — | 1.99 | 0.17 | 17 | 0.767 | L | 12 |
| NUE102 | 90004.3 | — | — | — | — | — | — | 0.763 | 0.04 | 12 |
| NUE102 | 90005.1 | — | — | — | — | — | — | 0.791 | 0.03 | 16 |
| NUE102 | 90005.3 | 0.0359 | 0.10 | 9 | 2.21 | 0.07 | 30 | 0.871 | L | 28 |
| CONT. | — | 0.0328 | — | — | 1.70 | — | — | 0.683 | — | — |
| LGN42 | 92204.2 | — | — | — | 2.02 | 0.12 | 20 | 0.826 | 0.23 | 6 |
| LGN42 | 92204.3 | — | — | — | 1.93 | 0.28 | 15 | — | — | — |
| LGN42 | 92204.5 | — | — | — | 2.23 | 0.02 | 32 | 0.847 | 0.10 | 8 |
| CONT. | — | — | — | — | 1.68 | — | — | 0.781 | — | — |
| LGN60 | 89174.2 | 0.0389 | 0.05 | 8 | 1.83 | 0.27 | 14 | — | — | — |
| LGN60 | 89175.3 | — | — | — | 1.75 | 0.18 | 9 | 0.795 | 0.15 | 7 |
| LGN60 | 89176.1 | — | — | — | 1.97 | 0.06 | 22 | 0.780 | 0.19 | 5 |
| LGN60 | 89176.2 | 0.0394 | 0.22 | 10 | — | — | — | — | — | — |
| LGN60 | 89177.1 | — | — | — | — | — | — | 0.782 | 0.20 | 5 |
| CONT. | — | 0.0368 | — | — | 1.61 | — | — | 0.743 | — | — |

TABLE 270-continued

Genes showing improved plant performance at Low Nitrogen growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LBY92 | 93921.2 | — | — | — | 4.54 | L | 142 | 0.973 | 0.01 | 21 |
| LBY92 | 93923.3 | — | — | — | 4.35 | L | 132 | 0.877 | 0.24 | 9 |
| CONT. | — | — | — | — | 1.87 | — | — | 0.803 | — | — |

Table 270. CONT.-Control; Ave.-Average;% Incr. = % increment; p-val.-p-value, L-p < 0.01.

TABLE 271

Genes showing improved plan performance at Low Nitrogen growth conditions under regulation of At6669 promoter

| Gene Name | Event # | Leaf Area [cm$^2$] | | | Roots Coverage [cm$^2$] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY186 | 91657.1 | 0.416 | 0.02 | 9 | 17.5 | 0.14 | 33 | 8.31 | 0.03 | 8 |
| LBY186 | 91659.1 | — | — | — | 16.4 | L | 25 | 7.88 | 0.12 | 2 |
| LBY186 | 91659.2 | — | — | — | 15.1 | 0.06 | 15 | 7.95 | 0.07 | 3 |
| LBY186 | 91659.3 | 0.460 | L | 20 | 19.2 | L | 46 | 8.27 | L | 7 |
| LBY179 | 91545.2 | — | — | — | 15.8 | L | 21 | 8.00 | L | 4 |
| LBY179 | 91545.4 | 0.403 | 0.26 | 6 | — | — | — | 8.17 | L | 6 |
| LBY179 | 91547.2 | — | — | — | 14.4 | 0.13 | 10 | — | — | — |
| LBY179 | 91549.1 | 0.428 | 0.15 | 12 | 16.4 | 0.02 | 25 | 8.32 | L | 8 |
| LBY152 | 91286.1 | 0.426 | 0.03 | 12 | 16.5 | 0.02 | 26 | 8.20 | 0.05 | 6 |
| LBY152 | 91288.2 | 0.434 | 0.01 | 14 | 16.5 | 0.07 | 25 | 8.17 | 0.06 | 6 |
| LBY152 | 91289.2 | — | — | — | 15.0 | 0.19 | 14 | 8.04 | 0.03 | 4 |
| LBY123 | 91427.1 | 0.430 | 0.25 | 13 | 15.6 | 0.20 | 19 | — | — | — |
| LBY123 | 91429.2 | 0.418 | 0.03 | 9 | 15.6 | 0.10 | 19 | 8.04 | 0.09 | 4 |
| LBY123 | 91429.3 | — | — | — | 15.2 | 0.08 | 16 | 8.28 | L | 7 |
| LBY114 | 91391.2 | 0.417 | 0.10 | 9 | — | — | — | — | — | — |
| LBY114 | 91393.1 | 0.395 | 0.25 | 4 | — | — | — | — | — | — |
| CONT. | — | 0.382 | — | — | 13.1 | — | — | 7.72 | — | — |
| LBY200 | 92754.1 | 0.385 | 0.13 | 10 | 14.9 | 0.05 | 17 | 7.83 | 0.21 | 3 |
| LBY200 | 92754.3 | 0.405 | L | 16 | — | — | — | — | — | — |
| LBY200 | 92757.1 | 0.398 | 0.04 | 13 | — | — | — | — | — | — |
| LBY200 | 92757.2 | 0.377 | 0.16 | 8 | — | — | — | — | — | — |
| LBY200 | 92758.3 | 0.408 | 0.08 | 16 | — | — | — | — | — | — |
| LBY141 | 92564.1 | — | — | — | 15.1 | 0.30 | 18 | — | — | — |
| LBY141 | 92565.2 | — | — | — | 15.0 | 0.08 | 17 | — | — | — |
| CONT. | — | 0.351 | — | — | 12.8 | — | — | 7.59 | — | — |
| LBY203 | 92839.1 | — | — | — | 14.6 | 0.29 | 16 | — | — | — |
| LBY203 | 92841.2 | — | — | — | 15.8 | 0.14 | 25 | 8.16 | 0.04 | 7 |
| LBY203 | 92842.3 | 0.450 | 0.08 | 10 | — | — | — | 8.09 | L | 6 |
| LBY180 | 92576.3 | — | — | — | 14.8 | 0.04 | 17 | — | — | — |
| LBY180 | 92578.5 | 0.444 | 0.20 | 9 | 16.2 | 0.02 | 28 | 8.26 | L | 8 |
| LBY177 | 92495.1 | — | — | — | — | — | — | 8.08 | 0.04 | 6 |
| LBY177 | 92497.3 | — | — | — | — | — | — | 7.88 | 0.25 | 3 |
| LBY177 | 92497.6 | — | — | — | 15.4 | 0.09 | 22 | 8.14 | L | 7 |
| LBY144 | 93059.3 | — | — | — | — | — | — | 7.99 | 0.18 | 5 |
| LBY144 | 93061.4 | — | — | — | 16.7 | 0.03 | 32 | 8.43 | L | 11 |
| LBY144 | 93061.5 | — | — | — | 16.9 | 0.01 | 34 | 8.23 | 0.03 | 8 |
| LBY144 | 93061.6 | — | — | — | 14.9 | 0.22 | 18 | — | — | — |
| LBY111 | 92794.4 | 0.443 | 0.16 | 8 | — | — | — | 8.01 | 0.07 | 5 |
| LBY111 | 92797.1 | 0.470 | 0.11 | 15 | — | — | — | 8.02 | 0.13 | 5 |
| LBY111 | 92798.1 | — | — | — | — | — | — | 8.00 | 0.08 | 5 |
| CONT. | — | 0.409 | — | — | 12.6 | — | — | 7.62 | — | — |
| LBY191 | 92519.2 | — | — | — | 19.0 | 0.04 | 29 | — | — | — |
| LBY191 | 92522.1 | 0.369 | 0.22 | 5 | — | — | — | — | — | — |
| LBY191 | 92523.3 | 0.400 | 0.01 | 14 | — | — | — | — | — | — |
| LBY144 | 93059.3 | 0.374 | 0.10 | 7 | — | — | — | — | — | — |
| LBY111 | 92797.1 | 0.382 | 0.16 | 9 | — | — | — | — | — | — |
| LBY111 | 92798.1 | 0.371 | 0.28 | 6 | — | — | — | 8.09 | 0.17 | 4 |
| CONT. | — | 0.351 | — | — | 14.6 | — | — | 7.74 | — | — |
| LBY78 | 92311.4 | 0.425 | 0.18 | 12 | 15.2 | 0.02 | 22 | 8.05 | 0.18 | 4 |
| LBY78 | 92312.2 | — | — | — | 14.0 | 0.22 | 12 | — | — | — |
| LBY78 | 92313.1 | — | — | — | — | — | — | 8.19 | 0.07 | 6 |
| LBY78 | 92313.5 | — | — | — | 15.2 | 0.11 | 22 | — | — | — |
| LBY31 | 92344.1 | 0.423 | 0.02 | 11 | 15.6 | 0.19 | 25 | 8.26 | 0.05 | 7 |

TABLE 271-continued

Genes showing improved plan performance at Low Nitrogen growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY31 | 92345.4 | — | — | — | 15.8 | 0.05 | 27 | 8.13 | 0.13 | 5 |
| LBY31 | 92345.6 | 0.427 | 0.13 | 12 | — | — | — | — | — | — |
| LBY31 | 92347.2 | 0.415 | 0.20 | 9 | — | — | — | 8.08 | 0.15 | 5 |
| LBY175 | 92179.1 | 0.427 | 0.16 | 12 | 16.0 | 0.03 | 28 | 8.23 | 0.05 | 7 |
| LBY175 | 92179.3 | — | — | — | 13.9 | 0.21 | 11 | — | — | — |
| LBY175 | 92181.2 | 0.441 | 0.20 | 16 | 15.9 | 0.02 | 27 | 8.21 | 0.05 | 6 |
| LBY175 | 92181.3 | — | — | — | 13.8 | 0.28 | 11 | 8.29 | 0.08 | 7 |
| LBY175 | 92181.4 | 0.440 | 0.02 | 16 | 15.3 | 0.04 | 22 | 8.06 | 0.28 | 4 |
| LBY149 | 92245.2 | — | — | — | 13.9 | 0.21 | 11 | — | — | — |
| LBY149 | 92246.3 | — | — | — | 14.5 | 0.18 | 16 | 8.10 | 0.15 | 5 |
| LBY149 | 92247.1 | — | — | — | — | — | — | 8.13 | 0.14 | 5 |
| LBY140 | 92265.2 | — | — | — | 17.2 | 0.05 | 37 | 8.14 | 0.13 | 6 |
| LBY140 | 92265.5 | — | — | — | 16.5 | 0.02 | 32 | 8.14 | 0.12 | 5 |
| LBY140 | 92268.2 | 0.410 | 0.05 | 8 | — | — | — | 8.15 | 0.15 | 6 |
| LBY116 | 92136.3 | 0.409 | 0.24 | 8 | 15.5 | 0.12 | 24 | 8.10 | 0.19 | 5 |
| LBY116 | 92136.4 | — | — | — | 14.6 | 0.11 | 17 | 8.22 | 0.05 | 6 |
| CONT. | — | 0.380 | — | — | 12.5 | — | — | 7.72 | — | — |
| LBY68 | 93862.5 | — | — | — | 16.0 | 0.24 | 7 | — | — | — |
| LBY5 | 93940.2 | — | — | — | — | — | — | 8.53 | 0.23 | 2 |
| LBY34_H2 | 93856.1 | — | — | — | 16.6 | 0.21 | 11 | — | — | — |
| LBY183 | 92516.5 | — | — | — | 15.9 | 0.28 | 6 | — | — | — |
| LBY159 | 92152.3 | 0.456 | 0.22 | 8 | 16.4 | 0.18 | 10 | 8.56 | 0.25 | 2 |
| LBY159 | 92153.1 | — | — | — | 17.8 | 0.17 | 19 | 8.56 | 0.23 | 2 |
| LBY157 | 92803.1 | — | — | — | 18.0 | 0.25 | 21 | 8.59 | 0.22 | 3 |
| LBY148 | 93767.2 | — | — | — | 16.4 | 0.24 | 10 | 8.69 | 0.16 | 4 |
| LBY109 | 93950.6 | — | — | — | — | — | — | 8.56 | 0.28 | 2 |
| CONT. | — | 0.423 | — | — | 14.9 | — | — | 8.36 | — | — |
| LBY80 | 92269.3 | — | — | — | 10.7 | 0.01 | 43 | 7.41 | L | 15 |
| LBY80 | 92270.1 | 0.356 | 0.17 | 10 | 8.74 | 0.15 | 17 | 6.87 | 0.03 | 7 |
| LBY80 | 92272.2 | — | — | — | 11.5 | L | 54 | 7.37 | L | 15 |
| LBY80 | 92273.1 | — | — | — | 8.88 | 0.14 | 19 | 7.00 | 0.02 | 9 |
| LBY185 | 91497.1 | 0.363 | 0.04 | 12 | 13.0 | L | 74 | 7.44 | L | 16 |
| LBY185 | 91497.2 | 0.358 | 0.15 | 11 | 10.2 | 0.01 | 36 | 6.92 | 0.03 | 8 |
| LBY185 | 91498.2 | 0.366 | 0.02 | 14 | 13.2 | 0.02 | 76 | 7.64 | L | 19 |
| LBY185 | 91499.2 | — | — | — | 9.26 | 0.11 | 24 | — | — | — |
| LBY179 | 91545.2 | — | — | — | 12.1 | L | 62 | 7.43 | L | 16 |
| LBY179 | 91545.4 | — | — | — | — | — | — | 6.81 | 0.27 | 6 |
| LBY179 | 91547.2 | 0.369 | 0.29 | 14 | 13.7 | 0.10 | 84 | 7.35 | 0.06 | 14 |
| LBY179 | 91549.1 | — | — | — | 9.58 | L | 28 | 6.91 | 0.12 | 8 |
| LBY179 | 91549.3 | — | — | — | 12.0 | L | 61 | 7.60 | L | 18 |
| LBY173 | 91651.2 | — | — | — | 9.69 | 0.03 | 30 | 6.79 | 0.09 | 6 |
| LBY173 | 91652.1 | 0.378 | 0.08 | 17 | 15.0 | 0.01 | 100 | 7.70 | L | 20 |
| LBY173 | 91652.2 | 0.358 | 0.03 | 11 | 12.6 | L | 68 | 7.07 | 0.04 | 10 |
| LBY173 | 91652.3 | 0.358 | 0.18 | 11 | 9.59 | L | 28 | 7.11 | L | 11 |
| LBY173 | 91653.1 | — | — | — | 11.1 | L | 49 | 7.00 | 0.08 | 9 |
| LBY153 | 92249.2 | 0.339 | 0.28 | 5 | 10.4 | 0.02 | 39 | 7.06 | 0.05 | 10 |
| LBY153 | 92253.2 | 0.358 | 0.18 | 11 | — | — | — | — | — | — |
| LBY121 | 92290.3 | 0.358 | 0.10 | 11 | 12.2 | L | 64 | 7.60 | L | 18 |
| LBY121 | 92290.4 | — | — | — | 10.6 | 0.14 | 41 | — | — | — |
| LBY121 | 92291.2 | 0.363 | 0.20 | 13 | 9.37 | 0.17 | 25 | 7.22 | 0.13 | 12 |
| LBY121 | 92291.4 | — | — | — | 11.0 | 0.04 | 47 | 6.85 | 0.26 | 7 |
| CONT. | — | 0.323 | — | — | 7.48 | — | — | 6.42 | — | — |
| LBY71 | 93769.3 | 0.368 | 0.28 | 8 | — | — | — | — | — | — |
| LBY68 | 93862.1 | 0.365 | 0.30 | 7 | 12.9 | 0.21 | 13 | 7.75 | 0.07 | 6 |
| LBY68 | 93862.4 | 0.394 | 0.07 | 15 | — | — | — | 8.21 | L | 12 |
| LBY61 | 94019.4 | — | — | — | 13.5 | 0.22 | 18 | 7.60 | 0.28 | 4 |
| LBY61 | 94021.4 | — | — | — | 13.1 | 0.17 | 15 | — | — | — |
| LBY6 | 94111.3 | 0.382 | 0.14 | 12 | — | — | — | — | — | — |
| LBY52 | 93946.2 | 0.427 | L | 25 | 12.7 | 0.27 | 12 | 7.81 | 0.07 | 7 |
| LBY52 | 93947.2 | 0.389 | 0.02 | 14 | — | — | — | 8.05 | 0.05 | 10 |
| LBY44 | 92491.2 | 0.399 | 0.04 | 17 | — | — | — | 7.96 | 0.02 | 9 |
| LBY34_H2 | 93856.1 | 0.393 | 0.09 | 15 | — | — | — | — | — | — |
| LBY34_H2 | 93857.1 | — | — | — | 13.0 | 0.26 | 14 | — | — | — |
| LBY34_H2 | 93857.2 | — | — | — | 14.4 | 0.05 | 26 | 7.75 | 0.10 | 6 |
| LBY34_H2 | 93857.4 | 0.374 | 0.22 | 10 | — | — | — | — | — | — |
| LBY216 | 94080.3 | 0.438 | L | 28 | 13.1 | 0.14 | 15 | 7.97 | 0.01 | 9 |
| LBY20 | 94085.1 | 0.408 | 0.06 | 20 | 14.7 | 0.06 | 29 | — | — | — |
| LBY20 | 94087.3 | 0.383 | 0.06 | 12 | — | — | — | 8.13 | 0.02 | 11 |
| LBY142 | 93199.1 | — | — | — | 13.5 | 0.11 | 19 | 7.74 | 0.18 | 6 |
| LBY142 | 93203.4 | 0.386 | 0.03 | 13 | 15.2 | L | 34 | 7.79 | 0.06 | 7 |
| CONT. | — | 0.341 | — | — | 11.4 | — | — | 7.30 | — | — |
| LBY41 | 91620.4 | — | — | — | 14.2 | 0.29 | 11 | — | — | — |

TABLE 271-continued

Genes showing improved plan performance at Low Nitrogen growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY41 | 91621.1 | 0.425 | L | 16 | 15.4 | L | 20 | 8.12 | 0.29 | 2 |
| LBY41 | 91621.2 | — | — | — | 14.4 | 0.10 | 12 | — | — | — |
| LBY41 | 91623.1 | — | — | — | 14.7 | 0.01 | 14 | 8.25 | 0.27 | 4 |
| LBY41 | 91623.2 | 0.393 | 0.29 | 7 | 15.7 | 0.07 | 23 | 8.47 | 0.01 | 6 |
| LBY173 | 91651.2 | — | — | — | 13.8 | 0.24 | 8 | — | — | — |
| LBY173 | 91652.1 | 0.402 | 0.25 | 10 | 18.5 | 0.01 | 44 | 8.45 | 0.03 | 6 |
| LBY173 | 91652.5 | 0.434 | 0.03 | 18 | 18.9 | L | 48 | — | — | — |
| LBY166 | 91542.5 | — | — | — | 15.2 | 0.08 | 19 | — | — | — |
| LBY166 | 91544.5 | — | — | — | 15.9 | L | 24 | 8.31 | 0.02 | 4 |
| CONT. | — | 0.366 | — | — | 12.8 | — | — | 7.96 | — | — |
| LBY85 | 92064.1 | 0.455 | 0.09 | 13 | — | — | — | — | — | — |
| LBY85 | 92066.2 | 0.442 | 0.19 | 9 | — | — | — | — | — | — |
| LBY85 | 92066.3 | 0.468 | L | 16 | 18.9 | L | 22 | 8.44 | 0.15 | 2 |
| LBY85 | 92066.5 | 0.474 | L | 17 | — | — | — | — | — | — |
| LBY85 | 92068.3 | — | — | — | 16.6 | 0.18 | 8 | — | — | — |
| LBY64 | 91340.4 | 0.453 | 0.05 | 12 | 16.3 | 0.10 | 6 | 8.47 | 0.19 | 2 |
| LBY64 | 91342.2 | 0.454 | L | 12 | — | — | — | — | — | — |
| LBY64 | 91342.3 | 0.454 | L | 12 | 16.8 | 0.27 | 9 | — | — | — |
| LBY64 | 91342.6 | 0.434 | 0.10 | 8 | — | — | — | — | — | — |
| LBY46 | 92200.3 | 0.432 | 0.07 | 7 | 17.2 | 0.14 | 11 | — | — | — |
| LBY46 | 92201.2 | 0.450 | 0.04 | 11 | — | — | — | — | — | — |
| LBY46 | 92201.4 | 0.454 | L | 12 | 18.0 | 0.17 | 17 | 8.42 | 0.13 | 2 |
| LBY207 | 92155.1 | 0.467 | 0.02 | 16 | 17.0 | 0.17 | 10 | — | — | — |
| LBY207 | 92157.3 | — | — | — | 17.5 | 0.13 | 13 | — | — | — |
| LBY207 | 92158.2 | 0.516 | 0.01 | 28 | 17.2 | 0.17 | 11 | — | — | — |
| LBY185 | 91497.1 | 0.464 | L | 15 | 17.2 | 0.30 | 11 | — | — | — |
| LBY185 | 91497.2 | 0.478 | L | 18 | 18.8 | L | 22 | — | — | — |
| LBY185 | 91498.2 | 0.470 | 0.03 | 16 | — | — | — | — | — | — |
| LBY185 | 91499.2 | 0.450 | 0.05 | 11 | 16.9 | 0.27 | 10 | — | — | — |
| LBY17 | 92216.2 | 0.472 | 0.08 | 17 | 16.5 | 0.27 | 7 | — | — | — |
| LBY155 | 92015.1 | 0.489 | 0.02 | 21 | — | — | — | — | — | — |
| LBY155 | 92016.4 | 0.492 | L | 22 | — | — | — | — | — | — |
| LBY155 | 92016.7 | 0.466 | L | 15 | 16.9 | 0.21 | 10 | — | — | — |
| LBY122 | 91370.2 | 0.497 | L | 23 | 16.7 | 0.10 | 8 | — | — | — |
| LBY122 | 91371.3 | 0.422 | 0.30 | 5 | — | — | — | — | — | — |
| LBY122 | 91371.6 | 0.475 | 0.12 | 18 | 17.6 | 0.08 | 14 | — | — | — |
| LBY122 | 91374.1 | 0.468 | L | 16 | 17.8 | 0.07 | 15 | — | — | — |
| CONT. | — | 0.404 | — | — | 15.4 | — | — | 8.27 | — | — |
| LBY50 | 91317.3 | 0.407 | 0.13 | 8 | — | — | — | — | — | — |
| LBY50 | 91318.1 | 0.403 | 0.24 | 7 | — | — | — | — | — | — |
| LBY50 | 91318.2 | 0.452 | 0.03 | 19 | — | — | — | — | — | — |
| LBY50 | 91318.4 | 0.412 | 0.18 | 9 | — | — | — | — | — | — |
| LBY24 | 91220.6 | 0.425 | 0.07 | 12 | 17.7 | 0.02 | 16 | 8.78 | L | 9 |
| LBY24 | 91221.1 | 0.436 | 0.02 | 15 | — | — | — | — | — | — |
| LBY24 | 91221.2 | 0.472 | 0.04 | 25 | 19.2 | L | 25 | 8.42 | 0.05 | 5 |
| LBY24 | 91223.2 | 0.404 | 0.23 | 7 | — | — | — | — | — | — |
| LBY24 | 91223.3 | 0.448 | 0.01 | 18 | — | — | — | — | — | — |
| LBY21 | 90977.1 | 0.415 | 0.07 | 10 | — | — | — | — | — | — |
| LBY21 | 90978.4 | 0.430 | 0.04 | 14 | — | — | — | — | — | — |
| LBY21 | 90980.1 | 0.407 | 0.11 | 8 | 16.8 | 0.18 | 9 | 8.30 | 0.22 | 3 |
| LBY161 | 91292.1 | 0.451 | L | 19 | 16.9 | 0.24 | 10 | — | — | — |
| LBY161 | 91292.3 | — | — | — | 16.5 | 0.17 | 8 | 8.29 | 0.20 | 3 |
| LBY161 | 91293.3 | 0.441 | 0.14 | 17 | 19.0 | 0.03 | 24 | 8.62 | 0.02 | 7 |
| LBY161 | 91294.1 | — | — | — | — | — | — | 8.40 | 0.08 | 4 |
| LBY152 | 91286.1 | 0.436 | L | 15 | — | — | — | — | — | — |
| LBY152 | 91287.1 | 0.469 | L | 24 | — | — | — | 8.27 | 0.22 | 3 |
| LBY152 | 91288.2 | 0.417 | 0.13 | 10 | — | — | — | — | — | — |
| LBY152 | 91289.2 | 0.422 | 0.01 | 11 | — | — | — | — | — | — |
| LBY15 | 91143.1 | 0.432 | 0.09 | 14 | — | — | — | — | — | — |
| LBY15 | 91144.2 | 0.425 | 0.19 | 12 | 18.3 | 0.03 | 19 | 8.38 | 0.08 | 4 |
| LBY15 | 91144.3 | 0.418 | 0.24 | 11 | 17.1 | 0.05 | 11 | 8.28 | 0.23 | 3 |
| LBY123 | 91428.2 | — | — | — | 17.9 | L | 17 | 8.28 | 0.20 | 3 |
| LBY123 | 91429.2 | — | — | — | 18.0 | 0.06 | 18 | 8.26 | 0.27 | 3 |
| LBY123 | 91429.3 | — | — | — | 17.6 | 0.10 | 15 | — | — | — |
| LBY123 | 91429.6 | 0.431 | 0.18 | 14 | 18.6 | 0.09 | 22 | 8.37 | 0.19 | 4 |
| LBY114 | 91391.2 | 0.434 | 0.05 | 15 | — | — | — | — | — | — |
| LBY114 | 91393.1 | — | — | — | 18.3 | 0.07 | 20 | — | — | — |
| LBY114 | 91393.2 | 0.404 | 0.14 | 7 | — | — | — | 8.36 | 0.16 | 4 |
| CONT. | — | 0.379 | — | — | 15.3 | — | — | 8.06 | — | — |
| LBY80 | 92269.3 | — | — | — | — | — | — | 7.64 | 0.26 | 2 |
| LBY80 | 92269.4 | 0.410 | 0.09 | 11 | 14.1 | 0.28 | 24 | — | — | — |
| LBY80 | 92270.1 | 0.422 | L | 15 | 14.3 | 0.02 | 26 | 7.93 | 0.04 | 6 |

TABLE 271-continued

Genes showing improved plan performance at Low Nitrogen growth conditions under regulation of At6669 promoter

| | | Leaf Area [cm²] | | | Roots Coverage [cm²] | | | Roots Length [cm] | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LBY80 | 92272.2 | — | — | — | — | — | — | 7.77 | 0.05 | 4 |
| LBY78 | 92311.3 | 0.424 | 0.07 | 15 | — | — | — | 8.07 | 0.02 | 8 |
| LBY78 | 92311.4 | 0.414 | 0.25 | 12 | — | — | — | — | — | — |
| LBY78 | 92312.2 | — | — | — | — | — | — | 7.77 | 0.15 | 4 |
| LBY78 | 92313.5 | — | — | — | 14.5 | 0.01 | 28 | 7.97 | 0.15 | 6 |
| LBY53 | 92414.1 | — | — | — | 13.1 | 0.16 | 16 | 7.77 | 0.07 | 4 |
| LBY53 | 92418.1 | 0.406 | 0.06 | 10 | — | — | — | 8.03 | 0.02 | 7 |
| LBY153 | 92249.2 | — | — | — | 12.9 | L | 14 | 7.61 | 0.29 | 2 |
| LBY153 | 92252.2 | — | — | — | 13.3 | 0.25 | 17 | 8.07 | 0.10 | 8 |
| LBY149 | 92246.3 | 0.422 | 0.01 | 15 | 15.7 | L | 39 | 8.33 | L | 11 |
| LBY121 | 92291.2 | — | — | — | 13.4 | 0.08 | 18 | — | — | — |
| CONT. | — | 0.368 | — | — | 11.3 | — | — | 7.48 | — | — |
| LBY76 | 92642.1 | — | — | — | 16.3 | 0.29 | 15 | — | — | — |
| LBY70 | 92684.2 | — | — | — | 16.8 | 0.10 | 19 | — | — | — |
| LBY70 | 92685.5 | 0.450 | 0.04 | 15 | 17.4 | 0.11 | 23 | 8.07 | 0.24 | 4 |
| LBY70 | 92686.3 | — | — | — | 16.1 | 0.24 | 13 | — | — | — |
| LBY227 | 92851.1 | 0.449 | 0.01 | 15 | — | — | — | 8.23 | 0.08 | 7 |
| LBY227 | 92853.1 | 0.428 | 0.30 | 10 | — | — | — | — | — | — |
| LBY159 | 92152.1 | 0.432 | 0.18 | 11 | 16.2 | 0.16 | 14 | — | — | — |
| LBY159 | 92153.1 | — | — | — | 16.8 | 0.29 | 19 | 8.03 | 0.26 | 4 |
| LBY156 | 92294.1 | — | — | — | 15.6 | 0.29 | 10 | — | — | — |
| LBY156 | 92294.3 | — | — | — | — | — | — | 8.20 | 0.11 | 6 |
| LBY145 | 92605.1 | 0.422 | 0.23 | 8 | — | — | — | — | — | — |
| LBY145 | 92606.2 | 0.433 | 0.03 | 11 | 16.8 | 0.09 | 18 | 8.15 | 0.13 | 5 |
| LBY145 | 92608.4 | — | — | — | 15.9 | 0.20 | 12 | — | — | — |
| CONT. | — | 0.390 | — | — | 14.2 | — | — | 7.72 | — | — |
| LBY92 | 93921.2 | — | — | — | 36.6 | L | 139 | 8.93 | L | 7 |
| LBY92 | 93923.3 | — | — | — | 35.1 | L | 129 | 8.67 | 0.07 | 4 |
| LBY6 | 94110.2 | — | — | — | 17.9 | 0.25 | 17 | 8.52 | 0.27 | 2 |
| LBY20 | 94084.1 | — | — | — | 18.7 | 0.23 | 22 | 8.71 | 0.19 | 5 |
| LBY20 | 94087.1 | 0.427 | 0.25 | 8 | — | — | — | — | — | — |
| LBY148 | 93765.1 | — | — | — | 17.2 | 0.06 | 12 | — | — | — |
| LBY148 | 93768.1 | 0.433 | 0.15 | 9 | — | — | — | — | — | — |
| LBY106_H3 | 93916.1 | 0.426 | 0.24 | 7 | 17.1 | 0.13 | 12 | — | — | — |
| LBY106_H3 | 93918.1 | — | — | — | 17.9 | 0.07 | 17 | — | — | — |
| CONT. | — | 0.397 | — | — | 15.3 | — | — | 8.32 | — | — |
| LBY50 | 91317.3 | — | — | — | 15.6 | 0.04 | 17 | 7.96 | 0.18 | 4 |
| LBY24 | 91221.2 | 0.438 | 0.17 | 7 | 16.6 | 0.05 | 25 | 8.02 | 0.16 | 5 |
| LBY21 | 90980.1 | 0.439 | 0.25 | 8 | 15.7 | 0.25 | 18 | — | — | — |
| LBY161 | 91294.1 | — | — | — | — | — | — | 8.09 | 0.09 | 6 |
| LBY15 | 91144.1 | — | — | — | 14.8 | 0.18 | 11 | 8.03 | 0.12 | 5 |
| LBY15 | 91144.2 | — | — | — | — | — | — | 8.12 | 0.07 | 6 |
| CONT. | — | 0.408 | — | — | 13.3 | — | — | 7.63 | — | — |
| LBY53 | 92414.1 | — | — | — | — | — | — | 8.35 | 0.18 | 4 |
| LBY53 | 92415.1 | 0.466 | 0.03 | 12 | — | — | — | — | — | — |
| LBY53 | 92416.1 | — | — | — | 16.2 | 0.15 | 17 | 8.33 | 0.14 | 3 |
| LBY53 | 92418.1 | — | — | — | 16.2 | 0.15 | 17 | — | — | — |
| LBY31 | 92344.1 | 0.450 | 0.20 | 9 | 15.8 | 0.13 | 15 | — | — | — |
| LBY31 | 92344.2 | — | — | — | 17.2 | 0.05 | 24 | 8.33 | 0.07 | 3 |
| LBY31 | 92347.1 | — | — | — | 15.4 | 0.14 | 11 | — | — | — |
| LBY208 | 92358.1 | 0.454 | 0.11 | 10 | — | — | — | — | — | — |
| LBY208 | 92358.2 | 0.439 | 0.29 | 6 | — | — | — | — | — | — |
| LBY207 | 92154.1 | — | — | — | 16.6 | 0.24 | 20 | — | — | — |
| LBY207 | 92155.1 | — | — | — | 15.7 | 0.03 | 13 | — | — | — |
| LBY207 | 92157.3 | 0.461 | 0.01 | 11 | 18.8 | 0.02 | 36 | 8.37 | 0.05 | 4 |
| LBY207 | 92158.2 | 0.448 | 0.19 | 8 | 15.1 | 0.15 | 9 | — | — | — |
| LBY175 | 92179.1 | — | — | — | 16.8 | 0.14 | 21 | — | — | — |
| LBY175 | 92181.3 | 0.462 | 0.05 | 12 | 17.6 | 0.13 | 27 | 8.38 | 0.07 | 4 |
| LBY175 | 92181.4 | — | — | — | 16.3 | 0.09 | 18 | — | — | — |
| LBY140 | 92265.2 | 0.452 | 0.08 | 9 | 16.2 | 0.05 | 17 | 8.39 | 0.04 | 4 |
| LBY140 | 92265.5 | — | — | — | 15.8 | 0.26 | 14 | — | — | — |
| LBY140 | 92266.3 | — | — | — | 16.6 | 0.04 | 20 | 8.30 | 0.27 | 3 |
| LBY116 | 92136.1 | — | — | — | 16.3 | 0.09 | 18 | — | — | — |
| LBY116 | 92136.3 | — | — | — | 17.3 | 0.09 | 25 | — | — | — |
| LBY116 | 92136.4 | — | — | — | 18.0 | 0.12 | 30 | — | — | — |
| LBY116 | 92138.6 | 0.439 | 0.24 | 6 | — | — | — | — | — | — |
| CONT. | — | 0.414 | — | — | 13.8 | — | — | 8.05 | — | — |
| LBY181 | 92479.3 | — | — | — | 15.1 | L | 32 | — | — | — |
| LBY181 | 92482.1 | 0.345 | 0.22 | 3 | — | — | — | — | — | — |
| LBY167 | 92770.4 | — | — | — | 14.1 | 0.18 | 24 | — | — | — |
| LBY167 | 92773.1 | — | — | — | 13.7 | 0.15 | 20 | — | — | — |
| LBY157 | 92802.2 | — | — | — | 14.2 | 0.06 | 24 | — | — | — |

TABLE 271-continued

Genes showing improved plan performance at Low Nitrogen growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LBY157 | 92802.3 | 0.389 | 0.08 | 16 | 17.4 | 0.07 | 53 | — | — | — |
| LBY157 | 92803.1 | — | — | — | 14.3 | 0.02 | 25 | — | — | — |
| LBY157 | 92803.2 | — | — | — | 14.9 | 0.10 | 30 | — | — | — |
| CONT. | — | 0.334 | — | — | 11.4 | — | — | — | — | — |
| LBY41 | 91620.4 | — | — | — | 19.1 | 0.02 | 17 | 8.67 | L | 4 |
| LBY41 | 91621.2 | — | — | — | 18.9 | 0.13 | 16 | — | — | — |
| LBY41 | 91623.2 | 0.431 | 0.16 | 7 | — | — | — | 8.45 | 0.23 | 1 |
| LBY186 | 91655.4 | — | — | — | 18.4 | 0.05 | 13 | — | — | — |
| LBY186 | 91657.1 | — | — | — | 19.2 | 0.09 | 18 | 8.80 | L | 6 |
| LBY186 | 91659.1 | — | — | — | 18.8 | 0.07 | 15 | 8.51 | 0.26 | 2 |
| LBY186 | 91659.3 | — | — | — | 19.9 | 0.06 | 22 | — | — | — |
| LBY166 | 91544.3 | — | — | — | — | — | — | 8.51 | 0.14 | 2 |
| CONT. | — | 0.404 | — | — | 16.3 | — | — | 8.33 | — | — |
| LBY85 | 92064.1 | — | — | — | — | — | — | 8.17 | 0.17 | 3 |
| LBY85 | 92066.3 | 0.387 | 0.30 | 7 | — | — | — | — | — | — |
| LBY85 | 92066.5 | — | — | — | 16.6 | 0.07 | 21 | 8.13 | 0.24 | 3 |
| LBY64 | 91340.4 | — | — | — | — | — | — | 8.13 | 0.20 | 3 |
| LBY64 | 91342.3 | 0.383 | 0.25 | 6 | — | — | — | 8.19 | 0.18 | 4 |
| LBY64 | 91342.6 | — | — | — | — | — | — | 8.10 | 0.27 | 2 |
| LBY46 | 92200.3 | 0.392 | 0.19 | 8 | — | — | — | — | — | — |
| LBY46 | 92201.2 | 0.395 | 0.02 | 9 | 17.7 | L | 28 | 8.24 | 0.08 | 4 |
| LBY46 | 92201.4 | 0.386 | 0.10 | 7 | 17.8 | 0.01 | 29 | 8.14 | 0.28 | 3 |
| LBY17 | 92214.1 | — | — | — | — | — | — | 8.13 | 0.23 | 3 |
| LBY17 | 92216.3 | — | — | — | 15.9 | 0.13 | 15 | 8.16 | 0.19 | 3 |
| LBY17 | 92216.4 | — | — | — | 15.6 | 0.17 | 14 | 8.45 | 0.01 | 7 |
| LBY155 | 92014.2 | — | — | — | 15.0 | 0.25 | 9 | — | — | — |
| LBY155 | 92015.1 | 0.389 | 0.19 | 7 | 14.9 | 0.26 | 8 | 8.19 | 0.14 | 4 |
| LBY122 | 91371.2 | 0.394 | 0.10 | 9 | 15.3 | 0.15 | 11 | — | — | — |
| LBY122 | 91371.3 | — | — | — | 15.4 | 0.13 | 12 | 8.30 | 0.05 | 5 |
| LBY122 | 91371.4 | 0.382 | 0.25 | 5 | — | — | — | — | — | — |
| LBY122 | 91371.6 | 0.378 | 0.24 | 4 | 16.1 | 0.18 | 17 | — | — | — |
| LBY122 | 91374.1 | — | — | — | 15.4 | 0.16 | 12 | 8.10 | 0.26 | 3 |
| CONT. | — | 0.362 | — | — | 13.8 | — | — | 7.90 | — | — |

Table 271. "CONT."-Control. "Ave."-Average; "% Incr." = % increment; "p-val."-p-value, L-p < 0.01.

TABLE 272

Genes showing improved plant performance at Low Nitrogen growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LBY186 | 91657.1 | — | — | — | 2.15 | 0.02 | 33 | 0.879 | 0.01 | 14 |
| LBY186 | 91659.1 | — | — | — | 2.02 | 0.02 | 25 | 0.830 | 0.15 | 8 |
| LBY186 | 91659.2 | — | — | — | 1.87 | 0.15 | 16 | 0.894 | L | 16 |
| LBY186 | 91659.3 | 0.0406 | L | 22 | 2.37 | L | 46 | 0.871 | 0.05 | 13 |
| LBY186 | 91659.4 | — | — | — | — | — | — | 0.871 | 0.02 | 13 |
| LBY179 | 91545.2 | — | — | — | 1.95 | 0.06 | 20 | 0.865 | 0.02 | 12 |
| LBY179 | 91545.4 | 0.0365 | 0.14 | 9 | — | — | — | — | — | — |
| LBY179 | 91547.2 | — | — | — | — | — | — | 0.831 | 0.15 | 8 |
| LBY179 | 91549.1 | 0.0379 | 0.07 | 14 | 2.03 | 0.01 | 25 | 0.883 | 0.02 | 15 |
| LBY152 | 91286.1 | 0.0363 | 0.12 | 9 | 2.03 | 0.02 | 25 | 0.870 | 0.02 | 13 |
| LBY152 | 91288.2 | 0.0381 | 0.02 | 14 | 2.02 | 0.03 | 25 | — | — | — |
| LBY152 | 91289.2 | — | — | — | 1.86 | 0.20 | 15 | 0.882 | L | 15 |
| LBY123 | 91427.1 | 0.0388 | 0.08 | 16 | 1.92 | 0.12 | 19 | 0.839 | 0.13 | 9 |
| LBY123 | 91429.2 | 0.0360 | 0.13 | 8 | 1.93 | 0.07 | 19 | 0.854 | 0.07 | 11 |
| LBY123 | 91429.3 | 0.0359 | 0.13 | 8 | 1.87 | 0.14 | 15 | 0.842 | 0.13 | 9 |
| LBY114 | 91391.1 | — | — | — | — | — | — | 0.828 | 0.27 | 8 |
| LBY114 | 91391.2 | 0.0381 | 0.03 | 14 | — | — | — | — | — | — |
| LBY114 | 91393.1 | 0.0371 | 0.06 | 11 | — | — | — | — | — | — |
| CONT. | — | 0.0334 | — | — | 1.62 | — | — | 0.769 | — | — |
| LBY200 | 92754.1 | — | — | — | 1.78 | 0.13 | 17 | — | — | — |
| LBY200 | 92754.3 | 0.0339 | 0.03 | 18 | — | — | — | — | — | — |
| LBY200 | 92757.1 | 0.0322 | 0.18 | 13 | — | — | — | — | — | — |
| LBY200 | 92758.3 | 0.0349 | 0.03 | 22 | — | — | — | — | — | — |
| LBY141 | 92564.1 | — | — | — | 1.86 | 0.13 | 22 | 0.834 | L | 32 |

TABLE 272-continued

Genes showing improved plant performance at Low Nitrogen growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LBY141 | 92565.2 | — | — | — | 1.84 | 0.11 | 21 | 0.721 | 0.10 | 14 |
| LBY141 | 92566.3 | — | — | — | — | — | — | 0.756 | 0.03 | 19 |
| CONT. | — | 0.0286 | — | — | 1.52 | — | — | 0.634 | — | — |
| LBY203 | 92839.1 | — | — | — | 1.76 | 0.14 | 18 | — | — | — |
| LBY203 | 92841.2 | — | — | — | 1.89 | 0.04 | 26 | — | — | — |
| LBY203 | 92842.3 | 0.0390 | 0.05 | 18 | — | — | — | — | — | — |
| LBY180 | 92576.3 | — | — | — | 1.78 | 0.08 | 19 | 0.745 | 0.29 | 7 |
| LBY180 | 92578.5 | — | — | — | 1.94 | L | 30 | 0.756 | 0.26 | 9 |
| LBY177 | 92495.1 | — | — | — | — | — | — | 0.746 | 0.28 | 7 |
| LBY177 | 92497.6 | — | — | — | 1.85 | 0.04 | 24 | — | — | — |
| LBY144 | 93061.4 | — | — | — | 2.00 | L | 33 | — | — | — |
| LBY144 | 93061.5 | — | — | — | 2.05 | L | 36 | 0.773 | 0.15 | 11 |
| LBY144 | 93061.6 | — | — | — | 1.80 | 0.09 | 20 | — | — | — |
| LBY111 | 92797.1 | 0.0398 | 0.09 | 20 | — | — | — | — | — | — |
| CONT. | — | 0.0331 | — | — | 1.50 | — | — | 0.695 | — | — |
| LBY203 | 92842.3 | 0.0355 | 0.02 | 20 | — | — | — | — | — | — |
| LBY191 | 92519.2 | — | — | — | 2.34 | 0.04 | 31 | — | — | — |
| LBY191 | 92523.3 | 0.0331 | 0.06 | 12 | — | — | — | — | — | — |
| LBY167 | 92772.1 | — | — | — | — | — | — | 0.809 | 0.17 | 8 |
| LBY144 | 93059.3 | 0.0322 | 0.12 | 8 | — | — | — | — | — | — |
| LBY144 | 93061.5 | 0.0318 | 0.23 | 7 | — | — | — | — | — | — |
| LBY111 | 92797.1 | 0.0333 | 0.05 | 12 | — | — | — | — | — | — |
| LBY111 | 92798.1 | 0.0316 | 0.26 | 6 | — | — | — | 0.798 | 0.19 | 7 |
| CONT. | — | 0.0297 | — | — | 1.79 | — | — | 0.748 | — | — |
| LBY78 | 92311.4 | — | — | — | 1.81 | 0.07 | 21 | — | — | — |
| LBY78 | 92312.2 | — | — | — | 1.70 | 0.26 | 13 | — | — | — |
| LBY78 | 92313.5 | 0.0365 | 0.15 | 16 | 1.84 | 0.08 | 23 | — | — | — |
| LBY31 | 92344.1 | — | — | — | 1.86 | 0.08 | 24 | — | — | — |
| LBY31 | 92345.4 | — | — | — | 1.89 | 0.05 | 26 | — | — | — |
| LBY31 | 92347.2 | 0.0362 | 0.14 | 15 | — | — | — | — | — | — |
| LBY175 | 92179.1 | — | — | — | 1.93 | 0.02 | 29 | — | — | — |
| LBY175 | 92179.3 | — | — | — | 1.70 | 0.28 | 13 | — | — | — |
| LBY175 | 92181.2 | — | — | — | 1.92 | 0.02 | 28 | — | — | — |
| LBY175 | 92181.4 | — | — | — | 1.83 | 0.08 | 22 | — | — | — |
| LBY149 | 92246.3 | — | — | — | 1.75 | 0.17 | 16 | — | — | — |
| LBY149 | 92247.1 | — | — | — | — | — | — | 0.820 | 0.28 | 14 |
| LBY140 | 92265.2 | — | — | — | 2.08 | L | 39 | — | — | — |
| LBY140 | 92265.5 | — | — | — | 1.97 | 0.01 | 31 | — | — | — |
| LBY140 | 92268.2 | — | — | — | — | — | — | 0.846 | 0.16 | 18 |
| LBY116 | 92136.3 | — | — | — | 1.88 | 0.06 | 25 | — | — | — |
| LBY116 | 92136.4 | — | — | — | 1.78 | 0.11 | 19 | 0.834 | 0.21 | 16 |
| CONT. | — | 0.0315 | — | — | 1.50 | — | — | 0.720 | — | — |
| LBY201 | 93927.1 | 0.0399 | 0.22 | 8 | — | — | — | — | — | — |
| LBY159 | 92152.3 | — | — | — | 2.09 | 0.29 | 11 | 0.917 | 0.06 | 7 |
| LBY159 | 92153.1 | — | — | — | 2.25 | 0.10 | 19 | — | — | — |
| LBY157 | 92803.1 | — | — | — | 2.29 | 0.10 | 21 | 0.910 | 0.07 | 7 |
| LBY148 | 93768.1 | — | — | — | — | — | — | 0.909 | 0.18 | 7 |
| LBY109 | 93950.1 | — | — | — | — | — | — | 0.906 | 0.21 | 6 |
| LBY109 | 93950.6 | — | — | — | — | — | — | 0.937 | 0.02 | 10 |
| CONT. | — | 0.0370 | — | — | 1.89 | — | — | 0.853 | — | — |
| LBY80 | 92269.3 | — | — | — | 1.27 | L | 42 | 0.634 | 0.21 | 9 |
| LBY80 | 92269.4 | 0.0270 | 0.28 | 6 | — | — | — | — | — | — |
| LBY80 | 92270.1 | 0.0296 | 0.05 | 16 | 1.03 | 0.13 | 15 | — | — | — |
| LBY80 | 92272.2 | — | — | — | 1.37 | L | 53 | 0.638 | 0.07 | 10 |
| LBY80 | 92273.1 | — | — | — | 1.05 | 0.08 | 18 | — | — | — |
| LBY185 | 91497.1 | 0.0275 | 0.15 | 8 | 1.56 | L | 74 | 0.655 | 0.07 | 13 |
| LBY185 | 91497.2 | 0.0277 | 0.26 | 9 | 1.22 | L | 36 | 0.622 | 0.14 | 7 |
| LBY185 | 91498.2 | 0.0280 | 0.12 | 10 | 1.57 | L | 76 | 0.687 | 0.01 | 18 |
| LBY185 | 91499.2 | — | — | — | 1.11 | 0.03 | 24 | 0.608 | 0.24 | 5 |
| LBY185 | 91499.3 | — | — | — | 1.02 | 0.30 | 14 | 0.634 | 0.24 | 9 |
| LBY179 | 91545.2 | — | — | — | 1.45 | L | 62 | 0.675 | 0.02 | 16 |
| LBY179 | 91547.2 | — | — | — | 1.67 | L | 87 | 0.708 | 0.03 | 22 |
| LBY179 | 91549.1 | — | — | — | 1.14 | L | 28 | 0.642 | 0.12 | 11 |
| LBY179 | 91549.3 | — | — | — | 1.46 | L | 63 | 0.735 | L | 27 |
| LBY173 | 91651.2 | — | — | — | 1.16 | L | 30 | 0.664 | 0.03 | 14 |
| LBY173 | 91652.1 | — | — | — | 1.82 | L | 103 | 0.767 | L | 32 |
| LBY173 | 91652.2 | — | — | — | 1.51 | L | 69 | 0.663 | 0.04 | 14 |
| LBY173 | 91652.3 | 0.0298 | 0.14 | 17 | 1.15 | L | 28 | 0.668 | L | 15 |
| LBY173 | 91653.1 | — | — | — | 1.35 | L | 51 | 0.685 | 0.02 | 18 |
| LBY153 | 92249.2 | — | — | — | 1.24 | L | 39 | 0.625 | 0.25 | 8 |
| LBY153 | 92253.2 | 0.0281 | 0.21 | 11 | 1.02 | 0.30 | 14 | — | — | — |
| LBY121 | 92290.3 | 0.0293 | 0.04 | 15 | 1.48 | L | 66 | 0.710 | L | 22 |

TABLE 272-continued

Genes showing improved plant performance at Low Nitrogen growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LBY121 | 92290.4 | — | — | — | 1.28 | L | 43 | 0.692 | 0.12 | 19 |
| LBY121 | 92291.2 | 0.0296 | 0.11 | 17 | 1.12 | 0.05 | 25 | 0.659 | 0.13 | 14 |
| LBY121 | 92291.4 | — | — | — | 1.34 | L | 50 | 0.684 | 0.02 | 18 |
| LBY121 | 92293.2 | — | — | — | — | — | — | 0.622 | 0.24 | 7 |
| CONT. | — | 0.0254 | — | — | 0.893 | — | — | 0.580 | — | — |
| LBY71 | 93769.3 | 0.0355 | 0.25 | 16 | — | — | — | — | — | — |
| LBY68 | 93862.1 | — | — | — | — | — | — | 0.806 | 0.21 | 10 |
| LBY68 | 93862.4 | 0.0412 | L | 35 | — | — | — | 0.832 | 0.16 | 14 |
| LBY61 | 94019.4 | — | — | — | 1.81 | 0.22 | 19 | — | — | — |
| LBY61 | 94021.4 | — | — | — | 1.78 | 0.23 | 17 | — | — | — |
| LBY6 | 94111.3 | 0.0362 | 0.16 | 18 | — | — | — | — | — | — |
| LBY52 | 93944.1 | 0.0379 | 0.08 | 24 | — | — | — | — | — | — |
| LBY52 | 93946.2 | 0.0406 | 0.01 | 33 | — | — | — | 0.841 | 0.09 | 15 |
| LBY52 | 93947.2 | 0.0375 | 0.06 | 23 | — | — | — | 0.875 | 0.03 | 20 |
| LBY44 | 92491.2 | 0.0388 | 0.04 | 27 | — | — | — | 0.841 | 0.08 | 15 |
| LBY34_H2 | 93856.1 | 0.0385 | 0.06 | 26 | — | — | — | — | — | — |
| LBY34_H2 | 93857.1 | — | — | — | 1.77 | 0.28 | 16 | 0.805 | 0.18 | 10 |
| LBY34_H2 | 93857.2 | — | — | — | 1.96 | 0.04 | 29 | — | — | — |
| LBY216 | 94080.3 | 0.0420 | L | 37 | 1.79 | 0.21 | 18 | 0.877 | 0.02 | 20 |
| LBY216 | 94082.2 | 0.0345 | 0.29 | 13 | — | — | — | — | — | — |
| LBY20 | 94085.1 | 0.0356 | 0.22 | 16 | 1.99 | 0.05 | 31 | 0.842 | 0.09 | 15 |
| LBY20 | 94087.3 | 0.0393 | 0.02 | 29 | — | — | — | 0.924 | L | 27 |
| LBY181 | 92480.1 | — | — | — | — | — | — | 0.861 | 0.04 | 18 |
| LBY142 | 93199.1 | 0.0367 | 0.14 | 20 | 1.81 | 0.18 | 19 | — | — | — |
| LBY142 | 93203.4 | — | — | — | 2.06 | 0.02 | 35 | 0.796 | 0.27 | 9 |
| CONT. | — | 0.0306 | — | — | 1.52 | — | — | 0.730 | — | — |
| LBY41 | 91621.1 | 0.0379 | 0.04 | 15 | 1.90 | 0.06 | 21 | — | — | — |
| LBY41 | 91621.2 | — | — | — | 1.79 | 0.26 | 13 | 0.875 | 0.14 | 8 |
| LBY41 | 91623.1 | — | — | — | 1.81 | 0.17 | 15 | — | — | — |
| LBY41 | 91623.2 | — | — | — | 1.95 | 0.06 | 24 | 0.919 | L | 14 |
| LBY173 | 91652.1 | — | — | — | 2.28 | L | 45 | 0.920 | 0.01 | 14 |
| LBY173 | 91652.5 | — | — | — | 2.34 | L | 49 | 0.930 | 0.02 | 15 |
| LBY173 | 91653.1 | — | — | — | — | — | — | 0.871 | 0.21 | 8 |
| LBY166 | 91542.5 | — | — | — | 1.89 | 0.10 | 20 | 0.912 | 0.02 | 13 |
| LBY166 | 91544.3 | — | — | — | — | — | — | 0.862 | 0.26 | 6 |
| LBY166 | 91544.4 | — | — | — | — | — | — | 0.876 | 0.12 | 8 |
| LBY166 | 91544.5 | — | — | — | 1.98 | 0.04 | 26 | 0.967 | L | 19 |
| CONT. | — | 0.0329 | — | — | 1.57 | — | — | 0.810 | — | — |
| LBY85 | 92064.1 | 0.0389 | 0.05 | 19 | — | — | — | — | — | — |
| LBY85 | 92066.2 | 0.0374 | 0.14 | 14 | — | — | — | — | — | — |
| LBY85 | 92066.3 | 0.0362 | 0.23 | 11 | 2.28 | L | 22 | — | — | — |
| LBY85 | 92066.5 | 0.0404 | L | 24 | — | — | — | — | — | — |
| LBY85 | 92068.3 | — | — | — | 2.03 | 0.25 | 8 | — | — | — |
| LBY64 | 91340.4 | 0.0392 | 0.03 | 20 | — | — | — | — | — | — |
| LBY64 | 91342.2 | 0.0395 | 0.02 | 21 | — | — | — | — | — | — |
| LBY64 | 91342.3 | 0.0366 | 0.17 | 12 | — | — | — | — | — | — |
| LBY64 | 91342.6 | 0.0372 | 0.11 | 14 | — | — | — | — | — | — |
| LBY46 | 92200.3 | — | — | — | 2.07 | 0.17 | 11 | — | — | — |
| LBY46 | 92201.2 | 0.0378 | 0.09 | 16 | — | — | — | — | — | — |
| LBY46 | 92201.4 | 0.0382 | 0.07 | 17 | 2.19 | 0.06 | 17 | — | — | — |
| LBY46 | 92202.1 | — | — | — | — | — | — | 0.850 | 0.23 | 7 |
| LBY207 | 92155.1 | 0.0386 | 0.06 | 18 | 2.05 | 0.22 | 9 | — | — | — |
| LBY207 | 92157.3 | — | — | — | 2.14 | 0.08 | 14 | — | — | — |
| LBY207 | 92158.2 | 0.0413 | 0.03 | 26 | 2.07 | 0.19 | 10 | — | — | — |
| LBY185 | 91497.1 | — | — | — | 2.07 | 0.22 | 11 | — | — | — |
| LBY185 | 91497.2 | — | — | — | 2.28 | L | 22 | — | — | — |
| LBY185 | 91498.2 | 0.0390 | 0.04 | 20 | — | — | — | 0.854 | 0.20 | 8 |
| LBY185 | 91499.2 | 0.0368 | 0.27 | 13 | 2.06 | 0.27 | 10 | — | — | — |
| LBY17 | 92216.2 | 0.0397 | 0.05 | 22 | — | — | — | — | — | — |
| LBY155 | 92015.1 | 0.0406 | 0.02 | 24 | — | — | — | — | — | — |
| LBY155 | 92016.4 | 0.0397 | 0.03 | 21 | — | — | — | — | — | — |
| LBY155 | 92016.5 | 0.0377 | 0.14 | 16 | — | — | — | — | — | — |
| LBY155 | 92016.7 | 0.0383 | 0.05 | 17 | 2.05 | 0.24 | 9 | — | — | — |
| LBY122 | 91370.2 | 0.0396 | 0.02 | 21 | 2.01 | 0.27 | 7 | — | — | — |
| LBY122 | 91371.2 | 0.0368 | 0.22 | 13 | — | — | — | — | — | — |
| LBY122 | 91371.6 | 0.0382 | 0.14 | 17 | 2.13 | 0.07 | 14 | — | — | — |
| LBY122 | 91374.1 | 0.0402 | 0.01 | 23 | 2.16 | 0.04 | 15 | — | — | — |
| CONT. | — | 0.0327 | — | — | 1.87 | — | — | 0.792 | — | — |
| LBY50 | 91318.2 | 0.0400 | 0.09 | 18 | — | — | — | — | — | — |
| LBY24 | 91220.6 | — | — | — | 2.11 | 0.04 | 16 | 0.795 | 0.25 | 12 |
| LBY24 | 91221.1 | 0.0377 | 0.25 | 11 | — | — | — | — | — | — |
| LBY24 | 91221.2 | 0.0404 | 0.12 | 19 | 2.30 | L | 27 | — | — | — |

TABLE 272-continued

Genes showing improved plant performance at Low Nitrogen growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LBY24 | 91223.3 | 0.0404 | 0.06 | 19 | — | — | — | — | — | — |
| LBY21 | 90977.1 | 0.0374 | 0.25 | 10 | — | — | — | — | — | — |
| LBY21 | 90978.4 | 0.0384 | 0.18 | 13 | — | — | — | — | — | — |
| LBY21 | 90980.1 | — | — | — | 2.00 | 0.21 | 10 | — | — | — |
| LBY161 | 91292.1 | 0.0412 | 0.02 | 22 | 2.01 | 0.24 | 11 | — | — | — |
| LBY161 | 91292.3 | — | — | — | 1.97 | 0.27 | 9 | 0.791 | 0.23 | 11 |
| LBY161 | 91293.3 | — | — | — | 2.22 | 0.02 | 22 | — | — | — |
| LBY152 | 91286.1 | 0.0397 | 0.06 | 17 | — | — | — | — | — | — |
| LBY152 | 91287.1 | 0.0404 | 0.04 | 19 | — | — | — | — | — | — |
| LBY152 | 91289.2 | 0.0378 | 0.24 | 12 | — | — | — | — | — | — |
| LBY15 | 91143.4 | — | — | — | — | — | — | 0.790 | 0.22 | 11 |
| LBY15 | 91144.2 | 0.0378 | 0.27 | 12 | 2.16 | 0.03 | 19 | — | — | — |
| LBY15 | 91144.3 | — | — | — | 2.04 | 0.13 | 12 | — | — | — |
| LBY123 | 91428.2 | — | — | — | 2.15 | 0.03 | 18 | 0.782 | 0.29 | 10 |
| LBY123 | 91429.2 | — | — | — | 2.15 | 0.04 | 19 | — | — | — |
| LBY123 | 91429.3 | — | — | — | 2.13 | 0.07 | 17 | — | — | — |
| LBY123 | 91429.6 | — | — | — | 2.24 | 0.02 | 23 | — | — | — |
| LBY114 | 91391.1 | — | — | — | — | — | — | 0.783 | 0.22 | 10 |
| LBY114 | 91391.2 | 0.0389 | 0.14 | 15 | — | — | — | — | — | — |
| LBY114 | 91393.1 | — | — | — | 2.23 | 0.03 | 23 | 0.845 | 0.03 | 19 |
| LBY114 | 91393.2 | — | — | — | 2.02 | 0.24 | 11 | 0.827 | 0.10 | 16 |
| CONT. | — | 0.0338 | — | — | 1.82 | — | — | 0.711 | — | — |
| LBY80 | 92269.2 | — | — | — | 1.51 | 0.28 | 9 | — | — | — |
| LBY80 | 92269.4 | — | — | — | 1.72 | 0.07 | 24 | — | — | — |
| LBY80 | 92270.1 | 0.0356 | 0.26 | 9 | 1.74 | L | 25 | — | — | — |
| LBY78 | 92311.3 | 0.0380 | 0.08 | 16 | 1.53 | 0.30 | 11 | 0.785 | 0.23 | 8 |
| LBY78 | 92313.5 | — | — | — | 1.77 | L | 28 | — | — | — |
| LBY53 | 92414.1 | — | — | — | 1.61 | 0.07 | 16 | — | — | — |
| LBY53 | 92418.1 | 0.0366 | 0.12 | 12 | 1.52 | 0.25 | 10 | — | — | — |
| LBY153 | 92249.2 | — | — | — | 1.59 | 0.06 | 15 | — | — | — |
| LBY153 | 92252.2 | — | — | — | 1.63 | 0.09 | 18 | 0.799 | 0.23 | 10 |
| LBY149 | 92246.3 | — | — | — | 1.94 | L | 40 | 0.847 | 0.02 | 16 |
| LBY121 | 92291.2 | — | — | — | 1.64 | 0.05 | 18 | — | — | — |
| LBY121 | 92291.4 | — | — | — | 1.65 | 0.19 | 19 | — | — | — |
| LBY121 | 92293.2 | — | — | — | — | — | — | 0.781 | 0.22 | 7 |
| CONT. | — | 0.0327 | — | — | 1.39 | — | — | 0.728 | — | — |
| LBY76 | 92642.1 | — | — | — | 1.99 | 0.29 | 15 | — | — | — |
| LBY70 | 92684.2 | — | — | — | 2.08 | 0.17 | 19 | — | — | — |
| LBY70 | 92685.5 | 0.0375 | 0.18 | 15 | 2.13 | 0.13 | 23 | — | — | — |
| LBY159 | 92150.4 | — | — | — | — | — | — | 0.862 | 0.12 | 13 |
| LBY159 | 92152.1 | — | — | — | 1.98 | 0.28 | 14 | — | — | — |
| LBY159 | 92153.1 | — | — | — | 2.06 | 0.21 | 19 | — | — | — |
| LBY156 | 92294.1 | — | — | — | — | — | — | 0.838 | 0.24 | 10 |
| LBY145 | 92605.1 | 0.0365 | 0.28 | 12 | — | — | — | — | — | — |
| LBY145 | 92606.2 | 0.0364 | 0.23 | 12 | 2.05 | 0.18 | 18 | — | — | — |
| CONT. | — | 0.0325 | — | — | 1.74 | — | — | 0.762 | — | — |
| LBY92 | 93921.2 | — | — | — | 4.54 | L | 142 | 0.973 | 0.01 | 21 |
| LBY92 | 93923.3 | — | — | — | 4.35 | L | 132 | 0.877 | 0.24 | 9 |
| LBY6 | 94110.2 | — | — | — | 2.21 | 0.18 | 18 | — | — | — |
| LBY20 | 94084.1 | — | — | — | 2.30 | 0.13 | 23 | 0.880 | 0.23 | 10 |
| LBY20 | 94085.1 | — | — | — | 2.15 | 0.28 | 15 | 0.904 | 0.10 | 13 |
| LBY148 | 93765.1 | — | — | — | 2.10 | 0.26 | 12 | — | — | — |
| LBY148 | 93768.1 | 0.0391 | 0.30 | 13 | — | — | — | — | — | — |
| LBY106_H3 | 93916.1 | — | — | — | 2.10 | 0.30 | 12 | — | — | — |
| LBY106_H3 | 93918.1 | — | — | — | 2.21 | 0.17 | 18 | 0.905 | 0.11 | 13 |
| CONT. | — | 0.0347 | — | — | 1.87 | — | — | 0.803 | — | — |
| LBY50 | 91317.3 | 0.0387 | 0.21 | 10 | 1.92 | 0.10 | 19 | 0.803 | 0.27 | 9 |
| LBY50 | 91318.4 | 0.0376 | 0.29 | 7 | — | — | — | — | — | — |
| LBY24 | 91221.2 | — | — | — | 2.04 | 0.04 | 26 | — | — | — |
| LBY21 | 90979.2 | — | — | — | — | — | — | 0.804 | 0.25 | 9 |
| LBY21 | 90980.1 | — | — | — | 1.92 | 0.18 | 19 | — | — | — |
| LBY161 | 91294.1 | 0.0379 | 0.26 | 7 | — | — | — | 0.804 | 0.24 | 9 |
| LBY15 | 91144.1 | — | — | — | 1.81 | 0.30 | 12 | — | — | — |
| LBY15 | 91144.2 | — | — | — | — | — | — | 0.830 | 0.10 | 12 |
| CONT. | — | 0.0353 | — | — | 1.61 | — | — | 0.738 | — | — |
| LBY53 | 92416.1 | — | — | — | 2.00 | 0.12 | 18 | 0.841 | 0.06 | 10 |
| LBY53 | 92418.1 | — | — | — | 1.97 | 0.13 | 17 | — | — | — |
| LBY31 | 92344.1 | — | — | — | 1.92 | 0.20 | 14 | — | — | — |
| LBY31 | 92344.2 | — | — | — | 2.11 | 0.03 | 24 | — | — | — |
| LBY31 | 92347.1 | — | — | — | 1.88 | 0.28 | 11 | — | — | — |
| LBY208 | 92358.1 | 0.0397 | 0.15 | 13 | — | — | — | — | — | — |
| LBY207 | 92154.1 | — | — | — | 2.03 | 0.13 | 20 | 0.844 | 0.14 | 10 |

TABLE 272-continued

Genes showing improved plant performance at Low Nitrogen growth conditions under regulation of At6669 promoter

| | | RGR Of Leaf Area | | | RGR Of Roots Coverage | | | RGR Of Root Length | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LBY207 | 92155.1 | — | — | — | 1.91 | 0.15 | 13 | — | — | — |
| LBY207 | 92157.3 | — | — | — | 2.28 | L | 35 | — | — | — |
| LBY207 | 92158.2 | 0.0382 | 0.29 | 9 | — | — | — | — | — | — |
| LBY175 | 92179.1 | — | — | — | 2.07 | 0.07 | 22 | 0.819 | 0.17 | 7 |
| LBY175 | 92181.3 | — | — | — | 2.13 | 0.03 | 26 | — | — | — |
| LBY175 | 92181.4 | — | — | — | 2.00 | 0.09 | 18 | 0.835 | 0.09 | 9 |
| LBY140 | 92265.2 | 0.0381 | 0.28 | 9 | 1.96 | 0.10 | 16 | — | — | — |
| LBY140 | 92265.5 | — | — | — | 1.93 | 0.19 | 14 | — | — | — |
| LBY140 | 92266.3 | — | — | — | 2.03 | 0.06 | 20 | — | — | — |
| LBY116 | 92136.1 | — | — | — | 2.00 | 0.09 | 18 | 0.809 | 0.28 | 6 |
| LBY116 | 92136.3 | — | — | — | 2.13 | 0.03 | 26 | 0.853 | 0.05 | 11 |
| LBY116 | 92136.4 | — | — | — | 2.23 | 0.03 | 32 | 0.920 | L | 20 |
| LBY116 | 92138.6 | — | — | — | 1.91 | 0.25 | 13 | — | — | — |
| CONT. | — | 0.0351 | — | — | 1.69 | — | — | 0.766 | — | — |
| LBY181 | 92479.3 | — | — | — | 1.86 | L | 35 | 0.797 | 0.02 | 12 |
| LBY167 | 92770.4 | — | — | — | 1.73 | 0.06 | 26 | — | — | — |
| LBY167 | 92772.2 | — | — | — | 1.56 | 0.28 | 13 | — | — | — |
| LBY167 | 92773.1 | — | — | — | 1.68 | 0.08 | 22 | 0.766 | 0.10 | 8 |
| LBY167 | 92773.4 | — | — | — | 1.55 | 0.28 | 12 | — | — | — |
| LBY157 | 92802.2 | — | — | — | 1.74 | 0.02 | 26 | 0.750 | 0.21 | 6 |
| LBY157 | 92802.3 | — | — | — | 2.14 | L | 55 | — | — | — |
| LBY157 | 92803.1 | — | — | — | 1.75 | 0.02 | 27 | 0.759 | 0.11 | 7 |
| LBY157 | 92803.2 | — | — | — | 1.82 | 0.02 | 32 | 0.754 | 0.27 | 6 |
| CONT. | — | — | — | — | 1.38 | — | — | 0.709 | — | — |
| LBY41 | 91620.4 | — | — | — | 2.29 | 0.05 | 18 | — | — | — |
| LBY41 | 91621.2 | — | — | — | 2.32 | 0.05 | 19 | 0.854 | 0.07 | 15 |
| LBY186 | 91655.4 | — | — | — | 2.26 | 0.07 | 16 | 0.811 | 0.25 | 10 |
| LBY186 | 91657.1 | — | — | — | 2.32 | 0.04 | 19 | 0.846 | 0.12 | 14 |
| LBY186 | 91659.1 | — | — | — | 2.27 | 0.07 | 17 | 0.816 | 0.27 | 10 |
| LBY186 | 91659.3 | — | — | — | 2.41 | 0.01 | 24 | 0.830 | 0.20 | 12 |
| LBY186 | 91659.4 | — | — | — | — | — | — | 0.878 | 0.03 | 19 |
| LBY166 | 91542.4 | — | — | — | — | — | — | 0.876 | 0.03 | 18 |
| LBY166 | 91542.5 | — | — | — | — | — | — | 0.853 | 0.07 | 15 |
| LBY166 | 91544.3 | — | — | — | — | — | — | 0.886 | 0.02 | 20 |
| LBY166 | 91544.4 | — | — | — | — | — | — | 0.879 | 0.03 | 19 |
| LBY166 | 91544.5 | — | — | — | — | — | — | 0.953 | L | 29 |
| CONT. | — | — | — | — | 1.94 | — | — | 0.740 | — | — |
| LBY85 | 92066.2 | 0.0347 | 0.10 | 10 | — | — | — | 0.805 | 0.25 | 8 |
| LBY85 | 92066.3 | — | — | — | 1.93 | 0.23 | 15 | 0.824 | 0.15 | 10 |
| LBY85 | 92066.5 | — | — | — | 2.03 | 0.07 | 21 | — | — | — |
| LBY64 | 91340.4 | — | — | — | — | — | — | 0.811 | 0.22 | 8 |
| LBY64 | 91342.3 | 0.0342 | 0.17 | 9 | — | — | — | — | — | — |
| LBY46 | 92200.3 | — | — | — | 1.91 | 0.26 | 14 | — | — | — |
| LBY46 | 92201.2 | — | — | — | 2.17 | 0.01 | 30 | 0.821 | 0.14 | 10 |
| LBY46 | 92201.4 | — | — | — | 2.20 | 0.01 | 31 | 0.836 | 0.11 | 12 |
| LBY17 | 92215.4 | — | — | — | — | — | — | 0.820 | 0.14 | 10 |
| LBY17 | 92216.3 | — | — | — | 1.95 | 0.16 | 16 | — | — | — |
| LBY17 | 92216.4 | — | — | — | 1.91 | 0.25 | 14 | 0.805 | 0.28 | 8 |
| LBY155 | 92014.2 | — | — | — | — | — | — | 0.808 | 0.22 | 8 |
| LBY155 | 92015.1 | 0.0355 | 0.07 | 13 | — | — | — | 0.804 | 0.27 | 7 |
| LBY122 | 91371.2 | 0.0343 | 0.19 | 9 | 1.87 | 0.27 | 12 | — | — | — |
| LBY122 | 91371.3 | — | — | — | 1.90 | 0.22 | 13 | 0.832 | 0.09 | 11 |
| LBY122 | 91374.1 | 0.0346 | 0.15 | 10 | — | — | — | — | — | — |
| LBY122 | 91371.6 | — | — | — | 1.96 | 0.16 | 17 | — | — | — |
| LBY122 | 91374.1 | — | — | — | 1.90 | 0.24 | 13 | 0.839 | 0.07 | 12 |
| CONT. | — | 0.0315 | — | — | 1.68 | — | — | 0.748 | — | — |

Table 272. "CONT."-Control; "Ave"-Average; "% Incr." = % increment; "p-val."-p-value, L-p < 0.01.

Results from $T_1$ Plants

Tables 273-275 summarize the observed phenotypes of transgenic plants expressing the gene constructs using the TC-T1 Assays (seedling analysis of T1 plants).

The genes presented in Tables 273-275 showed a significant improvement in plant biomass and root development since they produced a higher biomass (dry weight, Table 273), a larger leaf and root biomass (leaf area, root length and root coverage) (Table 274), and a higher relative growth rate of leaf area, and root coverage (Table 275) when grown under normal growth conditions, compared to control plants grown under identical growth conditions. Plants producing larger root biomass have better possibilities to absorb larger amount of nitrogen from soil. Plants producing larger leaf biomass have better ability to produce assimilates. The genes were cloned under the regulation of a constitutive promoter (At6669; SEQ ID NO: 10654). The evaluation of each gene was performed by testing the performance of different number of events. Some of the genes were evaluated in more than one seedling assay. This second experiment confirmed the significant increment in leaf and root performance. Event with p-value <0.1 was considered statistically significant.

TABLE 273

Genes showing improved plant performance at Normal growth conditions under regulation of At6669 promoter

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LBY92 | 12.1 | 0.02 | 61 | 238.5 | 0.03 | 39 |
| LBY20 | 9.92 | L | 31 | — | — | — |
| CONT. | 7.56 | — | — | 171.3 | — | — |
| LBY86 | — | — | — | 138.1 | 0.14 | 17 |
| LBY170 | 9.18 | 0.17 | 11 | 131.9 | 0.24 | 12 |
| CONT. | 8.26 | — | — | 117.7 | — | — |
| LBY92 | 12.2 | 0.15 | 26 | 231.9 | 0.10 | 37 |
| LBY92 | 12.6 | 0.04 | 31 | 212.5 | 0.10 | 25 |
| LBY92 | 14.3 | L | 48 | 262.3 | L | 55 |
| CONT. | 9.66 | — | — | 169.8 | — | — |

Table 273. "CONT." = Control; "Ave." = Average; "% Incr." = % increment; "p-val." = p-value, L = p < 0.01.

TABLE 274

Genes showing improved plant performance at Normal growth conditions under regulation of At6669 promoter

| Gene Name | Leaf Area [cm2] | | | Roots Coverage [cm2] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LBY4 | — | — | — | 11.3 | 0.21 | 15 | — | — | — |
| CONT. | — | — | — | 9.88 | — | — | — | — | — |
| LBY92 | 1.10 | 0.02 | 48 | 17.4 | 0.01 | 143 | 7.47 | 0.10 | 9 |
| LBY6 | — | — | — | 8.76 | 0.11 | 22 | — | — | — |
| LBY216 | 0.868 | 0.24 | 16 | 10.1 | 0.05 | 41 | 7.84 | 0.02 | 15 |
| LBY20 | 0.870 | L | 16 | 9.37 | 0.04 | 31 | — | — | — |
| LBY106_H3 | — | — | — | 9.55 | 0.02 | 33 | 7.76 | L | 13 |
| CONT. | 0.748 | — | — | 7.17 | — | — | 6.84 | — | — |
| LBY3 | — | — | — | 10.6 | 0.20 | 11 | — | — | — |
| CONT. | — | — | — | 9.49 | — | — | — | — | — |
| LBY92 | 0.973 | 0.09 | 19 | 19.6 | 0.02 | 87 | 8.09 | 0.22 | 6 |
| LBY92 | 1.05 | L | 28 | 16.1 | L | 53 | — | — | — |
| LBY92 | 1.16 | L | 42 | 20.2 | L | 92 | 8.37 | 0.05 | 10 |
| CONT. | 0.818 | — | — | 10.5 | — | — | 7.61 | — | — |
| LGN62_H2 | 0.847 | L | 48 | 11.6 | L | 53 | 7.76 | 0.26 | 6 |
| CONT. | 0.574 | — | — | 7.57 | — | — | 7.34 | — | — |

Table 274. "CONT." = Control; "Ave." = Average; "% Incr." = % increment; "p-val." = p-value, L = p < 0.01.

TABLE 275

Genes showing improved plant performance at Normal growth conditions under regulation of At6669 promoter

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LBY4 | 0.103 | 0.27 | 11 | 1.39 | 0.19 | 16 | — | — | — |
| CONT. | 0.0928 | — | — | 1.19 | — | — | — | — | — |
| LBY92 | 0.116 | L | 62 | 2.14 | L | 148 | 0.795 | 0.07 | 12 |
| LBY6 | — | — | — | 1.07 | 0.07 | 24 | — | — | — |
| LBY216 | 0.0890 | 0.05 | 24 | 1.21 | L | 41 | 0.826 | 0.02 | 17 |
| LBY20 | 0.0888 | L | 23 | 1.14 | 0.02 | 32 | 0.760 | 0.25 | 8 |

TABLE 275-continued

Genes showing improved plant performance at Normal growth conditions under regulation of At6669 promoter

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LBY106_H3 | — | — | — | 1.15 | 0.01 | 33 | 0.801 | 0.04 | 13 |
| CONT. | 0.0720 | — | — | 0.863 | — | — | 0.707 | — | — |
| LBY3 | — | — | — | 1.27 | 0.24 | 13 | — | — | — |
| CONT. | — | — | — | 1.13 | — | — | — | — | — |
| LBY92 | 0.0980 | 0.21 | 15 | 2.41 | L | 88 | 0.849 | 0.25 | 12 |
| LBY92 | 0.106 | 0.04 | 24 | 1.97 | L | 54 | — | — | — |
| LBY92 | 0.121 | L | 41 | 2.48 | L | 94 | 0.879 | 0.11 | 16 |
| CONT. | 0.0855 | — | — | 1.28 | — | — | 0.755 | — | — |
| LGN62_H2 | 0.0847 | L | 48 | 1.41 | L | 55 | 0.798 | 0.06 | 12 |
| CONT. | 0.0573 | — | — | 0.909 | — | — | 0.711 | — | — |

Table 275. "CONT."-Control; "Ave."-Average; "% Incr." = % increment; "p-val." = p-value, L = p < 0.01.

Example 32

Evaluation of Transgenic *Brachypodium* NUE and Yield Under Low or Normal Nitrogen Fertilization in Greenhouse Assay Assay 1: Nitrogen Use efficiency measured plant biomass and yield at limited and optimal nitrogen concentration under greenhouse conditions until heading—This assay follows the plant biomass formation and growth (measured by height) of plants which are grown in the greenhouse at limiting and non-limiting (e.g., normal) nitrogen growth conditions. Transgenic *Brachypodium* seeds are sown in peat plugs. The $T_1$ transgenic seedlings are then transplanted to 27.8×11.8×8.5 cm trays filled with peat and perlite in a 1:1 ratio. The trays are irrigated with a solution containing nitrogen limiting conditions, which are achieved by irrigating the plants with a solution containing 3 mM inorganic nitrogen in the form of $NH_4NO_3$, supplemented with 1 mM $KH_2PO_4$, 1 mM $MgSO_4$, 3.6 mM KCl, 2 mM $CaCl_2$ and microelements, while normal nitrogen levels are achieved by applying a solution of 6 mM inorganic nitrogen also in the form of $NH_4NO_3$ with 1 mM $KH_2PO_4$, 1 mM $MgSO_4$, 2 mM $CaCl_2$, 3.6 mM KCl and microelements. All plants are grown in the greenhouse until heading. Plant biomass (the above ground tissue) is weighted right after harvesting the shoots (plant fresh weight [FW]). Following, plants are dried in an oven at 70° C. for 48 hours and weighed (plant dry weight [DW]).

Figure 9B:
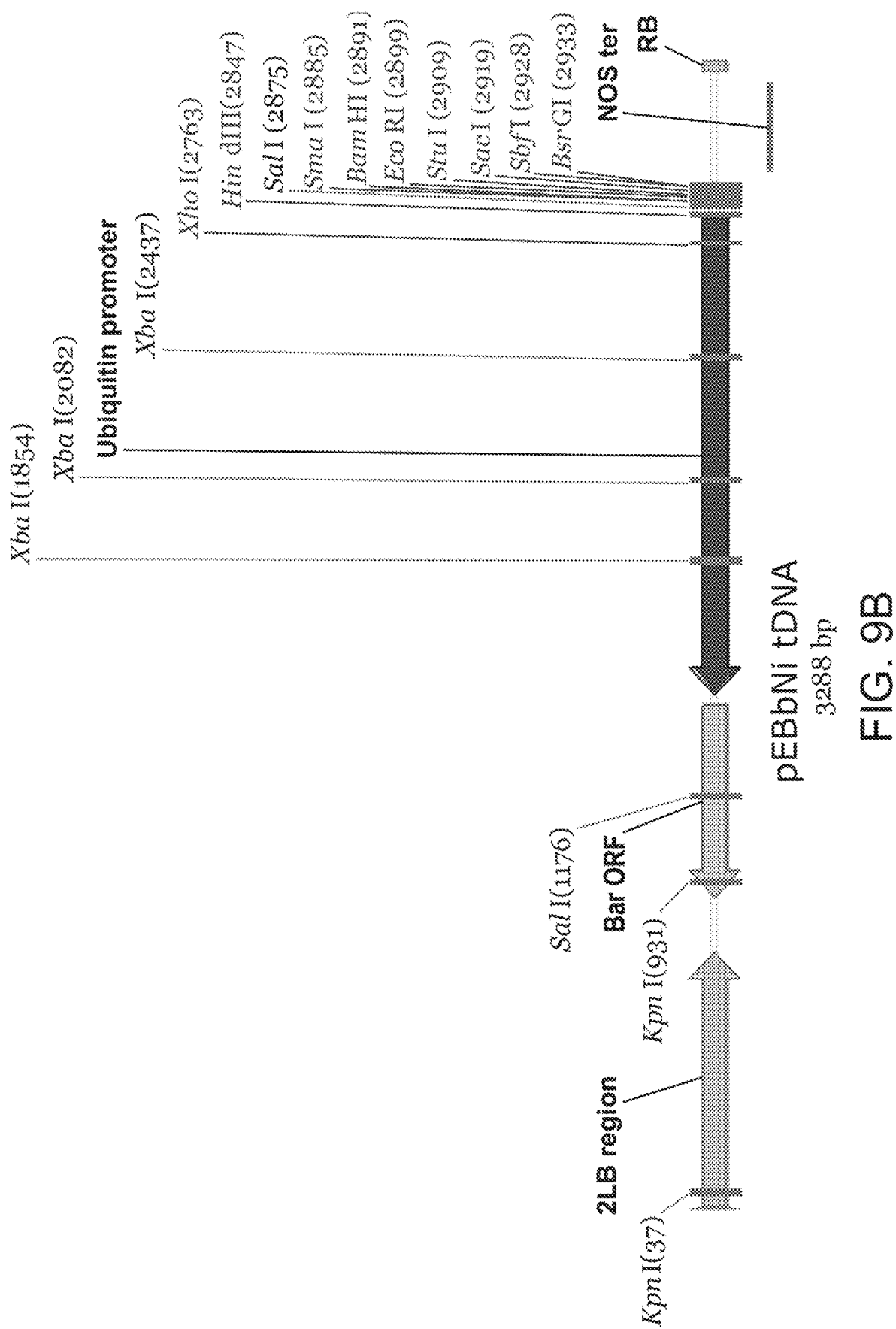

Each construct is validated at its $T_1$ generation. Transgenic plants transformed with a construct conformed by an empty vector carrying the BASTA selectable marker are used as control (FIG. 9B) or with a construct conformed by an empty vector carrying the BASTA and Hygromycin selectable marker (FIG. 13, pQ6sN)).

The plants are analyzed for their overall size, fresh weight and dry matter. Transgenic plants performance is compared to control plants grown in parallel under the same conditions. Mock-transgenic plants with no gene and no promoter at all, are used as control (e.g., FIGS. 9B and 13).

The experiment is planned in blocks and nested randomized plot distribution within them. For each gene of the invention five independent transformation events are analyzed from each construct.

Phenotyping

Plant Fresh and Dry shoot weight—In Heading assays when heading stage has completed (about day 30 from sowing), the plants are harvested and directly weighed for the determination of the plant fresh weight on semi-analytical scales (0.01 gr) (FW) and left to dry at 70° C. in a drying chamber for about 48 hours before weighting to determine plant dry weight (DW).

Time to Heading—In both Seed Maturation and Heading assays heading is defined as the full appearance of the first spikelet in the plant. The time to heading occurrence is defined by the date the heading is completely visible. The time to heading occurrence date is documented for all plants and then the time from planting to heading was calculated. It should be noted that a negative increment (in percentages) when found in time to heading indicates potential for drought avoidance.

Leaf thickness—In Heading assays when minimum 5 plants per plot in at least 90% of the plots in an experiment have been documented at heading, measurement of leaf thickness is performed using a micro-meter on the second leaf below the flag leaf.

Plant Height—In both Seed Maturation and Heading assays once heading is completely visible, the height of the first spikelet is measured from soil level to the bottom of the spikelet.

Tillers number—In Heading assays manual count of tillers is preformed per plant after harvest, before weighing.

These results demonstrate that the polynucleotides of the invention are capable of improving yield and additional valuable important agricultural traits such as increase of biomass, abiotic stress tolerance, nitrogen use efficiency, yield, vigor, fiber yield and/or quality. Thus, transformed plants showing improved fresh and dry weight demonstrate the gene capacity to improve biomass, a key trait of crops for forage and plant productivity; transformed plants showing improvement of seed yield demonstrate the genes capacity to improve plant productivity; transformed plants showing improvement of plot coverage and rosette diameter demonstrate the genes capacity to improve plant drought resistance as they reduce the loss of soil water by simple evaporation and reduce the competition with weeds; hence reduce the need to use herbicides to control weeds. Transformed plants showing improvement of relative growth rate of various organs (leaf and root) demonstrate the gene capacity to promote plant growth and hence shortening the needed growth period and/or alternatively improving the utilization of available nutrients and water leading to increase of land productivity; Transformed plants showing improvement of organ number, as demonstrated by the leaf number parameter, exhibit a potential to improve biomass and yield important for forage and plant productivity; Transformed plants showing increased root length and coverage demonstrate the gene capacity to improve drought resistance and better utilization of fertilizers as the roots can reach larger soil volume; Transformed plants showing improvement of leaf petiole relative area and leaf blade area demonstrate the genes capacity to cope with limited light intensities results from increasing the plant population densities and hence improve land productivity.

Example 33

Figure 13:
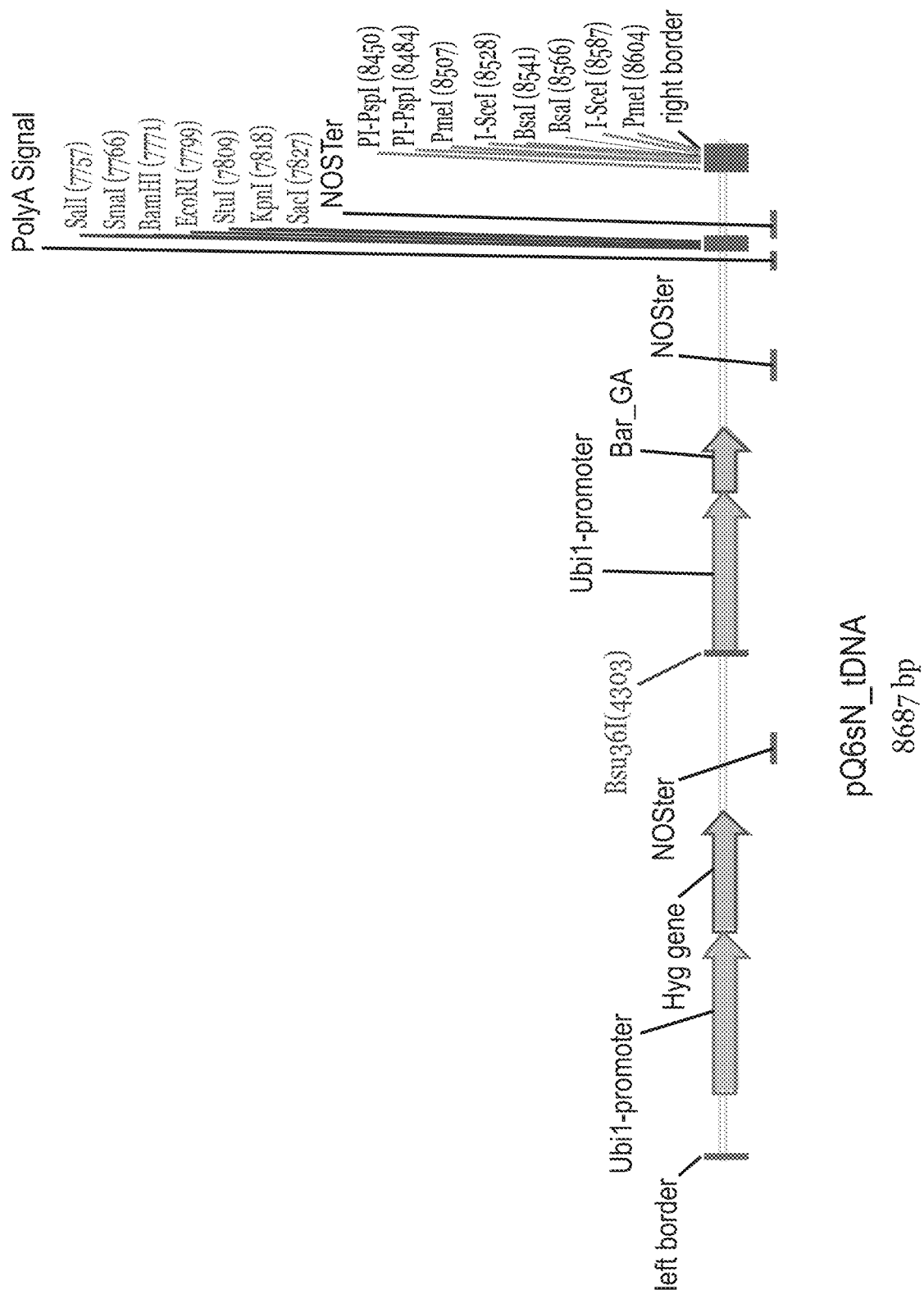
FIG. 13 is schematic illustration pQ6sN plasmid, which is used as a negative control ("empty vector") of the experiments performed when the plants were transformed with the pQ6sVN vector. "Ubi1" promoter (SEQ ID NO: 10640); NOS ter=nopaline synthase terminator; "Bar_GA"=BAR open reading frame optimized for expression in *Brachypodium* (SEQ ID NO:11335).

Evaluation of Transgenic *Brachypodium* Nue and Yield Under Low or Normal Nitrogen Fertilization in Greenhouse Assay Assay 2: Nitrogen Use efficiency measured plant biomass and yield at limited and optimal nitrogen concentration under greenhouse conditions until Seed Maturation—This assay follows the plant biomass and yield production of plants that were grown in the greenhouse at limiting and non-limiting nitrogen growth conditions. Transgenic *Brachypodium* seeds are sown in peat plugs. The $T_1$ transgenic seedlings are then transplanted to 27.8×11.8×8.5 cm trays filled with peat and perlite in a 1:1 ratio. The trays are irrigated with a solution containing nitrogen limiting conditions, which are achieved by irrigating the plants with a solution containing 3 mM inorganic nitrogen in the form of $NH_4NO_3$, supplemented with 1 mM $KH_2PO_4$, 1 mM $MgSO_4$, 3.6 mM KCl, 2 mM $CaCl_2$ and microelements, while normal nitrogen levels are achieved by applying a solution of 6 mM inorganic nitrogen also in the form of $NH_4NO_3$ with 1 mM $KH_2PO_4$, 1 mM $MgSO_4$, 2 mM $CaCl_2$, 3.6 mM KCl and microelements. All plants are grown in the greenhouse until seed maturation. Each construct is validated at its $T_1$ generation. Transgenic plants transformed with a construct conformed by an empty vector carrying the BASTA selectable marker are used as control (FIG. 9B) or with a construct conformed by an empty vector carrying the BASTA and Hygromycin selectable marker (FIG. 13).

The plants are analyzed for their overall biomass, fresh weight and dry matter, as well as a large number of yield and yield components related parameters. Transgenic plants performance is compared to control plants grown in parallel under the same conditions. Mock-transgenic plants are with no gene and no promoter at all. The experiment is planned in blocks and nested randomized plot distribution within them. For each gene of the invention five independent transformation events are analyzed from each construct.

Phenotyping

Plant Fresh and Dry vegetative weight—In Seed Maturation assays when maturity stage has completed (about day 80 from sowing), the plants are harvested and directly weighed for the determination of the plant fresh weight (FW) and left to dry at 70° C. in a drying chamber for about 48 hours before weighting to determine plant dry weight (DW).

Spikelets Dry weight (SDW)—In Seed Maturation assays when maturity stage has completed (about day 80 from sowing), the spikelets are separated from the biomass, left to dry at 70° C. in a drying chamber for about 48 hours before weighting to determine spikelets dry weight (SDW).

Grain Yield per Plant—In Seed Maturation assays after drying of spikelets for SDW, spikelets are run through production machine, then through cleaning machine, until seeds are produced per plot, then weighed and Grain Yield per Plant is calculated.

Grain Number—In Seed Maturation assays after seeds per plot are produced and cleaned, the seeds are run through a counting machine and counted.

1000 Seed Weight—In Seed Maturation assays after seed production, a fraction is taken from each sample (seeds per plot; ~0.5 gr), counted and photographed. 1000 seed weight is calculated.

Harvest Index—In Seed Maturation assays after seed production, harvest index is calculated by dividing grain yield and vegetative dry weight.

Time to Heading—In both Seed Maturation and Heading assays heading is defined as the full appearance of the first spikelet in the plant. The time to heading occurrence is defined by the date the heading is completely visible. The time to heading occurrence date is documented for all plants and then the time from planting to heading was calculated.

Leaf thickness—In Heading assays when minimum 5 plants per plot in at least 90% of the plots in an experiment have been documented at heading, measurement of leaf thickness is performed using a micro-meter on the second leaf below the flag leaf.

Grain filling period—In Seed Maturation assays maturation is defined by the first color-break of spikelet+stem on the plant, from green to yellow/brown.

Plant Height—In both Seed Maturation and Heading assays once heading is completely visible, the height of the first spikelet is measured from soil level to the bottom of the spikelet.

Tillers number—In Heading assays manual count of tillers is preformed per plant after harvest, before weighing.

Number of reproductive heads per plant—In Heading assays manual count of heads per plant is performed.

Statistical analyses—To identify genes conferring significantly improved tolerance to abiotic stresses, the results obtained from the transgenic plants are compared to those obtained from control plants. To identify outperforming genes and constructs, results from the independent transformation events tested are analyzed separately. Data is analyzed using Student's t-test and results are considered significant if the p value is less than 0.1. The JMP statistics software package was used (Version 5.2.1, SAS Institute Inc., Cary, N.C., USA).

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

LENGTHY TABLES

The patent contains a lengthy table section. A copy of the table is available in electronic form from the USPTO web site (https://seqdata.uspto.gov/?pageRequest=docDetail&DocID=US10975383B2). An electronic copy of the table will also be available from the USPTO upon request and payment of the fee set forth in 37 CFR 1.19(b)(3).

SEQUENCE LISTING (11335 sequences)

SEQ ID NO: 1 - DNA, 1235 bp, Arabidopsis thaliana
gacgtcaagaggttgaagcaagacaaaaatggtgaaaacaaagaaagaagatctaaatcaatttctgattcctcgtctcaacaccatctacgaaaccctccagttgttcgatggaacagcttctcctacagtggaaagagttaattggaacgatgttcttcagatgtctgatcacctctctaaacaagccaccatagtgggaatgctatggactggagaatctccaaaagctgattcacttaaagagactatggagtcttacttcaatgcccttcaagggtttttactctgttgccatggaagcactcttggtgctggacctacgctttcttcaatcatacatgtttctgttaagcaaattgttgattctagcttcagattgttgcagggttctgtttctctatacgagggatcgtatgagaaggataagaagccgtctattccgcagctctcgggagtggtttgggaagcatgttccagtttcaagaaggttcctgcaacaaacattactgcgattggtagagctattacacaggttgcggtttccatgaaggatgttcttagggagatgaaagaagtgaagccagcgtgtcctttatctgaatgtgaggcatctggtgataatatgtctagtgatgatgatgatgatgacgatttaggcgatgatttgtctcctgaagaaatggaagttgctacaatggttactgagattgtctctgaaactatcatggtgataaaagaactcattcgagttatcactggtatgattaagatggagaatccaaaggataatagtgggtttgtggagtcgcttgagaagctactgaagctgtgtcaaggaactggtgtacaaatcgatgagcttggtgcttgtgtctatccaccgcaggagatgaacaagatgaagcaaacagtgaaggttatacagggaaatctagacgaatttgaaactgaagttgagcgtttgaagagttcttcagacggcttttcgggagcttgcgggaagctgcgaaactccttgaaacatatggaaactgaattggataaaagatgtgaagctgagctagtagttgaaatgcagaatgttactcttgacagttagtttggattttgcaattgagttttttttcggtttgtttcagtggcttgtgtcttgtagtaacattcatctaatgttcaatgtgttgtacacgtttcttaactttatagatatggtacttagattttgttttcgt

SEQ ID NO: 2 - DNA, 2107 bp, Arabidopsis thaliana
ggagaaaacgtaaaaccctaaaccctactgcttatagaatcttcgacgatctgcttcatttctcctcatctacgagtgagagaatttgtcaatttagcttctttagttcggtctgatctgaattaattgcaatcttctcggttgtgtgagagaatcaatcaccatgtatcggcttgtctccaacgttgcttccaaagctaggattgccagaaagtgtacaagccagattggaagcaggctcaattctactaggaattatgcagcaaaagacataaggttcggtgttgaagctcgggctttaatgcttaggggtgttgaggatcttgctgatgcagttaaagtcactatgggacccaagggtcgtaatgtcatcatcgaacaaagctggggtgcaccaaaggtgacaaaggatggtgtgactgttgccaagagcattgagttcaaggatagaattaagaacgttggtgccagtcttgtgaaacaggttgctaacgccacaaatgacgtagctggtgatggaacaacgtgtgccacagtccttactagagctatcttcacggaaggttgtaaatcagttgccgctggaatgaatgcaatggacctaagacgtggtatcaaattggcagttgatactgttgtgacgaacttgcagagccgagcacgcatgattagcacctctgaagaaatcgcccaagttggaacaatatcagctaatggagatagggaaattggtgaactgattgcaaaggctatggaaactgtcggcaaagagggagtgatcacaattcaagatggcaagaccttgtttaatgagctggaagttgttgagggtatgaagattgacaggggatacatctccccgtacttcataactaacccgaaaacacaaaaatgtgaactagaagatcctctcattcttatccacgagaagaaaatttccaatataaacgcaatggtgaaagtattagaactggccctcaagaagcaaaggccgctgctgatcgttgctgaggatgtggagagcgatgctcttgccaccctaattctgaacaaacttcgtgctaatatcaaggtctgtgctgtgaaggcccctggttttggagagaaccgaaaggccaatttacatgatctagctgccctcactggagcccaggtaataacagaagagttgggtatgaatctagacaacattgacctcagtatgtttggaaactgcaagaaggtaacggtatccaaagatgatactgttgttctcgatggggctggtgacaagcaagcaattggggaacgatgtgaacagatacgatccatggttgaagcaagcacttctgattatgacaaggagaagttgcaagaaaggttggctaagctttcgggtggtgttgctgtactaaagattggaggagcaagtgagacagaagttagtgaaaagaaagatagagtaacggatgctctaaatgccactaaagcagccgtagaggagggtattgttccaggtggtggtgttgctcttttgtatgcttcgaaagaacttgagaagctttccacagctaactttgatcagaaaattggtgttcaaatcattcaaaacgcactcaagacacctgtttacacgattgcttccaatgctggagtcgagggtgcagttgtcgtaggcaagcttttggaacaagataatcctgaccttggttatgatgctgctaaaggagaatatgtggacatgataaaggctggtattatcgatcctttgaaagtgatcagaaccgcattagttgatgctgcaagtgtttcgtctttgttgacaacgacggaagcagttgtgactgagattccaacgaaagaggtagcatctccgggtatgggcggtggtggcatgggcggcatgggtggcatgggcggtatgggaggaatgggtttctgaggagaactataaaccctgagtagggttctttggaatctgttgtgagagatgctacggttggttcatccacaagacactaatgtattctttaatcatgattggtagagagagaccttcagattttccgtgattttcaattcacaaacgatttataaactattttgaagaagatccttttccgattca

SEQ ID NO: 3 - DNA, 716 bp, Hordeum vulgare
aaagtacacacaccacactaatcaagtacacacatccaggccaataagccacgcccagagaaagataaccacatcacacctagctagctagcgtcgtcatgtccggcgtgtgggtgttccgcaacggggtggtgaagctggtggagaaccacccggcgtcggcggcgggaccgccgggcggcggcgcggtccggcgcaaggcgctgctccacacgcccacgggggaggtggtcgcctcctacgcctcgctggagcgcaagctcgtcgcgctcggctgggagcgctactacgccggcgggggcggcgccgccggcgactgcatgctcaggttccacaagcgctcctccgtcgacctcatctccctccccaaggacttcggccagttcagctccgtccacatgtacgacgtcgtcatcaagaaccgcgacgccttccgcgtcatcgacgtctagcctactaagcctagctcgcgcagctggctgatccggccattcgatcgaagcaagcgcagctagctcgtgcgcgccggcggccgccaccgtcgcacccatgtcgccttcgatctccgctgctggttaacttgtgtatgtgtgtgtttgtacgtgccctgcacgtatatacgtgtgtatgtatatgtacgtggtgtattggcgtatatatagttatgcattatgcatgctgcgtgtgcatcatggttaattaattcgtgtattact

SEQ ID NO: 4 - DNA, 1418 bp, Hordeum vulgare
aatcacctcgcgagcctcgtcgtcaacctcgccgcctaccaccctccatcccacagatagaagagagtccccccccaggagtcgacaaccaaccaccagcccaccgccggcgccgcggatggagctgttcgcgcacgccaaggcggtgcggctcaagagccggcacgacaagttcctgtacgcggacgaggacgagctgcacgtcacgcaggaccgcaacggctcctccccgagcgcgcgctggacggtggagcccgtgccgcacgcgcccggcgcggtgcgcctccgcggcaggtacggccgctacctggccgcctccaccgagccgttcctgctcggcatgacgggccgcaaggtgctgcaggcggccgcggcccccgggggccgccccgacgcgtccgtcgagtgggagcccgtccgcgacggcttccaggtccgcctcaagtcccgcgccggcggcgtccgcggcggaggggacaagtacctccgcgccaacgggggcgtcccgccctggcgcaactcggtcacccacgacgtgccgcaccgcacggccacgcaggactgggtgctctgggacgtcgagatcgtgcaggtggtcacccccggcccggccacgcccgcgccggagaaggccgcgtccgcgccccccgccgccctcgcgccggactccccgcccgcgcccaagctccggcccgcgcccacgccctacgaggcgcaccaccggcccaccaagtcccagacgtcccctcccccgccggactacgcgccgccgccgccgccgcccagggccaagccggagcccaggctctccaagctcgagtcttccgattctttctctgccccattgcacaaggtggagggccgtgcaatccactaccacattgcagacgataagggcgacgtagacgatgatatcgagagacgctcgttcacctttaatggctctaacctggaggagctcacccagaagttacaagaggaaacaggcatcgatgatctgatcgtctgcacacgcagccctatcagcgggaagctcactcctctccttctgcagctgcctcccaacaatgcagcaatgcacattgtgctcgtccgcgagtcctcaaaagtggcaaagacatttccgtggccgtatggctcataatcttcagagggaagacgctgtcgcttcaggctgagcagtgggatgctgggctgcacatctggttaattcattggaactatacaccgtctattctggcttatggttatcaggagcaactaggaccccgtgcttgtgtataaagtgttagattaaattaaaccggcggatcgtgcggaaaaactggagagatgtttatattttacagactagtagtattatgtttatactttattatagactagtcggtggttgatgatggattgatggttacttg

SEQ ID NO: 5 - DNA, 2194 bp, Hordeum vulgare
tccggttgacacttactcccgtcgaaaggaaaagcccgcatcgtatagtcatccagattccgggctccagctaagccgccagaccgccgcatctccaccgcatctccaccgcttccccctaaacccacgccgccgaccatggcatcctcctccgctaaaccctactgctgctcctccctaaaccccgcccactccacccccgtcgccgggcgcaccaccctctccaccctccccgctgccaagccccgccgcttctcacatggcctcgccgccgtcgccgcgaaccctagggcctcccgcaccgccgtcctccgctctgtccacgcgtgcctggcggcgccgcgccggccggagtacgtcccggaccgaatcgacgaccccaactacgttcgcatcttcgacaccacgctccgcgacggggagcagtccccgggggccaccatgaccagcgcggagaagctcgtcgtcgcgcgccagctcgcccgcctcggcgtcgacatcatcgaggcgggcttcccggcgtcctcgccagacgaccttgatgccgtgcgatccatcgccatcgaggtggggaacacacccgtcggggaggatggccatgtgcccgtcatctgcggcctctcgcgatgcaacaagagggacattgacgccgcctgggaggctgtgcgccatgcccggaagccgcgcatccacaccttcattgctaccagcgagatccacatgcagcacaagctgcggaagacgcccgaccaggtggtggccatcgctagggagatggtggcttatgcgcgcagtcttggatgccccgatgtcgagttcagccccgaggacgccggcaggtcgaatcgagagttcctgtatcatattctagaggaagtaataaaagctggagcgacaactctcaacatcccagacaccgttgggtacactctccctcatgaatttgggaaattaattgctgacataaaagcaaatactcctgggattgaaaatgcaattatatctactcattgccaaaacgatcttggtcttgcaagtgccaacacattagcgggtgcttatgcaggagcacggcaattagaggtgactatcaatggtattggtgaaagagctggaaatgcttctttggaggaggttgttatggcaattaaatgtcgacgagaactcttagatggattatacactgggattaattcacaacatattaccatgacaagcaaaatggtacaagagcacagtggacttcatgtacagccgcataaagctattgttggtgccaatgcctttgctcatgaaagtggaattcatcaggatgggatgcttaaattcaaaggaacttatgagataatatcgcctgatgatattggtttaacacgtgcaaatgagttcggtattgttcttggaaagctcagtggaaggcatgccgtcagaactaaactagtggagcttggatatgaaatcaatgacagggaatttgaagatttctttaaacgctacaaagaggttgcagagaaaaagaagcgtgtaactgatgaagacatagaagctttactgtctgatgagatatttcagcctaaggttatttggtcccttggtgatgtacaggcaacatgtggaacacttggtttatctacagcaactgtcaaattgataactttagatggagaggaaaagataggttgttctgttggaactggcccagttgatgcagcatacaaggctgttgaccaaataatacagattccaactattcttagagaatatagcatgacttcggtcacagaaggcattgatgcaattgcaaccactcgagtagtcatcactggagatgtcagtgccaataaatatgctttgactggtcactccaatcgatccttcagtgggagtggtgcagccatggatgttgttgtatccagtgtccgagcttacctgagcgccctgaacaagatgtccagttttgttggcgctataaaagccagcagcgcagcacctgaaaccctaagtgctcagaccacagaatgagtgtttacatcacatttcttttctgttatttcatccccggagcaatgtgaatttacatgttagtaaagagctgtttggtagtgtaagggactgggttttctagctggtgtgcatctgaaggatattttgttctccttggtttattgcaacttttgcttgagcaatgagcaaa

SEQ ID NO: 6 - DNA, 1075 bp, Hordeum vulgare
gctcgacccaccatcttcctccccccctcctgtctccccgctcgccgctacgcaaacccttctccccgcgccgcgccgccacccccaagaacctcatcggctccggcctttgatctcctcctccggccggcagaggcatcgaatcccccacgccacatcctccaatggctaccaagtcccaaaagaagaagaagccctccgcccccaacccctcaatcgacgccaagaagcccgaccctcaggaacccgcggagacgcgagagacggcggcggcggcggccaagaagaagacgccgaagaagcagaaggagagcaaggaggtctccgccaagaaggcgaagcagcagaaggagggcaaggaggtctctgccaagaagccgaagccgaagaagcagaaggagagcaacgagatcgacgagatcttcgaggccactaagtccgacaagaagcgcaagttgcaggaggaggaggaagaggagtccgagggggctagcaagaaggccaagaagggcaaggccgaggggggcagcaagaagaagagcaagaaggaggccgggggcagaggctgggagcccggccacgacgaggtcgaggagaagcggccgcggcggcgcaccaacgacgggctcaccatatactccgccgacgagcttgggttcggcaaggccgacgccggcggcaccgccctctgccccttcgactgcgactgctgcttctgagcctttcagttcaggggtcctccctgcctgaggtgatgtactcaggtgacattcgtcgtcgtggtgtttgttgtaatgctcggttgattcgataaccatgtgcttaggcatgtgattggatgaaatggaattttggttctctgatattgtcagttttacaagggctccagattatatgtcttcctagttgaaccagttacttgtttcaacaacaacaaaactaaagcttagctgtttgaagtaaaattcttacatgatgtcagtgttcgagttgcatgagcaatgtgcctttttatatgatgtcgatggtcgagttgcctgaagggccttgtaagagaatacatatttttaggaag

SEQ ID NO: 7 - DNA, 1086 bp, Hordeum vulgare
aggcacccagcacagcagtacgggccaacgagccgactcccgattcatcaatggcgtctagcgacgagaagcctgttccgacgccggcctcaaccggaggcgacggcgggccggcggggaagccgacgaccacgtcgacgatgctgctcgacaagggcgcggcggcgctgcagtcgctccgccccgtgaagcagatcaagcagcacgtgtgcacgttcgccctgtacgcgcacgacccgcaccggcaggtggagacccaccacttcgtctcccgcctcaaccaggacgtcctccagtgccccgtctacgactccgacgacaagcacgcccgcctcatcggtgtggagtacatcgtgtctaggaagatcttcgagtcgctgccggcggaggagcagaagctgtggcactcgcacgcgcacgagatcaagacggggctgtgggcgaacccgtgggtgcccagcatgctggggaaggcggagctggaccacatggccggcacgttcggcaagttctggtgcacctggcaggtcgaccgcggcgaccgcctgccgctcggcgcgcccgcgctcatggtgtcgccgcaggcggagcgcgtcggcgccgtgcgcccggacctggtgaggaagcgcgaccagaagtacagcttctccacggaggagctcaaggccgccagggccgacgtggaggtgccggcggagccgcgcccgggccaggccgactactgggtccgccaccacaagggcttcgccgtcgacgtcgtgccgcacgagatgaagcgccacgcgccgtttccgtgagcgaccccgttcctcggcgccagaagcgtcagcacaagtggggtagagcgcttccgtgttagtgtgtgaaactgtgcgctttgtgtagttgcgggcagaggtagcgccgagtaataaaaatcatctactgaatcatctactagggtgccttttggtttgagaaccaaaaggcatggtaatgttatggtcccgaaggaacgggttggttctattcttgtattcggttgaagataaaaaatcttgtatttggttgtaagataaaaaattgtgtttggtttgagaatcaaaa

SEQ ID NO: 8 - DNA, 683 bp, Hordeum vulgare
gctcacttccattgcttcgttcccaactcctccctccatcgcttccttgcggtttcatctttttgtctgagagatcacaccttcagttcaatcttgagccggttctgttcgatcgatcatctatgtcgtctggcctctccttaccggcgacggtgcggccggcatcctccgggcttggggggcgccagctttacgcgtcgccgccgcgccacggtacgaggaggccatgccgcggtctgctggcgctgcgaccgagcacgaggagctgcgcggctttcgggcaggaccactacgggggcgcgctggtggacgtgggcatggcggtgctccggcggaggatccgggagacgcggatggcggagaccaactacgaggcgccggcgggatgggcggactgggagaagcgctactacccggcatacgtctccgacgtggccgcgctcgccggagcgctgcagctgctggccatgggcaccaggcctggcgtcgctgcggccgtgacagcactgctgctcgccggcgtgcccatctccgctctcgcagccttgcacctcctcggtcaggcggtgggatccgttctgcaccatgtttcttgatcgactcatcattcattcgtacgcaatgtgtgctctctgtgtctatattctatgtacataaacaatgcaacggtgatacctaattct

SEQ ID NO: 9 - DNA, 2142 bp, Hordeum vulgare
gcttccatcctctctcgttctctaccaaagtccacccgcccgatccggcggagctagggttcgcgccgccagccggcgaccccgccccgtcccgtccgccggcgaaccattccaggtccggcgggcgacggcctctccttgcgggctccacctccgtcaagtctgcatccatccagtactgcatccagccaacccccatccatctacaagcagcagccaccaagtttctgtcaagatggggttgtcttcagctgctgatatcgatggggcgcagctgtgtatcttcgacctgaggagagggcagcaggaggggcaggagctcgacaagatcctcttcttccacccggctgactgccccatcctgctccagctctccgtcattggcctctgtgaaggaatcatcactttcacaagaatattttctccagaagatgactgtgaggtgatagaatctgacaaacactcccacgttttttaccaagctgagccagatatttggatggttctggtagtgcagaaaattaaggacaatgaatcaactttgcgctttggtgcattgcaaggaatactgaaagaatctcattcgcttttcgcaatgtttcatggacccattcgaactttacttgacagacaaccaagtgctgaatttgcccgtggtcacctccacacatttgtcacagattatttgagcgattttagtgttggcaaaaagctacaattgccaacctaccgtgatagcctaacggagcggggaacagtccaaatgctaacagtctcacgagaagtggcacttgaagttcagtcgctcaccacagttcttgggtcatgtcttcgaaacgtaatctgccaatcaattgtattatttgaggacctcttggtgtctacgacacttcccctggatgatacattaaacctatacacttatgctatcctgcggttgactcctagtgctttatcttccaacgggaattcatggtcctatttgcggaaagggggttatgttaatgctgacaccactttaagttcggcaaatggagcagctgcagcagagaggtatcatagtcgatctcgtgacacttctcctggtggacaaaatcagatgcaccataatttcaggcctcttcagcgtgagaaattgtccaagggaaaagatggttttgttgctgctgactttgcaactacagaaattcgtggtgctgtaccgttgaatccaatattgtggtttcatcaggcagaggagcgcatgtatttatgcgtttatcagcacaagaaccttactatcttgctagtgattccagcttcctcactgataaatggagaagagggcattgctcatgtgaagaggcatcttcttgaaaatgcatcacagaacattgtcagtgttgaacaaaaattatcacgaggatggggaggagaaaatgcctatcatgttggtggataccgctacatactctctgatccaaacagaaaagtatcaagagcctccccacctgggaaagtcatcaccctgtcaaaggattctctacttgccctcaacaggctaagaggagaagtagatcttgagaagtcaagagctaagaggagtgacactacccatgacaaggattatgaagtatgcatcagagcgaaaaataatgcatggattattgctaaaatttctcgaggaaaagaactctatatggctatagagaagggcggcgaaacacttctctacgcatctacagctgttgagaaattcagcaacaggtactgcgagggggcattctctacagactgaacgcactgctagtatgagatccagtccagcactgcacatggttctcgactggatcactcccttacctgtgtgtaattgatgtcgatcttactcatgcgataactggattcgtaccagttgtacagctgcaagccctttggaataaaaataatgcagagcaggatccagcattaacgttctgcggccacttacgaacatgctcatttctattttatgttttttggaaaacaacaactcatttctatatgtaaatgcctgagggaggactactaactcgtatgtattacgggccggttctctgtggcttgtagatggcttaacttgaaaattgaaccttctccagagaaagaaaacctggaaattaa

SEQ ID NO: 10 - DNA, 2142 bp, Hordeum vulgare
ctctcctgcttcctccttccaccagtccacattcacacacgctctccctcccccacctccgttccacggctcgcgttccttcgctggcaggctagcagatctccgatggggtgcttccagtccaagccggcggggaagccgctgccgcccgacgccgacgccgccctcccgcccgacgaccccgcagatcccgaggcggcgaacggagcggacggggcgggcgcggacggcgacgagaaggacggggcgaagcgggcggtgccggtgttcagggagttcgggctcgccgagctgcgggccgccaccaagggcttcagcgccgacctcatcgtctccgagagcggcgagaaggcgcccaacgtcgtctaccggggccgcctcgacggcggtcgcctcatcgccgtcaagcgcttctcccgcctctcctggcccgacccgcagcagttcctcgcggaagcggccggcgtggggaaggtgcggcacaagcgactggtcaacctcattggctgctgcgccgagggtgacgagaggctgctcgtcgcggagtacatgcccaacgacacattgtccaagcacctcttccactgggataagcagccgttgccatgggaaatgcgattgagggttgcacattacattgcgcaagctctcgatcattgcaatgcagagaacaggaaaatctatcatgacttgaatgcctacagagtactttttgatgaggaaggtgatcctcgcttgtcaagtttcggactaatgaagaacagccgtgacggcaaaagttatagcaccaacctggcttacacccctccagagtttctacgaacgggcagagtcatcgctgagagtgtgatatatagctacggaacagttctgttggatcttttgagtgggaaacacattcctcccagtcatgcacttgatttgataaggggaaagaacatactgctattgatggattcctccttagaaggacaatatgctaatgaagatgcttcaaaattagttgaccttgcatcaaaatgcttgcagtttgaagcaagggacagacccaatataaagtatttattgtcttctgttgggcctcttcagaagcaaaaggaggtggcgtcacatgtgttgatgggcattacaaaaactgcgtcggtcttaccaactattctttctccacttggaaaggcctgtgccggaatggaccttacagcagtacatgatatattgctgaaaacaggttacaaagatgatgaaggtgcagaaaatgagttgtcctttcaagaatggactcagcaagtgcaagagatgctgaacacaaagaagtttggtgatattgcatttcgagataaagatttcaagactgcaattgactactattcaaagctagttggaatgatgtcagtgccttcagctacagtttttgccaggcggagtttttcctacctgatgaacggacagtcggagcttgctctacgcgacgcaatgcaggcccaggtctgcatgcctgaatggcctaccgcattctacctccaagccctagctctctcaaagctcggaatggaaaccgatgcacaggacatgctcaatgacggagccacctttgaggccaagaagcaaaacagctggcgtggttagggacgaagccactgcttcccccaaactgttgttgcctttcaacagaaaagggtacaatgatgagtgttcactgggacgtctgatgagctgctaggagtgggattgaagtgcactgttttatcgtgcgaattcgcgacccctgcccccaaatgtcgattaatgatgctgtcgtgacctggaagatctaaaagagcagaaggcttatgagttgcaccacatgacggcaagatttcgccgatcattgcgtggcggtgctcccttgggatagaagattgtaattatggtgacgctctcttaacgatttctccttttttgtttctgctggatggctggacgattgtgtgggaacaaagggggttggttccttgtgattagctgaggagaaaataaaccagagccatctgaattccgtttgattccagggtgtttcctcatctgttgcttttctgttgaatgaattggtggtgatttgcatcaaataatgttagatcatttttagcccctcgtcctgtttta

SEQ ID NO: 11 - DNA, 3136 bp, Hordeum vulgare
agacacaggcagagcgatgctcgtgacagcctgagcggtcgcctaggcacccttccctcccctcaacagtcaacagcgaccagagaaaggaataggcgaaaaccctaaacctcgccaccggccacggccatggcggcgaccaccgctacccccaccttcctccgtgcgaccgagctccgcctcctccgctgcaccctcccttccccgatctcccaaccagctcccccctcacctcccccagaacacccgctcggtcctgtcgtgtcctctgccgtcgccgccgtcgaggtcggggactacgtggctgctatcgcctccgccgtcccccacatcttccacccctccgccttcgccgaggttgcccagggctccccaacgcaagcttacgccgacctcactgccgctgccgaggcgttcctccgggaggatggcggaggggccgcgagcgaggggttccagtgcaggtgtgcgcttgttctctccgcggcggtggccgcgctgctcgcattcacgcagcagaacgtgacgggaccgtcggggaagtttccacccttccctttccagacttcacgtttggacgaagaggggcatggtgatcctggaagcaaatgggatgattgggcttcgggtcatttagctgcttttggttcccatgttcatgggaaattcgctctcttgccgttcattgtctttgcagaactactcttcacaagcatacagggtctcgactcctctgattgttggagtgtgcaatggtggttgtgcagaatatccttgtcccagcaaaatattttagatgagctatcgtcctctttgtttgatcgagtacaagtgtacaagaatgaaatgttggcccactttggtgaacttgaaaaggtctctagctactggggttctttgttatgtgatgaagaagggttttcttttgtctcagctgtttttctggaagctggaatcgtggagtataaatatggccaagttgatgcttcaaggctgcatctggatagtgctcaagaggcatgtgggattcatctctctctcacagggattcttggttttcgaacaatacaccaggtggacgccaagtcccaaatggttctagttgcgaagactactaaatcagcagctgatgatggccaatcaacagagctagcaggatctcagagtgatggtgtggcttcccggaacgcagggagctctgttccaagtgaaagtgatgaattttgtgatatactaagaacaccaagactggctgaaaatgggaatgaaacgagcggtgagagtatgacatccgcaaacacacagatatcgctatctgctatccagcaggccgctgtacttgcacaatgtttatatgtgagtcggaggagtcggagtgatgaaatgtctgggtgggagatggcaccatacatagagtcaattgattctcaagaaaaatcatactttgtggtcaggagcttgtgtgatgttctgcgtattaggtgggagtccacgcgcagtcggacaaaacagcgggcactgttaatgatggagaatttggttgaagatattgccaaagaatttcctgtagtttcacaaagaaccaaactggtttttggagttcatatgccgcctatccctgcattaaggaaagagtatggtgaacttttgataagttgtggtttacttggtgaagcacttaatgttttcaaagaactcgaattgtgggataatctaatctattgctatcgattatcgggtaaagttgctgatgcggtcagtttaataaatacccggctctctgttacaccaaatgacccaaggttatggtgttcacttggtgatgctacaaataatgatgatcattataagaaagcactggaagtctcagataacaagtctgctcgagctctgcgctctctggctcgcagtgcatacaacaggaatgacttccatacatccaaaattctttggggatcagcattggcactgaattctttgtatccagatggctggtttgcctatggtacagctgcatggaaggataaagatcttgagaaggcagtggatgcttttagtcgtgctgtgcagatagatcctgaaaacggagaagcatggaacaacatagcctgtctgcacatgattagaggaaagagccaggcagcagtccaggcattcaaggaagctgtaaagttcaagaggaatagctgggaagtttgggaaaattacagtaaggttgctttggacacatgcaacatgcgactgacacttgaagctgtcaaaatggtattgaatctgtcctcgaacaagcgcttcaatgttgatctattggacaaggtgatggtctctgtcgaagaacaagctagacatcttagtgatactcaagaagctaaatccataagcaacgcttcagatgatgcaaataaagagaccaggctaccaaatcaattgctaggtgtaattggtgatatccttcagcagattgtacggagtggggctagcaatgcagagatatggggattatatgcaagatggcataaaagcaagggcaacctcatggcatgctctgaagctttgttgaagcaagttcgatccctccagggttcaggattatggcatgatcagaagaagttcacgaagtatgctcaagcttctctgcaactttgcaaggtctatatcgaaatttcctccacgactggaagcagacgagaattattgtcagctgagatgcatcttaaaagctccttaaaacaggcaacggacttctcaggtacggaggagtataaatcacttaatgactgccttgaccaattaaggggcctgattggcgctgcatagagttactgatatcttggttgcgaaccaaggtcactttgtcatattgcttatcacagaccctttataaatgacaagcatcgtcaagtcgcatcatccgatggtctatactcaagttcggcacgaagagtacaccagaccctttatttactcttgttctgttattcatgttggtcgtttgctgaatgtttcagcacacaatccagctcgtagctgtgagcactctgttaatcaggtttatcatgtgtaatcccagactgtatttgggaaagtatttgtactattgcctctgtttgaatgaaagtgttgtcgtgctctcaat

SEQ ID NO: 12 - DNA, 2872 bp, Hordeum vulgare
gagacacacgctctcctccattgcgctaccacggcaccaaccaactgctcgacggtatgccaccacactaggccactcaccccacccccaccccactcccccccctccccctacccgcagagcgccgccgccgcagccgccgagatgagggggcaaatgcagccgcggccgttcatgatgcacggcggcccgatgccgccgccgcagcagcagttcgggctgacggagacgcgcccgccgctggccgccatgctgcggccccgcttcaacatcccggggctcaacccctccgccgccgccgccaatgccgcgggcaagatctcctccacctacgacctcgtcgagcccatgcgcttcctctacgtgcacgtcgtcaaggcgcgggacctccccggcgtgtcccccaccggctccatcgaccccttcgtcgaggtcaagctcggcaacttcaagggcagcaccgccgtcctgcccggcaaccacaccccttcctggcaccaggtcttcgccttctccgccacgcacctccagtcgcatctgctcgaggtcgccctcaaggccaaggatctcgccggcggcgacgacctcgtcggccgcatggtgttcgacctctccgaggtgccggtccgcgtgccgccggactccccgcttgcgccgcagtggtacaggctcgacggcaagcgcggggagaagctccagcgcggggagatcatgctgtccgtctggctagggacccaggccgacgaggccttcccggaggcctggcattccgatgcccatggggcggctagtccgtcggccgtcgcctccacgcgcgccaaggtctacttctcgcccaagctcgtgtacctccgcgtcgccgccatcggggcgcaggacctcgtgccccacgacacgtcccgccccatgaacgcctccgtcaagctgcagctcgccgggcaggtgcgccgcacgcgcccgggcgcaccgcctgggacgcccaacccgatgtggaacgaggagttcatgtttgtggcgtccgagccgttcgacgagcccctgctcgtcaccgtggaagaccgcgtcgggccaggccgcgacgagccgctcggccgcattatgctgcccctcaacgctgcaatgccgcgccatgaccacttcggcaagcccgtggagccgcgctggtacagccttgcgcgtcccagcgacgacggtgagaagaaggaaggcaagttcgcgagcaagatacagcttcggatgtcgctcgactttgggtaccatgttcttgacgagtcgacttactacagcagcgatctccagccatcgtcaaagcacacacggaagccgagcattgggatccttgaggtggggattctgggtgcgcgcaacctgatacccatgaaggccaaggatggtcgcaccaccgatgcttactgtgttgccaagtatggtcccaaatgggtgcgcacaagaaccattctcaacacactgaatccgcagtggaatgagcagtatacctgggaggtgtttgatccatgcaccgtgatcacagtggtggtgttcgacaatacacagattgggagcaagaacggtgatgcccgggatgaaagcattggcaaggtcagaattcgtctctcgacgctggagactgaccgggtgtacacccatttctaccctttgctagctctcaagccaagcggtctgaagaagaccggtgagctgcatttggctgtgcggtttacgtgcaccgcgtgggtgaacatgatggcaatgtatggccgtcccctgctgccgaagatgcactactcacaaccaatatcagtgatgcagttggactacctgaggcaccaggcgatgcagattgtttcggcgaggctgagccgtgccgagcctcctctccgcagggaggttgtggagtacacgctcgatgtgggctcacacatgtttagtctccggcgcagcaaggccaacttctatcgcatcacttcgctgttctgtggttttgcctcgatggccaagtggtatgatggcatcaggagctggcgaaacccgatcacaacaatgctggtgcacatgttgttcctgatactgatctgctacccggagctcatcctgcccaccatcttcctctacatgtttatgatcggaatctggaactatcgttacaggtcaaggcacccaccacacatggataccaagctatcacaggctgagtttacgcaccctgatgagctcgatgaggagtttgacacattcccatccaacagaccggctgacattgtgaggttgcgctacgacaggctgaggagtgtcggaggtcgtgtgcagacggtggtcggggaccttgcgacacaaggcgagagagctcatgctctgctgagctggagggaccctcgcgccaccgccatcttcatattcctgtccctggtcgtggccatcgtgctgtacgtgacgccgttccaggttttgctggtcatcactatgctctacttgctgcgccatccccggttccgcagcaggatgccctctgtcccgttcaacttctacagaagattgcctgccaagtccgattcgctcatttgaggccagagcacccgacggaagataaaatgggggaaccctgtaacattgtctccctctctcattctgttccttctggtaagcttcagatcagatgtgaatatacttggtgagttgattaattagaggcagtttggtggccctgtaataaggtgtcggttttatatgttttactgtctgcttatagttaggcagatagcgaagggaatgaccagataagatcccttcatagttttggatgaacattgttggctctggggtttctggcgtagagcagtggggtggggcacatgatcagttccattgtgttatg

SEQ ID NO: 13 - DNA, 703 bp, Hordeum vulgare
aagcaaaagcagacagcatcctacctacgatccgatactgaattttccctcaggtacaaaatcgaaagcaacacctacaatgtcgatcgtgaggcgtagcaacgtgttcgaccccttcgccgacctctgggccgaccccttcgacaccttccgctccatcgtcccggcgatctcaggcagcaacagcgagacagctgcgttcgcgaacgcccggatggactggaaggagacgcctgaggcgcacgtcttcaaggctgatcttcctggcgtgaagaaggaggaggtcaaggtggaggtggaggacggcaacgtgctcgtcgtcagcggcgaacgcactaaggagaaggaggacaagaacgataagtggcaccgcgtggagcgtagcagcggcaagtttgtgaggcgcttccgcctgccggaggacgccaaggtggaggaggtgaaggccgggctggagaacggtgtgctcaccgtcaccgtgcccaagacagaggtcaagaagcccgaggtgaaggccatcgagatctccggctgagtattcgagtcggagccattctggttgatgtgtgtgcgagttctgcagcctaaatacagttgtgatttgttcttgtcgagtctggttgaggcatctctgtatcgcgtttctttcctcggtcgtttgtgtacttgtgtaatcgcaatgaataaatgtagtacctgatgc

SEQ ID NO: 14 - DNA, 1207 bp, Hordeum vulgare
cacagccccaatccaatctcaatcctcggcaaaaccctcgatctcgtcccgccctccttccccgacccccctcatcagatcgagagctccacagcagcgttccgcattcggatccagctgccgaaggaaggaccagccaggcgatggcggcgacgcaccacccggcctccccgaccggcggcaagccctcctccccctcgcccccgtcgccggtgcgcctggcggcgtcgcaagcggcggcggtggcggcgatccagcccagctcgccgcgctacttcttctcctccctggcggcctcctcgtcgccgcaccgccgcatcgccatcgccgtcgacctctccgacgagtccgccttcgccgtcaagtgggccgtgcagaactacctgcgcccgggcgacgccgtcgtgctcctccacgtgcgccccacctccgtgctgtacggcgccgactggggctccatccccgtctccgtcgacgaggagggcgccggaggcgcggccccggcgtccgaggacccggaggacgacgcgcggaagaagcgggaggaggacttcgacgccttcacctccaccaagtcgcaggacctggcgcagccgctcgtcgccgcgcagatccccttcaagatccacatcgtcaaggaccacgacatgaaggagcgcctctgcctcgaggccgagcgcctcggcctctccgccatgatcatgggcagccgcggcttcggcgcctcccgcaaggctggcaacggcaggctcgggagtgtcagcgactactgcgtgcaccactgcgtttgccccgtcgtggttgtcaggtaccctgatgacgccggggcggcgggtggtgccgactctgtgggggatgagctgcggacggtgcctgagaatgaggtcgtgttccatgaggcgccggaggggcagaaagaaaactgagaaggtaatagcgagcaccaagcagcctgatcacgagagagcaagttttgcttgatgcctagccatctgtaagctgtaactgagtggtttttccactctgctttccgcttgagtttgtgtcagacttgtagatcatggacctgtccttgctgtttcgcttcctgagaactgaaatgagaataatgtaattctgcatatggtactagttgttaacgtgttgttctatgaacgttttttattagctccctggaacattatttcagtttggttacttgttttta

SEQ ID NO: 15 - DNA, 2240 bp, Hordeum vulgare
cccctccaaccccgctccaacacctccctcccacatgatgccatccccgcagatatacccgcagcaattcagccgtcctctcacgccaacctgacacacctcacctccccttccctttccgttagttgccgctcgccaccgcaccgcaccccaccgcaccgcgagaggaagtgcattggctcgccaccgcccgccctccccaccttgcttccgcagaaagatccattcggtggctcccctgcacaccgcagcgatagtaaagccgcggcctttcctgcgcgcgcttgccttgccgccgcggcatccgccccgccccgccccgccccgccccgtggatagataggcagcgagtgatagatctgggggaggcgcagatctgactgaccggccggtgctcattctcttcccgccggtgagagtttgtcggggcggccatggggaagaagggcaagtggctgggcgccgtcaagaaggtgttcagcccggagtccaaggagaagaaggaggagaaactgaggaagaaactggctgcaagagaccccagcccaccagatcttacaccttctacttccttggaagtcaatgtttcgatgccgccgccccctcccgcagttccttctccgcaccaaactgaggaggttcaggtccgtgatgtggagctggagctggagctggagctggagcaggagcaggagcagagcaagcatgtgaccgtggaggcagcccctgatgctcctgctcagacgtcggcggcattgccacctggtgtgtcgagggaagagctcgctgcaatcaagatccagaccgccttcaggggatacctggctaggagggcattacgagccttgaggggccttgttagattgaagtcattggtcgagggtaattcggttaagcgtcaagctgcaagcacactgcgttgtatgcagactctcgcacgggtgcagtcacagatacgttcaagaaggctgaagatgtctgaggagaaccaagccctccagcgccagctcctgctgaaacaagaattggacagtttgaggatgggggagcactgggatgacaccacccaatccaaagagaagatcgaagcaagtctaataagcaggcaggaggctgcgataagaagagagagagcgctcgcatacgcgttttcccatcagtggaagagcagttcaaggtcctccaacccaatgtttgtagacccaaacaacccacactggggctggagctggctggagcgctggatggcagcaaagccttctgaggccggccgcactggaaccggcaaggaaagcaacattgaccagggatcagtgaagagcatgagtttgaaccttggggagggtgagatcactaaagcctttaatcgtaggggctccaagccagacaagtcgtcaccgacgactccaaagctgacccgcccagcctcccggctatccccttctacacccactgccaaagtgacaccaatagttgtgaagaagaaacctgctacaccgaagaatgggctttcacaggtggacgacgacgcaaggagtgtgctcagtgtgcagtccgagcgacccaggcggcacagcatagccacctcgacggtgcgggatgatgagagcctcgccagctctccgtcagtcccaagctacatggccgccacaaaatccgccagggccaagtcccgccttcaggggtcgccactgatcgatagtgcagagacgacaccagagaaaggaggctctgttagtattgggtcagccaagaagaggctgtccttcccagcaggaggggcgcccccctcgccaatgaggcggcattctggccctccaaaggtggagagcatggtgaaggacatcgctgtgacaccgcagccagaggccctggcgatcaatggttgaaagctgaaacaaaggagcaactcataagagtgccgagacggggctatggatatacatatttcacacccaggaacaaaggttaaaaagttattgaattgttgcattttgctttcatcaaattaattgttgtgactacattgtcagctttattaggagaagactctcggtgtcatctgtcggtccatgtccatttcatttgttgcttgtgtaaaaccatatggggtttgttgtttgtatgtacacaacacaggtcttctatttatgcgagcaatatatttcttccatgccttactccaatgaacttgtcaatgtagcactctgccccaataagtaccctgtcttccatcttac

SEQ ID NO: 16 - DNA, 1040 bp, Hordeum vulgare
ccagcagtcctcgcctccatccaaatcccccgagcggaggaggaggaggccggcggcggcggcggaagccatggaggaggggaagcaggggttccagccgcacctgatgggcggcggcgggaggatgaggggcgcggcgggggccatggggctgcagaagcagaactcgtggtcgcccgacatcgagcgggacgaggcgtgggagcggcgccggcgcgggatactgggcaggggccgccgctcgccgctgcagcgcgcgcagagcgtcaccgacgaccagctcgacgagctgcgcggctccctcgatctgggcttccggttcgacccgccctcgcagcgctgcgccgcctgcgacgccgggaggagccgcctcgtcgagacgctcccggcgctcgacctcctctacgccgtcaacgccaacgccaacgccaacgccaaggccggctgcgcggccagccagtgctcctgcggcgcctcctcggaggcctcggagccgtcgcccatcgggagccccctctcaatactctctccagatgacccgccggagacggtcaagatgaggctgaagcagtgggcgcaggtggtggcgctgtccatgcgcagccgctcctgaacagaccagccatggctgaacgaacatcccgtggaacgtggatgccataccgaattcagaggagggacaaggaacaacaacgcacaagaaaaagaataatccatccatccctccctgcctcgagatcgaagaagcaaccaatgattgatgagcaagcaaacgagaagagaatctaccaatagtgtcgtcggacgatcggccagccgccttccacatctgctcctcccgcatcttggaccagctagcttagccctgctgctactactaatcaacctttgtgtcacatgtttatcgttgagcaattcgagaaccatactccgtaatccgcgttattacctctgttattacctagtttctcctccccctgatcttccgtcgtcgcattgcttccgttactagtcacctcccctgatttcgtgataatttc

SEQ ID NO: 17 - DNA, 2500 bp, Hordeum vulgare
caaccactagtattacgcataggaaaagatctgaaaagaagagcgaggccacatcagtcggcagtagtctactctactccacctctgccctcccccgcccgcctgcgctgctcccgtcgctttcccctcacctcctccgcatccacatcgcccccattcccatcccatcccatccgccccccgtccgccagatgcgccaccagtcccgccgcgcgtagcacctcgctcccggccgccggcggccctcggcaatggcgagcgcgtcggaggacgaggcgggctcggagcgctgctgcggcagctacagccccagcgccgacgtcagcggctccgagacctccagcgactgctccgcccccaccgccaccacccgccgcttccccttctcctcctcctccgcctccgcctccgcctcccgcggcctcgcctcctcctcctcctcccagctccccaccccgtccgccgccttcttcccctcctccgtccccgcctccgacctctccgagatcgacatgatgaaggagcgcttcgccaagctgctgctcggcgaggacatgtccggcagcggcaagggcgtctgcaccgcgctcgccgtctccaacgccatcaccaacctctccgccaccgtgttcggcgagctgtggcggctggagccgctggcgccggccaggaaggccatgtggacgcgggagatggactggctgctctccgtcgccgactccatcgtcgagctcatcccctcgctgcaggagctccccgacggcggcggccagttcgaggtcatggtgccgcgcccgcgcagcgacctctacatgaacctccccgcgctcaggaagctcgacgccatgctcctcgccatgatcgacgagttcaaggagaccgagttctggtatgtcgacagggggattgtggtcgacgacggcggcggggggccgtgcccgtcctcgtcctcgtcttcgtcctgcgggcggccgtcctcggtgcggcaggaggagaagtggtggctgccgtgcccgcgggtgccgcccaaggggctgcccgaggaggccaggaggaagctgcagcagagcagggactgcgccaaccagatactcaaggcggccatggcgatcaacagcgatgtgcttgctgagatggagataccggatgcgtatctggagtcgttgccaaagagtggtcgaacttgcttgggtgagataatttacagatacataacggctgaacaattctcacctgaatgcctcctggactgcttggacctgtcatcggagcaccatacacttgaagtagcaaacagaatagaggctgccatccatgtctggagactaaagggccaaaagaaaacgacgactcaggcaaagtcaaagaaatcttggggcggaaaagtgaagggtcttgttggagatacaaagagccaagtattgtcacaaagagctgatggtctgctgcagagcttaagattgcgacaccctggtttgccacagacttcgcttgacatgaacaagattcagtataacaaggatgtcggtcagtccatacttgaaagttactcaagggttctagagagcttggcattcaacacaattgcgagaattgacgacgtgatttacgtggacgacgcaacgaagaaatctgcagctgccgagaccgtttcgatcttcaaccgcggcacgggtgcaccagtccagaagaaaatctccccgagcccattctcgatccagcatacgccgtacgcctcccccttcgccacacccaccttctgctcctccaccccagtcaatggcaacagccccggaagagcaccactgcctccgccgagcaaaaagaacccgccagcgaaacccgagatcaaagtcgagaagctcttctccggtgatgtagagaaggtgtggacctatgccggaaacctgagcgcgcggaaagaagccggagacgctcctgaaagggactgatttttggcgtacgcctccttggggaggtcgacaggtatcatcattcaacagatactgatccggtcggtagggctagagcttccctgtacagaagcaacatcagtcaatttttttgtgctttcttagcgcgatcgatccgcggaccgtgtactgcacctccctgctcacctagcaatggagtaattgaactcttgatgtcgtctagtttaccgtcagctgtgtgtactaccccttgttcatgtctatactagcttagctagcaggtcgggttgggcagcaagccggcaagttattgaactcgagatgttgctgctgctgctgctgtaggtttttttgtgtccctgatcctgaagccaccagtaatgctgtgacagtaactgcagctgcagtgggatgtttgttgttgttgtacggtggccgtgcattctgatgtctgacaattgtctgtacttacatgctccttgatgaatcgatctgacgctagttcttcatttctttgcctaccattgtagtctcttctattaattgtggtgtgatttgatcccagc

SEQ ID NO: 18 - DNA, 2018 bp, Phaseolus vulgaris
ggaaaaacaacttcatataagaagcactagggggggcagtgggaggcacagcagatggagtatttcaacaaagccaaggccgtgaagctacggagccacctcgggaagtacctagtggccgacgacgaccaccacaaactgcgtcagagcaaaaacggctcaaccagaaattcaatatagttggtggagctggtgaaagggaagagccaccacgtgcgtctcagaaactccaacggccgttacctaaccgcgacggaggcgccctttctgttaggcgtgacggggaataaggtggtgcaggggagtttgggggatggttggaatgggaaattggagtgggaacccataacggaagggttgcacgtgaaactgagaagctggtgcgggaagtaccttagagggaatggtggaacgttaccgtggagaaactcgatcacgcacgatgacccttacgcttccaccacccacgattggatcttgtgggctgtggagcctctggagtttcccgacaaactgctttcttcgccggagactcattttccgtcgtcgttggagtcggaggatgagcttcgcggttcggaagaaccgggttcgtcactgttgcagagcacaagttccgacaccatgttccgctccggcatggagctcttccaccgcgcgaaggtggtgcggctgcgcagccaccacgacaagtacctcctggcggacgaggacgaggaatcggtgacccaggaccgaaacggatcctccaggaacgccaagtggacagtggagctcattccggagttcgacaacctcttacggctcaagagctgttacggcaagtatttgacggcctcgaaccagccgttgctactgggcgtgacggggcgcaaggtggtgcagagcgtgccgcggcagctggattcctccgtggagtgggagcccgtgcgggacggcgcgcaggtgaagctgaagacccgttacgggaactttctgagggccaatggggggctccctccttggaggaactccgtgacgcacgatatcccgcataggaccgccacacaggattggatcttgtgggatgttgatgtgttggagatccacgtcgagtctcctgctcctcctcctattcctcactctgattccctcgatttcgattcctatactccctctgctgtttccatcaaatccactgctttctccagacaagagtcgacggattcaaatgtgggttcgccaccgaagttggaggggaggactatatactaccatgttgcagaggataatggggacgtggatgatgagaatgtgcagggttattctttgactttcaaaggaaatggggttgagcagttgactcggaagtttgtggaagagacggggcttgagggagttattgtgtgcactcgaagtcctttgaatggaaaactctaccctcttcgcttgcagcttcctcccaacaatgtcaccatgcaggttgttttggttcttccctcgtctaaagtggcaagagactttgaggagcaaggtctactatgacaagctagattattgttggagtcttgaatctactgaaatgcaaggcctatttacgttgtgatccaaagcgtgtttcaaattttatgtgataacatttaagaatttgttgcaaaacttcacctatttcaagtgattccctgcattcagaaggaagaattcgtggaggtccaattgtaccttaaagttgccttgggaaactcatgtcagtcttatccactattaattggtgtccaatagtctgtagaatgtcgacgattcttatgtaaatggaagtctttgttgggcttcttatttattagtgctagctttaatcttagtctattgatgtggattcagatattttgttgtatctcatttttttgttatttttctctttttcatgtttttaagtccatttgtatagccaacttttcagaaaagtataggtaaattatttttagtcatataatttcaagaattagtaacattttttctcacatatacattttgcctca

SEQ ID NO: 19 - DNA, 2400 bp, Phaseolus vulgaris
gttgaagctgctagattcctagatttgtttgctgcatgtctaagccataattcagtgttttctggttcactcagaaaactcacttcgacagatcgatcatcagccctgggatatcttccctccattgctgagttgaaatctggagctaattttttcaattatagcccctctcttataaattctggtttatctgaagtccctaaatgcaggcttattgaggaaaagagtctagaaaatcctgttaaaactgctcaaaataagtatgagcttcctcgcatgcccccttggtttagttatgttggtagtcttaagttataccaacctcttgcagggattctccgatttgtgggtttatctatagtggcagataatataagtgaagggcttctgttgcatgtgattgagaccctgcttggttacttccgtaaattggtttctgagcttcgtttaagagaatacaataaagaaagctggcagtcttggtatgacaggcatggttctggacagttattgaggcaagctagcacagctgcatgcatgctaaatgagataatatttggtgtatcggatcaagcaagtaatgattttgctagaatatttcataattgtgcatttcatacatctttctgggagatgcccaaggataaaggtgtaaggagttatttagttgagtgcattggagggatcttacatgagtatttatctgctgaggtatggaatgttccaattgattgtggaactgctgacttgccgcttcatgctgtggttgaagaagatattagcctatactttttccaagatgctgcaatgctgcaacaggttattattgatggagtaggaatctttaatatgtgccttggaagagattttgtttctagtggatttctacactcttcactttatttattgctggagaatcttagttcttcaaattaccgagttagaaatgcagcagattctgtcttgcatatactttcaaccacatctggctttccaactgttggacagttagttttggaaaatgcagactatgtggttgattcaatatgtcgacaattacgtcatttggacctaaatcatcatgtgccaaacgtgctagcatccatgctgtcctacattggagtggctcacaagattttgcctctgcttgaggaaccaatgcgctctgtgtcaatggaacttgaaatactgggtagacatcaacatcctgatcttactattccattcctaaaggcagtagcagaaattgtgaaggcatcaaaacgtgaagctttcctgttacccactcaggcagagttgttcgctggagatgtgaagtctataatctccaattctgcagaaactatgcaagatcagtgggaggacattttattcaaattaaatgattctagaagatatagacgaacagttggttctattgctggttcatgtgttactgctgcaatcccacttctagcatctatcaagcaagagatatgtttagctgccttggatataattgagagtggtactttggcaatagcaaaagtagaagcagcttataaacatgaaagggaaattaaagaagcaactgaagaagccttagaatcactatcactgtatcagctgaaggatactttggaagctaatgaagaaggggctgacgaaaaccggctacttccggcaatgaataaaatatggccattcctggttacttgtattcagaacaggaatccagtggctgtgcggagatgtttgagtgtgatcagcaatgtagtgcccgtttgtggaggaaatttcttcacacgtcgtttcctctctgatgggcctcacttttggaaacttctgacaacatccccatttcataaaaagtcagttttcaaagatgagaagatccctttgcaactaccttacagaagcagttccatgagttcagaggattcattggctgagacatcctatctcaaggttcagattgccgtgctcaacatgattggtgacttatgccgtaacaagagcagttcctctgcgttagaacttgttctgaagaaggttagtggtttggttgtggggatagcctgtagcagtgttgttggacttcgagatgcttctctgaatgccctccatggactttcatctattgatcctgatcttgtatggcttctcttagctgacatatattacactaaatatacacaagattttcctccaccttcaccacaattaccacaaatctctcaaattctccctcttcccatgtcacccaaagaacatctgtatgtgcagtatggaggtcagagctatggttttgacataaatttggcttctttggatattgctttcacaagatttgattctcaacgtcaaatgtatagctaaaacccgaattagcgtatataaattatttctgtcctttttatc

SEQ ID NO: 20 - DNA, 722 bp, Phaseolus vulgaris
agagagtttggtttggttcttaataactgggcttacggatccaacagaaatctatgaccttttctacccttcggtcaaggtgatttagctgttggattttccttcctcagacttcattcacacatttaacatcaggatgatatgatcgatcgtatttcatctcacggttccatatcagcaaccttcagttcagggaaagtgatgcatttcaatcctttgggaaatgggtttgtggactatacttgaggggtttttgcttcttgcaaatgcattggcaatattaaatgagggtcgttttcttgcacctagaggatggggtttcacagatttctcaggaggaaggactaagtcgttcaaaggccagcttataggtctcatttatgcaactcagtaccttagagttcctctcatacttctcaactccatttgcattattctcaaattcgtgtctggatgatgctttacaaggtttggggtttttgttagatgatttcacgaaggtctttaagatagcaggtttaccaaattcttttgcagaaatatcagttaaagtatttctcctatttcgtgatattatttataaccaccaaataacgttctttaggctaaaatgtagggcattataattttaaattcagtgttgtattcagtttattgagtattgattataatttttattttattttatgttttgttgattctagcttaccttgcttgactga

SEQ ID NO: 21 - DNA, 3050 bp, Phaseolus vulgaris
ttgatgctcaataaagtcaaacaacagcaaagaacccagcttttttatttccaccatgcaataaagaattggagttaccaagaatcagttattctttcccttctcattcttctattcaattctcttcctctctcacaccccatcctctctctctctctctctctttctctcgactcctttggtttctgcaatggccacccttgcagacattggtgtctcagctaccatcaacattctctcagcctttgctttcttgctggcttttgctctgctgagaatccaacccgtcaatgatagggtctactttccaaagtggtatctcagtggagggagaagtagtcctaggagttctgggaattttgtgggcaagtttgtgaacctcaatttcaggacttaccttaccttcctgaattggatgcctcaggctctcagaatgagtgagtctgagattatcagccatgctggccttgactctgctgctttccttagaatctacactctgggcttaaagatttttgttccaatcacagttgtggcactcctcattcttataccagtcaacgtatcaagtgggacattatttttcctaaaaagggaattggtagtgagtgatattgataaactctcaatatcaaatgttcctcctgaatctataagattttttgttcacatagcattggaatacatgttcacattatggatttgttttctgctgtacaaagaatatgataatatcgcatcaatgagattgcacttcattgcatcacaacgcaggcgtgtggagcaattcacagtacttgtcaggaatatccctcgtatgcctgatcacgcagtatcagattctgtgaatggcttctttcaaacaaaccacccagatcattatattggacaccaggctgtctacaatgcaaataaatttgctaaattatcgaaaagaagagatagactccaaaattggctggactattaccagcttaagtttgaaagacatcctgacaaaaggtccaccgtcaagactggatttttaggcctttggggtgggaaagttgatgcgattgagtactacaaacatgcaattaaggaacttgataacctgatgacatcggaacgccagagagttataaaagatcccaaagctattttgccagttgcttttctttcattcaattcccgttggggagcatcggtttgtgcacaaacccaacaaagcaagaatccaacactctggctaactgattgggctcctgagccacgtgatgtatattggcgaaacttagccataccatttgtttctttaagcatccggaagcttgtaataacattgtctgtgtttgccttggtattcttctacatgattcccattgcttttgtgcaatcccttgccaatttggaaggtcttgaaaaagttgctcccttcctcagaccagttatagaattgaacttcatcaagtcctttctacaaggttttcttcctggtttggctcttaaagtatttttgtacattctaccatcagttctgatgatcatgtcaaaaattgagggatatactgcattgtcaactcttgagcggaagacagctgcaaaatattattactttatgctggtgaatgttttcttgggaagcatagtgactggaactgcatttcaacaactgcatgctttccttcaccagtcacctacacagattcctagaacaattggagtttccattccaatgaaggctaccttctttatgacatacataatggttgatggatgggctggaattgctagtgagattctcagattaaagccattggttatataccatctcaagaacatgttcatagttaaaacagaaagagataaaggaaaggccatggaccctgggagtgtggactttccagagactattccaagtcttcaactatacttccttcttggaattgtgtacgctgtggtcacaccgatccttcttcccttcatactagtcttctttgcctttgcatatttggtttatcgtcatcagataatcaatgtctacaaccaacagtatgaaagtgctgctgcattttggccacttgttcacagccgcatcattgcaagcatgctaatatcccagtttcttctattgggattgcttagcaccaaaaaggcagctaaatccacacctttgcttgttatattaccagtattgacatttgcattccacaagtactgccagagacgttttgagccagcatttcggaagtacccgattgaggaagcaatgtcaaaggatttattggagaagagcacagaacctgacttgaacataaaggcttatttggctgatgcttacttgcatccaatcttcaggtcatttgaggttgaagaggaattgattgaaatcgaagtagataaacaacaaactgctgctcctagttctccatcgactgagcctagttcaccctccccaccccatcatctggatcaatcattcccatctcatcatttgcatataccatccccaccccatcatttgcctgaactgtcagcactccatcatttgcctgaactgtcagcaccccatcatttgcctgaactgccaccaccccatcatttgcctcaactatcaccaccccatcatctgcctcaactgtcaccaccccatcatctgcctcaactatcaccaccccatcatatcattgaacccgcactaccacctcaatataatgagtatccaccaggttattactaccaataccatcctccctcccctccccattatgtttatcagtactaagtttagccttgaactcaactcctgcataccaatcaaccagtttgcttgagacttgccgaaaatttagtatttccagtgaacttagatctgttttgggtttttatctatccatttcaagtgtaaatgatttttctccttacatgtaaatggtttggtttcatccaaatgtggggtagcaggattttactttgagcaagctcctaggaagatgtgaatgtttgtcaaaacaatttattctggttaataggttattattatcattacctagaattttgcttttatgaaa

SEQ ID NO: 22 - DNA, 2872 bp, Brachypodium distachyon
tttagggccactctcgcctgttcctctaccccctggccatttcttcgcttccccagcattttctctgtttccgattaatttctccattgttcttgcgaagggaacttgacagggcttaatctggtggtcacttatgcttgaagagatggtggtcgctgtggagaatggggtaaagatggaatccgccgccgccgccaccactgacgccgacgccgattctcctatttccgttctggaggacgagaaaatgtccgaatccaaggatgaaaaagccagtcgttttgtggatgcgagcacgtccctgcctgttaagttcgaggccaacggtggtgaggtgcatcccatagtccaggcgctgaatgctgaagaggcgctattgcaatcagtcaaagttgagactgctgatgagtatttggatgctagtacttctcttcctattgacctcgaggccaagaacggtgatgcatccttcattactgaggtgatgtcaaaggaggaagaacaattatatcaggcccggcttaaggaagaagaggaagaagaggaggccaaaacgaaagaagctgcaaaacatgcttttgatccgaaggcacggtttagcaagttggatgagctgctgacacagacacagctcttttcggaatttctactggaaaagatggagcagatcacagataaaggtgttgaagttaaagatgaagaggaacctgtggaagagccgcagaaaggacgtggcagaaagaggaaagcgaattctaagccacagtacaatgataaaaaggcaaagacagcagttgcagccatgcttacaagatcacaggaagatcgttctgctgatgatggtattctcacagaagaagaaaagtgtgaaatagagcaagccaagcttgttcctttaatgactggtggaaagttaaaatcttaccagattaagggtgttaagtggttgatatcactctggcaaaatgggctaaatgggatactagctgatcagatgggccttgggaaaacaattcagacaattgggtttcttgcccatctgaaagggaatggtctgcatggtccatacatggttattgctcccctgtccactctgtcgaactggttgaatgagatatcgaggtttgttccatctctaactggtctgatttatcatggagacaaggtgactcgggcagagctaaggagaaaatttatgcccaaaactgctggtcctgattttccgataataatcacttcatatgagatagctatgtcagatgcaagaaaagttctttctcattataagtggcagtatgttattgtagatgaggggcatcggttgaaaaattcaaagtgtaaattattgagtgagttaaagcacattccaatggataataaactacttttaactgggacacctcttcagaataaccttgcagagctgtggtcgctcttgaacttcattttgcctgatatattctcatcccatcaggagtttgagtcatggtttgatttttctgggaaaggagacgaggaacaacaggaagatactgatgagaacaagagagttgttgtttcaaagcttcatgccattttgcgtccattccttttaagacgtatgaaggaggatgtagaacagatgcttccaaggaagaaagagataattatttacgctaacatgactgaacatcaacgtcaaatccagactcatttgattgagaagacattcgacgactacttgcttgggagcgcagatattgtgttgagacctggcatgaaggcaaagctgaataatctaatgattcagatgaggaagaattgtgcccatcctgatcttttcaatgctgcatttgactcaacaggcctctacccacctattggtaagcttctggagcaatgcggcaaatttcagctgttcaacaggttgctggattctctactcaaacgaaaacacaaggttctagtattttcacaatggacaaaagtcttggacctcatagcttattatttggatacgaaaggcctggaggtttgccggattgatggtggtgtcagattggaagagaggaggaggcagatagcagagtttaatgacttgaacagcagtttgaatgtcttcattctaagcacacgtgctggcggtcttggtatcaatcttacttctgctgatacctgtatactgtatgacagtgactggaatcctcaggctgatttgcaggccatggatcgatgccaccggattggtcaaacaaaaccggtgcatgtttatcgcctggcaacatccaattctgttgagggacggattattaagaaagcttttggaaagttgaagctagagcacgtcgtgattgggaaggggcagtttcaacaagatagagccaagcctaacgccttagatgaggcggagctgctagcgctgctcaggaacgagcaggatgaggaagacaggatgatccagacggacatcagcgatgaggaccttctgaaggtgatggatcgcagtgatctcacaggccctcctggtgccgtcgatgccacccctcttgttcccctcaaagggcctggctgggaggtcgtggttgcgtccaagagcggcggcggcatgctcacagcgctcaccagctgagacctgtcccagcccagcactgtagtgacgagtgacgacgcctctctttttcggtgcttcggcttgttcaccgggaattagccgatgtttcgtaacaacaatatattagcctccctaagtaactatccacccggcgtcgtcaccctactagattagaactgatcttttggcgagctatgttctttctaactttaagctcgtgcctccttccaaggcaggctatgatgtaagactgttattggtagtctatgctgaaggaagttt

SEQ ID NO: 23 - DNA, 1968 bp, Chlamydomonas reinhardtii
cctcagctcatatccacacaaccagacacatactgcagccatttcaaagcagagcagcagacgcgataccaggttgccgaccactgctccactcgagagtgactcttgtttggtccaaactcatcgtgctccactcgagagtgactcttgttttgtccaaaatcatcgtaagcagctgatcgcctcgttgcaagcttccgcgtcgttgtaaatggacccagcgaagattcgcccctcgtccgcgtacaacaccccctactggaccaccaacagcggtgcgccggtatggaacaacaacaactccatgacagtggggacgcgcggtcccatcctcctggaggactaccacctggttgagaagctggcgcagttcgaccgggagcgcatccccgagcgcgtcgtgcacgcccgcggcgctgcggcaaagggcttcttcgaggtgacgcacgacatctcagccctgacggcggccgacttcctgcgcgcgccgggcgtgcagacgcccgtcatcgtgcgcttctccactgtggtgcacgagcgcggctcgcccgagaccctccgcgaccctcgcggcttcgcggtcaagttctacacacgtgagggcaatttcgacatggtcggcaacaacatgccggtgttcttcatccgcgacggcatgaagttcccggacatggttcacgccttcaagcccaaccccaagagccacatccaggaggcctggcgcattatggacttcctgtcgcaccaccccgagtcatgccacatgctgacgttcctgctggacgacgccggcatcccgctcaactaccgccacatgccgggctttggcgtgcacaccatgaagctgatcaacaaggccggccgcgagacgtatgtcaagttccactgggtgcccaagtgcggcgagaagtacctgctggacgacgaggcggtgatggtgggcggagccaaccacagccacgccaccaaggacctgttcgacgccatcgcagcgggcgactacccggagtgggcgctcatggtacagaccatggaccccgcggacgaggacaagtttgactttgaccctctggacgtgaccaagacctggcccgagtcgctgttccccatgcagccggtgggccgcatggtgctcaaccgcaacgtggacaacttcttcaacgagaatgagcaggtggccttctgccccgccatcatcgtgccgggcatcggctacagcgatgacaagctgctgcagacgcgcatcttctcctacgccgacacgcagcggcaccggctgggccccaactacctactgctgccggtgaacgcgccgcgcgccccccaccacaacaaccaccacgagggcttcatgaacttcatgcaccgcgacgaggaaatcaactacttccccagcaggtttgacccggtgcgcaacgcggagcgggtggctgccgtgtcgagtgcgccgctgtctgggcgccgcgagaagatggtgatcgccaaggagaacaacttcatgcaggccggcgctcgctggcgcgcgttcgacgcggcgcggcaggagcggtttgtggtgcgggtggcggacatgctggcggacccccgctgcacgcaggagatccggcgcatctgggtgggctactggtcccaggccgacccgcagctgggcgcgcgcattgccgccaagctgcagggccgcggctgcctgtaggtggccggtacaatcagatggtatggcctggtgctggcaaattgtgtcagctgccgtgtgaagggtggacaccctgggttgtacagtgaacgggacagtaaccgggaacatgtttagggagcccatccgattgatggtaggcttggcaggaggctgcaggaaaactgatcgtcattagcacagagcgaggtagcccaggctggagatgatgtgttgctgactgctccgtgcactgcgtaatgtacatgttgtcatgtaagctataagccgctgca

SEQ ID NO: 24 - DNA, 1334 bp, Chlamydomonas reinhardtii
ctacttacctagccctgtgctagaagtctcttgtgtatttgacgtgtggccttgaaacccacaacatcaaaacaacgatggccgcttcctgccttcggccggcacccacggcctcggcgcagatgatgactcgctcgccagtggctggcttgccgcgcccttgctcagctctccagcgctcaggatgcacgcttcaaggggcatttggaacgtttgcgccccagacaacccggacgttcgtggtgacctgggccaaagggggcgtaatggacgcacccacaacaactcaacagccggccagcggggttgagcgcagccagaagcggccacctatctataaagtcctcctgcacaatgacaattataacaagcgcgagtacgtggtgaaggtgctgctgaaggtggttgagcagatcaccgtcgatgacgcggtgacctgcatgcaggaggcacacgagactggcgttgcgctggttgttgcctgcccacaggacaacgcagagcgctactgcgagggcctgcgcctcaacggactcacgtcgaccattgagccgggtggctgctaaagccagcgggcatagagtgccgccctgaaatttttggtgccatagcgtggccaactaggggtggcgttctgggcaggactcggaagggagcagtggcagtggcagctgagcgaaatcctccgtgagtacggtactgacgcactccgcacggcggagtgcgatgtatactatgcattacgtttgcgtgttcgaagagtgacgggatgagtaatgcctattgtaagaatgagtagaggcgagtgagcagcgcgccgatggggtgccccagcacgcacagcaccacgcactttcgccttaagtatgttcatggtccgtactgagcgcccacgccactggtacggcctgtagaggaacgtgatccattttcaaacgactgtgagacagatgcgacgggaacgtgcgggtttatgtttgtggaatggtgccaaaaacaggatacggtgctgatacggctgagcgtgtctagcgaagtgttcgaagctttctttgctttggtggtgcttgagcggtgcggggtattgtgtatgctgtctgtgtgagaagacgctagaagatatcccgaatgagaggagaggcaggcaatgagtttgtttagccaaggagaggcaggcaatgagtttgtttagccaaggatgacacggcggagaagggacagacatgcggaatccgtcatcagacggttcagggttagggggcccttgtatacgcacgcacgggtttatgaagtggggcagccggaatcaactggtcaacagaagtatagcactt

SEQ ID NO: 25 - DNA, 2290 bp, Chlamydomonas reinhardtii
cttcaaacacagtcagggtagtctcgactgttacataccattactcgggagcagcgacgctgccctctgtagcaggacgcgacttcagatcgcattgaacttgagtcctgagtctctcgggaagccccagcttaccggatctggtctaggagttcaggacaaggacaaatggcgggcttccggccgctaaacctagtgcggccgttcctctcggtgctgcccgatgtgcagcaagccgaccggcgcgttcccttcagggagaagttcctctacaccgcggttacgctgttcatcttcctggtctgctctcagctgcctctttatggcatcaagaccaacagcagcagcgaccccttttactgggtccgtgttatcatggcgtccaaccgcggcacctgtatggagctcggtattagtcccatcgtcacctccggcctggttatgcagctgcttgctggttccaagattatcgacgtcgacaacagcgtgaaggcggaccgcgagctgctgaacggcgcgcagaagctgctcggcgtgctgatcaccattggcgaggctgtcgcttatgttgtctccggcatgtatggcgacgtgcgtgagctgggcgctgtcaacgctattctgattattactcagctgttcatggctggcatcatcgtcatctgccttgatgagctgctgcagaagggctacggcctgggctcgggtatctccctcttcatcgccaccaacatctgcgagtccatcatctggaaggcgttcagcccctacaccatcactggcccccgcggtgctgagttcgagggtgccatcatcgccatgttccacctcctcatcacccggtccgataaggtccgcggcctgaaggaggctttctaccgcactaacctgcccaacatgaccaacctgatggccaccatcctcatcttcctggtggtcatctacttccagggcttccgcgtcgacctgcccgtgcgcaacaagcgcgcccgcggccagcagggcaactaccccatcaagctgttctacaccagcaacatgcccatcatcctgcagtccgccctggtgtccaacttgtacttcatctcccagctgctgtacaagcgctacggcggcaacatgctggtgcagctgctgggccgctggcagcagaccgagtacggtggcggccagatgatccccgtgggcggcctggtgtactacatctcgccccccagcagcctgaccgaggtggcgcaaaacccgctgcacgcgctgttctacgtgaccttcatgctcactgcctgcgcgctgttctccaagacctggattgaggtgtcgggcagcagcgccagcgacgtcgccaagcagctgaaggagcagcagatgttcatccagggccaccgcgacaccaccgcctccctgaagaaggagctgaaccgctacatccccattgccgcggccttcggcggcatgtgcatcggcgctctgaccatcgtggccgacttcatgggcgccattggctcgggcaccggtatcctgctggctgtgaccatcatttaccagtacttcgagacgtacgagaaggagaaggcccaggcgcctggctctctcttttaagcttctttccggactgctgccccacgctttggcgcacctgatgacgggagccgcgacgctgcacgcggagagcggctgacgccaggtggcgaggtggtggtgtcactagacgcgggggcgtgcggggcagtcagcgtgcgaggaatgttgcaaatggggcaaggaaagagcggtgctgccagcgctctgtatcttgcgcctgtatggccgcatggttacctgtggcggacctcgaggtgactgacctcttagttgcacgtgactgatgtagctatggcaggcggttcctgctgctgcgacagaggtttggacatactgacgaccatgaccaaccaaactaggttttgactccagacagtgtagcgtgcgtggcagtaaaggacccgccgaaatgggccggtctgcagaaattacttttcgtgtgggtgtgtgtggtgtcgtgagtgcaacagaaagggcgccaacgtcgccttctcccacttgtttgggtaatagtgggagcagcatgggtagcaggctgtagacctgattaattccaggtgccatcgatgattcggaggctagcagaatagacacacatcgaaagggcttctcacatgaagcccataactagatgaagcggaggcaagcgagtgcactgtgattggagggtgcatcgtgatgtgggcatgcatgtaatgctttcctcaag

SEQ ID NO: 26 - DNA, 3868 bp, Chlamydomonas reinhardtii
ctcccagcccttgcatagtcagggtaccagttttgcaaaaatgagacgcagcgctgctcgcctgctgcgtggcgttggccaggcggtcgcccgctcgggcgaggtcgccgaggcgtcggctgtgaagctgttcgacatcaacgccagccgtggactgtcggcgcagacgttgagcatgctcggcgctctgagccatgcggccacgcccctgccgagcggcttcgctgccagcggtatccgctccatttcggtcgcggcgctgcagccgagcgatgacttcaagccgcgccacaacagcggcacgcccgcggaaattgactccatggtcaaggccacgggcttcggctcgctggacgcactcattgatgcaacggtgcccaaggcgatcgtgcgcaaggacggcatgaacctgggcaagtaccacgagggcatgaccgagagccagttcctggagtacttcaaggccatggccagcaagaacaaggtgtacaagtcgtacatcggcatgggctactacgggacgcacgtgcccaacgtcatcctgcgcaacgtgctggagaaccccggctggtacacgcagtacacgccctaccaggcggagatcgcgcagggccgcctggagtcgctgctgaacttccagacgatgatctgcgacctgaccggcatggccatctccaacgcctcgctgctggacgaggccacggccgccgccgaggccatgaccatgtgcagcgccatcgcgcgcggcaagaagcccaagttcctggtgtcgagcaagtgccacccgcagaccattgcggtgtgccagacgcgcgctgagggcctgggcctggaggcggtggtggtggatgaggacaagatggcgtacgccaaggacgtgtgcggcgtgctgctgcagtaccccgccacggacggctccatctcggactacaaggcgctggtggcgaaggcgcacgccgccaacgtcaaggtgtgcgtggccaccgacctgctggcgctcaccatgctggcgccgcccggcgagtggggcgccgacatcgtgatcggcagcgcgcagcgcttcggcgtgcccatgggctacggcggtccgcacgcagccttcctggcctgccacgacgagttcaagcgcctcatgcccggccgcatcatcggcatgtccatcgacgcgcagggcaagcccgcgctgcgcatggcgatgcagacgcgcgagcagcatatccgccgcgacaaggccacctccaacatctgcacggcgcaggcgctgctggccaacatggctgcgctgtacgcggtgtaccacggccccgagggcctcaagaccatcgcgcaccgcgtcaacggcctggcgtccgtgttcgccgccggcgccgccaagctgggccacaccgtgccgtcggcgcccttcttcgacaccgtgtcggtcacggtgaaggacggcgacgccgacaagtacgtggcgctggcgctgaacgagaagatcaacatccgcaagctgagcaagaacaccatcagcctggcgttcgacgagaccagctccgtggcggacgtggacgcgctgctgcgcgtgctcaactgcggccgcgacgcgcccttcaccgccgccagcctggcgccggcggttgagggcggcgtgggcggcttcgcgcgcaagagcaccttcctgcagcagcccatcttcaacacctaccacaacgagcacgacatgctgcgctacctgaagcggctggagaacaaggacctgtcgctggtgcacagcatgatccccctgggcagctgcaccatgaagctgaacgccacggcggagatgatgcccatcacctggcccgagctggcggcgctgcaccccttcgtgcccgtggaccaggccgagggctatgcggagatgttccgcgacctgtcggcgcagctgtgctccatcaccggctttgacgccatgagcctgcagcccaactcgggcgcgtccggcgagtacgcgggcctcatggccatccgcgccttccacctgtcccgcaacgagggccaccgcaacgtgtgcatcatccccgtgtcggcgcacggcaccaaccccgcttcggcggtgatggcgggcatgaagatcgtgaccgtgtccaccgacagccagggcaacgtgaacatcccggagctgcgcgccaaggcggaggagcacagcaagaacctggcggcgctgatgatcacctacccctccacgcacggcgtgtacgaggacggcgtggacgagatctgccgcatcatccaccagcacggcggccaggtgtacatggacggagccaacatgaacgcgcaggtgggcctgaccgcgcccggcctgatcggcgcggacgtgtgccacctcaacctgcacaagaccttctgcatcccgcacggcggcggcggccccggcatgggccccatcggcgtcaaggcgcacctggcgcccttcctgcctacgcaccccgtggtgcccaccggcgcgctgccgtcgcggcccgccgaccccaagcccttcggcaccatggcggcggcgcccttcggctcctccctcatcctgcccatcagctacgcctacatcagcatgatgggcagcgccggcctcaccatggcctccaagctggccatcctcaaggccaactacatggccaagcgcctggccggccactaccccgtgctgttcaccggccccaacggcacctgcgcgcacgagttcatcctggacctgcgcccgctcaaggagaccgcgggcatcgaggcggaggacgtggccaagcgcctgatggactacggcttccacgcgcccaccatgtcttggcccgtgcccggcacgctcatgattgagcccaccgagtccgagtccaaggaggagctggaccgcttctgcgaggccatgatctccatccgcgaggagatccgcgagatcgagagcggcaaggccgacaaggccaacaacatcctgaagcacgcgccgcacgcgccgggcgtggtgctggcggacaagtgggagcgcccctacagccgcgagcgcgctgccttccccgcgccgtgggtgcgccaggccaagttctggcccaccgtcagccgtgtggataacgtgtacggcgaccgccacctcatcacgcggtgggataacggcacctctgccgaggccgtggccgcgcacgcgtaagcgtgagcgcgagcgtgggcttaagcggcggttgcggtgggaccctacggcggctgtggcggtggcggttggggcggtcgtggcggtggtggtgatttgcgaggcggagctggaggtgggggcttgtctgtgacacgaataagagcctggaggcggggagaggagagtgttgaaaggagaggtctggtgcgctttccaggaggttcggacggtccggtgtggtgcaatttaagcccacccggtggcagcatttacagcggtggcaggtggcaaagagagtcagtttgccatgatgcatgggccacggagaattgagagcaggttgagtagggccggtcgtgccagatctgcgaggtgtaatcgcgtaggtaggtcatatcatttagttttggtatcgtgtacgggcgtagtgtgcccgcagttttgtcttgtcgcggaatgtgggtggatccatccttgagtggtgaccaacagactcaggtgtgcccaaatgttgttagttggggacagcattctaccgaaggtgcatgctgaggccccaatgctattgattccgtgagctgtgctgtgcaaggttggtttggcggaacgcgcgtagtcaggcgcagccccaggagtgttgcgctcgtgcgcgtcctgtgctgccgcgtgtgtaaaggcgcctggacagtgcctggagcgagcatacccataaggccatacgttttg

SEQ ID NO: 27 - DNA, 5278 bp, Chlamydomonas reinhardtii
aagttgaattgctatcgttgtcatacattttaattaggtagcttccagtatgcaactttagccctgtgtcactggcgaatcgtcgagaatgcgcaactcgtcgaccttactgcgttcggcattcgcccgccggggcacgcacttacaacagcagagtgcgctgtgggagttgcatcgcgcccgatactcgacgaacgacgatagtaatcgcgaggaggggggcctgctcaacaagatctggcgggccgggctcggccagaagccgaaggacagcagcagtagcagcagcagcgctgccggaggcagcagcagtagcagcagtagctctcgcagcagcggcgccagcagcggcgatgcgctggtgcccagtggcccggagcggcggcaccacaaggtgtttgtggtggagctgtctcgcaagccgctgttcccgggcatttacacgccagtcatcattagtaagaacgaggcgctggtgaaggagatcatggacgtcaagaagcagggcgcccacgcctacgtgggtgcgttcctcaagcggccggagccgccgctgggcatgacggccgccgccgccgtggccgccgcgggggagacggaggtgcgggacgccgcctcccacctgtacgacatcggcacgtttgcgcaggtgcacacagtgctggcgggcgacagcgccgactcggcgcagctgctgctgctggggcaccgccgcatccgcaagaccggagtgatctctgcggaccccctgcgtgtgcatgtggaccacctgcgtgatgagtcctacaccagcgatgacatcctcaaggccaccagcatggagatcgtgaacaccatgcgcgacctgctgcagctcaaccccctgtacggcgagcagttcaggacgctgctgtcgctcaccggcagtatcgacctgcaggacatgagccgcctggtggacgccgccgcctcgctcaccagcgccgacgacaccacactgcagacggtgctggagacactcaacgtgccggagagggcccggctggtgctggggctgctgaagaaggaggtggagctgtgcaagctgcaggcggacatccgggagcaggttgagggcaagatcgtcaaggagcagcggcgcatgttgctgatggagcagctcaagagcatcaagaaggagctggggctggagcgggacgacaagagcgcgctgctgcagaggttccaggcccgctgggacgagcgcaaggcgctggcaccccccgacgtggcgcgggctgtgcaggaggagcttgacaagctgggcggcctggagccggtcagccccgagttcaacatcacgcgcacctacctggactggctcaccagcctgccctggggcgccaccacgcaggagctgttcgacctggtgcgggccaagaaggtcctggacgacgaccactacgggctggaggacgtcaaggaccgcatcctggagttcatcgcggtgtcgcacctgcgcggcagcgcccagggcaagatcctgtgcctggtggggccgcccggagtgggcaagaccagcatcggcaggtccatcgcgcacgcgctcaacaggaagtactaccgcttcagtgtgggcggactgcacgacgtggccgagatcaaggggcacaggcgcacctacgtgggcgccatgcccggcaagctggtgcagtgcctcaagagcacgcagagctccaacccgctggtgctcattgacgaggtggacaagctgggccgcggccacagcggcgaccccgcctcggcgctgctggagctgctggacccggagcagaacgccgccttcaccgaccactacctggacctgccgctggacctcagcaaggtgttgtttgtgtgtacggccaactcgctggacaccatccccggccccctgctggaccgcatggaggtcatacggctgtccggatacgcacaggatgagaagcgcgccatcgcgcggcgctacctggagccggccgccgccgccgacgccggcgtgccgcccgggtctgtgagcctggcggacgacgcgctggaggcgctgatcggcgagtactgccgcgaggcaggcgtgaggaacctgaagaagcacgtggacaaggtgtaccgcaaggtggcgctgcagctggtgcgggcgggcgccaaggtgatcaggctggacgaggaggggaaaacaccccagcagcagcagcagcagggggaggcggcggtggaggcgggtgccgggagcagcagcggcaccgccgaggcttccaccagcacgagcacccctagcagtaccagcagcaccgccaccaacaccgacagcaccaccaccaccagcaccgccaacagcaccagcagcaagccggctcccaaggtgcgggtggagtacgacgggccgcccatcacggtgcaccgcgcgcagctcaaggactacgtggggcaggcgccctttgcaaaggacaagttctacgagtccacaccgcccggtgtggtgatgggtctggcctggacgcctctgggcggcgccacgctgtacgtggaggcggcgcgggtggcgggcagcgaggcgcgcggcagcctcaccaccaccggtcagctgggggacgtgttccgggagagcgccaccatcgcgcacacctacgcacgcaacttcctggcggcccgcatcgccgacggcaccattcccgccggcgccgccgcgtcctcgccctcggacgacacgccggcctcgtcaccctcggacgccaccacggccagcagcagtagcagtgccagcagtggcagtagcagtagcagttccgggaagcagcagcagcagcagccgcagctgccctccgggcccggctccttcttctccagcggcgcgctgcacgtgcacgtgccggcgggcgccacgcccaaggacggccccagcgcgggctgcacgctggtgacggcgctgctcagcctggcgctggaccggcccgtgcggccggacctggccatgacgggcgaggtgactctgacgggctgtgtgctgcccatcggcggcgtgaaggagaaggtgcttgcggcccggcgcagcggcgtcaaggtggtggtgttccccgagggcaacaggcccgagtacgaggagctggcggaggacatcaagcagggtctggagccgcacttcgtgagcagctacgaccaggtcttcaaactggcgctggagcacgacagcggcagcggcaacgcggacaaggccaagcaggaggcgccgctgtccacgagcgcatgaggtggtcggcggggggcaacaccgagcgagcgcgtgcgaggatacggagggggccacgtagtcagtgtcgagtcgtctgtcgctgcctagcctgacaccgatggacgttttgaattgggctgaaatgtgcattcatgtgtaattaattgtcgcttttccagtatttccacccttcgcaaccggttacggccgagcggatccaagccatacggaatgccgagacgagactcactgcgagcaactttgcgtactcgaaacttgctcaaggtgtgcgtacatgaaaatctgcatatgtactcagagcgtaggcgctaggttacggactcgcgtgctagccccgaaatgattcggactcgcgtagggttgagaggtacaaggtgaagcacagacgattaatgaggacaagatagcggaaaatgagtgaacccttgttagttttcgacccacagccggtccacatattgctgttagtgtttggcctcttcacaattgttttcgcgactttcgggcgcgtccttaaggcatcttcatagcggccgcggcggtcatgaccactgcgctggagctgcccacgggtctggtggtacggcaatggcaggcgctgctgctgctgctgggacccgtgctggcggcgggcgtgcttgattggcgcgtgtgtgacggccacagaccctgtgctggcgcacgctatcgtgcaaggcacctttgctgagacgctgctgccgggccggctgcgcgacctcatgtccgccgagtccgccgccaacgacggctttgcctaccccttcgtgatgctgcccgtgctgctgctcacacagcccgccacaccgcacctggcggcagagtacctggtgactgtgtggctgtgggagattatcaccggctgcgtcatctgcggcctcatcggcttcatcagcggcaccatcctcaaatgggcggaccgcaagggctttgtggagaatacctcgctcgtggggtacagcatcgtgctggcactcagcgtgctgggcgcgggccgctgccttaacatcaacgagatattgggctcctttgtggctggcgtcgccttcgcgtccgcactggacgcacgcgaccgcatcgccgagctgcagatccaggagactgcagacctgctgctgggcaacttgttcttcctggcgttcggcgcctccatcccctgggacagctggggcgacgtgggcttcggggcgggccagatggtgggcgtggcgctggcggtgctgggcctgaagcggctgcctgtgctgctggcggtgtacaggttgatgcccagcggcctccacacggtggcggaggcggcacacttcggctggttcggcccggtgggggtggcggctttcttttacgcgctggaggtcattgaaaaggtcggcggcgacacgggcgagcgctgctacgtgctgctcacagcagcgggcactgccggcggcgtgggcgggtcaagtcggtacgccatgtatgcgtcacccagcctgcgtgcagcaggtgcggccggcggcacggcacgcgtgtcgtttgcgccgcggcgttaccaccaactggcgaccgcgtcagtgccgctgccggctgctgctgctgcgggtggtgcggtggggaatgggagcatgcaccggaatgggagtcagcagcgagctacagggcggcaggcagcggtgccgcagcaggtcgttgcagatgccgaggcgccgccacctcgtcagccgctctgcggggaggcagagatggtctcagcccgcgcctaatggcgactatgtttactcgtgtttgttggttgctgtcacgcaagactagctagcaggttttagtggtgtggtgcatttagtcgttccgtataagcaggaagactcttgaagtaaatgagatgccttagcaggtgtgtgcatacggcaatgttgcgtgagtgactccctgttggctgacacggcgaaaggacgtacatataaggatacagatacagcactggggtggggttgaccttgggcggtggattggacacacacacaacgcgataag

SEQ ID NO: 28 - DNA, 1480 bp, Chlamydomonas reinhardtii
gaaagcttcaggtgcaaatggtcgcaaatagtacacttccaggtagaaaatacattaaacatgcgtcagtcactgtccagcactagatctgcaagtgcaacaccctcagcgtgctgctcgcggacagccgcgcgcgccgtccacgcaggccgctggctgccccagcgccggcggaacttgacccccgtggcggccgccgcggagggcgggggcggagccgtgctgcgtcaagtgctgacgggccccgagcgcaccaagctcgacacgggcgatgaccggggcttctacgacgtgccgcgactggtcaagcacgtggatgacggcttcctggaccaggtcacggagctgtaccggcagcgtatccccgagggcggcgccgtgctggacctgtgcagcagctgggtgtcacacctgccgcaggacgtcacctacagcaaggtggtggggcacggcatgaacgcggcggagctggcccgcaacccgcgcctggactcgttcttcgtgcgcaacctcaacgccagcccggacggctgggcggcggcggaccagagcttcgacgccgtgctgtgctgcgtcagtgtgcagtacctgcagcagccggagcgtgtgtttgccgaggtgtaccgggtgctcaagcccggcggcgtcttcatcatcaccttctcaaaccgcctgttctacaccaaggcgatttccgcatggcgcgacgcgtcgggctatgcacggtgccagctcgtgaagcagtacttccaggctgtggccgggttcacggcgccggaggtgctgatggaggtacccaaggctgctggcagcgcctcatcagcggcaggcagcggcggcgcgctcccgcagtggctcaagcctctgggccgcttcttcgagcgcaccagctcagaccccttctatgcggtggtggcgtaccgcaacttcaagcgggaatgagctgacagttagagaatcaggcaagcgaggcagccgttgcttgggttgtgcgggcagggggcagcagcgatagcccgtgtgcgggctgcggcatatgcacagacgggctaggcaagggcgccctctggacccgggatgcatgcataggccgtgcttctgtctggctaggcgtttcaggtgtagctatgaacatgcagcagggcccgcaaaagtgccgcagtttcccggtttcccagcttttgagggggccgtgtgaccgcccggcccgtggatactcatgcagttggtatgttttatccggacgagatcctatgctgtactgatgacgtacagtatccctggcagcacatttggagtccctgcagtaccgtacacccgttatccgagtttggcccgtttgcgcccttgcgcacgtagcttggctaagaaccatacgtattacggtatgcgtaacgcgcagtgttgattgtaaaagaaggctgaagtggaggaggctgcaggaggaggctgcatgagtgctatgtaacttgaccagacg

SEQ ID NO: 29 - DNA, 1446 bp, Gossypium hirsutum
ggcacgagcttgcttgcaattgcaagaagcacttcaaacccaaccttctgtttttttctcataaaacctccccactactgatttctctatataatctaatgttctcccgttgttttagccgtctttaacacttttcaatggcttcctcttctgttattgcttggggctcaggtgaagatggtcaattgggtatcggaaacaatgaagaaagagaatgggtttgcgttgttcaagctcttgagcctcacaatgttcgctccgtcgtcgctggcagccgtaattctctcgctatttgtgatgatggcaagttgtttacttggggatggaaccagagaggaaccctagggcaccctcccgagaccaaaactgagaatattccaagtcaggttaaggctcttgctaatgttaaaattgttcaggcggctattggtgggtggcattgtttggctgttgatgatgaaggcagagcttatgcctggggtgggaacgaatatgggcagtgtggtgaagagcctgagcggaaagatgatactggtaggcctttgagaagggacattgtgattcctcagcgctgtgcgccaaagcttgtagttcgccaggtagctgctgggggtacccattctgtagtgctgacacgtgaaggatatgtttggacctggggtcaaccttggccacccggagacataaaacaaatatctgttcctgtgagagtacaaggtctcgaaaatgtgaggcttatcacagtgggagcatttcataatttggctctccaggaggatgggactttatgggcatggggtaataacgaatacggacaacttggaactggggacactcagccaagatcacaacctatacctgtccaaggattatctggtctcactttggttgatattgctgctggtggatggcattccactgcattgactgatgatggagaggtgtatggttggggaagaggagaacatgggaggctcgggtttggagataacgataagagcagtaaaatggtgccgcaaagggttcaacttttagctggggaagatattgttcaggtatcttgtggtggaacacattcggttgcattgacacgtgatgggcgcatgttttcgtttggacgaggtgaccatggacgactaggttatgggcggaaggcaacaacaggtcaacccatggaagtcccgatcaatctgccagctccaaaaagtgttagcggaagtggtgctgaaggatattggatctctaaacttgttgcatgcggaggccggcatacgcttgctatagtagaatggaagaccgatgaatctaagccataactgaagaatgtaatgttctcatatatataaatatagaacttgatgactgaagaacagcaaaaccaggttccatttaaaaagcatgatgaggaataactaaataaatgaacttactgttcacttaaatggg

SEQ ID NO: 30 - DNA, 1486 bp, Gossypium hirsutum
ctcttccttgttcaaacccaaagcttgaaagaccttgtatattcaaataaaaacagagagatcgtcgatcagatttagttgattgatccaaagaatcaaatggaatgaaatgaacgtagagtgagtggatttcagcaatgaaaagcgtcttctcggcgcccggagattacatctacttcaagtcccaagtccctcttcacaggatccccatcggcacgaagcagtggcggtattatgattttggtcccaaagtggttactccactcatatgtcttcctggaactgcagggacagcagatgtctactacaaacaaatcatgtgcttgtccatgaagggctaccgggtcatttctgttgatattccctgtgtttggaatcatcaagagtggattcaaagttttgaaaagttcttggatgccatcgatgttcatcatatacatctgtatgggacatcccttggaggcttcctagcacaactttttgctcaacatcgtcccagacgggttaaatccttaattctatcaaatacatttttggagacacgcagttttgcagcagcaatgccttgggcaccttttgtcagttggaccccgtcttttttgttgaaacgatacgtcttaacaggaatccgtgatggccctcatgaaccttttattgccgattctgtggactttgttgtttcgcaggtcgaaacactctcaagagatgaattagcatccaggttgactttgacagttgactctgcttcagtaaaaccgctactactttcagattcatttattactataatggatacgaacgactactcggcaattcctcaacaacttaaagatcagttgagtgagaggtacccaggtgcaaggcgagcttatctcaaaacaggaggcgatttcccctttctttcccgcccagatgaagttaacctacatcttcagctgcacctgagacgggttggattggaagctcagccagagctggttcagagcatcccaaaagatggcaccggtggaggccccagcaaagaaaatgataaggaggatcgtgatgatgaacaaaaagataatgggggaaatcccgaaagcaattctgaagaaagccagccgtcaccttcggctccggaaagttcagaatctcatggtctagatgaacagctcctcagcaatgccgaaattcattacatcaatcagaaagattcaatcattttgaagccttctgcaatgtcaatgaatcaacacagtgcggctgccggaatcctcctccaatcgacatgggagttctttattttctctttgctgccgttatatgtggattcattatacatttattctaataatgcttggaaattgagacaactggtgtaaatagagcattggttagcagtttctgctcgttgtttatataaatataagctctgttgcaaacagtttctccattgacaatgttgtatctattcagttattttaagttcctcattattgaattttca

SEQ ID NO: 31 - DNA, 2241 bp, Gossypium hirsutum
caactcgcgccgtttcttaacatttttcgcttcaactttacgccacactctcattgtttctctgtcgaaatggaaggctcagtcgaagaaatggcgaaagcagtttccgatttagcattggattcgtctgctgccggtgaagctcagagcaaaaatgctcgtaagaaggaacttaaaaataagcagagggaagaggagcgtcgccgtaaggaggaggagaaagcagccaaacaggctgcagccaaggcaggcacacaaagtcagaaacatgcagccgctgaagacgaagatatggatcccacgcaattccacgagaacaggctgaaatttcttgcagcccaaaaggcagaggggaaaaatccatatcctcataaattcttcacatcaatgtctattgttgaatatatagagaaatatggaagcctaggcaatggggagcatattgaggatgccacagtatctttagctgggcgaattatgagcaaaagagcatccagttcaaaactttttttctatgacttgcatggcggtggtgccaaagtccaggttatggctgatgcgagcaagtcaggcttggatgaagctgaatttgcaaaattccattcaactgtgaagcgtggagatatagttggtgtcactgggtttccaggcaaaactaagagaggagagttgagcatttttccaatgtcatttttagttttatcccattgtctccatatgatgccaaggcaaaaagcaggccctgatgccagcgtgaagaaaactgatgtatggatcccaggaagtactaggaatcccgaaacgtatattttgaaggatcaggaaactcgttatcgccaacgttatcttgatttgatgttaaaccttgaggttcgtcaaatattcaagactcggtcaaagatcatttcttatgtgaggagctttcttgacaatcttgatttcttggaggttgaaactcccatgatgaacatgattgctggaggtgcagctgcccgtccatttgtaacccatcacaatgaattaaatatgaagctctatatgcgtattgcacccgagttatatcttaaggagttagtagttggtggactggatcgtgtgtatgagattggaaaacagtttagaaatgagggcattgatttgactcacaatcctgaattcactacctgtgagttctatatggcttttgctgactataatgacttgatggagcttactgaaaaaatgttgagtgggatggtcaaggaacttacaggcagctataaaattaaataccatgcaaatggccttgacagtgctccaattgagattgatttcactccacctttcaggaggcttgacatggtagaggagttggagaagatggctaacctcaacatacccaagcccttttccagtgatgaaactaacaagtatttggcagatgcatgtgaaaagctcgagattaaatgccctcctcctcaaactacagcacgtttgttggataaacttgttgggcattttctagaagagacgtgtgtgaatcctactttcatcatcaaccatcctgaaataatgagtcctttggcaaaatggcataggtcaaaaccggggctgactgaacgatttgagctgtttatcaacaaacatgaactttgcaatgcatacactgagttgaatgatcctgttgtacaacgtcaacgatttgctgaacaactgaaggatcgacaatctggtgatgatgaagctatggctttagatgaaacattctgtactgcacttgagtatggattgcctccaaccggtggttggggattgggtatcgatcggctagctatgctattaacagattcacagaatatcaaggaagttcttctcttcccagccatgaaacctcaggatgaaccatccactaaagctccagcaacttagggagttgaacctgccgaaatctgactcatcgccgtgatctagtatgtttactgtaaaccagtggtgagatctgtcaacttttttggcgtagattttgtcttgaaagaaatattgcaattgacattcaaccctcttatgtatttgctagtatagataggtgttttatcatacacgctagaagtcacgtcaggtcacctccatccattgtttatgattaccttaactgaatataatatagtcatgtctcatgtggagtggaaccaaaattgaattcagaattgtgtggaggtgtagtcaggcatttttcttagttaaatcgcagcaactattttc

SEQ ID NO: 32 - DNA, 823 bp, Gossypium hirsutum
acccgcattgataaacaaagatcatcaaatcagaatcatcctcaaactgttcaacaatttcgtctcccgttaccaaatttccccattaaaaccaaaaatgagaatcccaaatctcaccaaagcctttattttgttaatggcaataactctgatgtcaacccaagccaacagcctaatcccttacagtagatccttatgggacgtgatgctcgctgaagacccattcaaaatcctggaacaaaccccagtgaccgtccccaaaggatcagaacccgtcgctttagctcgagccgactggaaagaaaccccacggtaccatgccattaccctggacatcccagggatgaaaaaggaggatttgaagatcgaggttgaagagaacagagtgttaaggatcagtggagaaaggaaagaagaacaagaaattgaaggagagaaatggcatagagctgaaaggacgaatgggaagttttggaggcagttcaggttgcctgcgaatgtggatatggatcgcatcaaagctcatatggaagatggggttttgaggatcagtgtgcctaaaattgtagatgagaataagaagcaggctaaggtgattgacattgttcagtcgggtggtactggtgaagatatcaaggcaacctcccagggtcatcagtagatatttgattgatctaccaggtttttgatggattgatttcgggttttcatcgtttcgcctacttatgtaataataagttgatgtttatgtgtttggttgaagtatgatgaaatggtgatgcttaatttcaatattattaatatattagtattaagtacatgt

SEQ ID NO: 33 - DNA, 1921 bp, Gossypium hirsutum
acacaaattctgtgccaaatttcaagagcaaaccaaaaaaaggctgcaatttcagcttttcaatatttgcttttgatcaatcgaaatggcttcacaagattctcaaatgccttcttcatcacccctttcttccaataaggatgaaatgcgtcccaaagccgattttcagcctagcatttggggagatctcttcctcaattgtcccgacaagaatattgatgctagaactgaaaaacgccaccaacaattgaaagaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacaccacatctcttcgattccgactactccgagagcatggatacaatgtttcatgcgacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccaccaaccatttaagccttgcagtatcatctttggaccatcctttgtccgaagaggtttctcatgctttgaaacaatcaattcgaagaggcttgccaagggttgaggcaaggcactatctttcagtataccaagatattgagtcccataataaggctttgttggagtttgctaagatcgacttcaacatgttacaatttttgcataggaaagagctaagcgagatttgtaggtggtggaaagatttagactttcaaagaaagttgccatatgcaagagatagagtggttgaaggctatttttggatctcaggagtgtactttgagccccaatattcacttggtagaaagatgttgacaaaagtgatagcaatggcatctattgtagatgatacatatgactcatatgcaacatatgaagagctcattccatatacaaatgcaattgagaggtgggatatcaaatgcatagatgaacttcctgaatacatgaagccgagctacaaggcactattagatgtttacgaagaaatggaacaactggtgcctgagcatggaagacaatatcgtgtcgaatatgcaaaaaatgcgatgatacgacttgctcaatcttaccttgtggaggccagatggactcttcaaaactacaaaccatcattcgaggagtttaaggctaatgcattgccaacttgtggttatgccatgcttgctattacatctttcgtcggcatgggagatatcgtaacaccagagacctttaaatgggcagccaatgaccctaagatcattcaagcttccacaattatttgtaggtttatggatgatgttgcggaacacaagtttaagcataggagagaagacgattgctcagcaatagagtgttacatggaagaatatggcgtatcagcacaagaggcatacgatgtattcaacaagcatgttgagagtgcttggaaggatgtgaatcaagagtttctgaaaccaacagaaatgccaacagaagttttaaatcgtagcctaaaccttgcaagggtgatggatgtactttacagggaaggagatggatatacatatgttggaaaagcggctaagggtggaatcacttcattgctcattgaaccaattgcactttaaaattatgttaatttttcctctccaagcttgtttcctaagaaatagttattaagttctaattaataatgttttataatattcatatattataaaagaaagtccaaatctattgtctttgtacttattggcttatattaattcaataaagttctttccaaacttttcattgtg

SEQ ID NO: 34 - DNA, 1227 bp, Gossypium hirsutum
ccattagctactgccagaaaatccaagcatcaatcttgcaaagcaaagcgtttgctaatggagggtctgatgcaggtgccttatgatgttacggttaggttcatgttgaccttcttggagcgcaatttgttgcctgatgctattatacggaggttgactcggcttctcctggctagtcgtcttcgttctggttataaaccctccactgaactccaactctctgatctccttcagtttgctcattccctaaaggagatgcctatagctatcaagacagacaagcctaaaactcaacattacgaactgccaacctctttcttcaagttggttcttgggaagaacttcaaatacagttgctgttacttttctgatgagtcgaaaactttggaggatgctgaggaagcaatgttggaactgtactgtgagagatcgcaattaaaagatggccaaacggttcttgatgtggggtgtggatggggttcactttctctatacattgcccgtaaataccccaattgcagggttacagggatttgcaattccaccactcagaaagcttttatagaggagcaataccgggatcggcaattgcaaaatgtggagatcattgttgcggacataagcacatttgaaatggaggcatcatacgacaggatatattcgattgaaatgtttgagcatatgaagaactatcacgatcttctcaagaagatatcaaagtggatgaaagaggatagtcttctttttgttcattatttctgccataaagcatttgcttaccactttgaggacataaatgaagatgactggataaccaggtacttctttacaggaggtacaatgccttcagctaatctgcttctatatttccaggatgatgtttctgttgtcaaccattggcttgtgaatgggaaacattatgcaaaaactagtgaagagtggctgaagaggatggaccgaagcttggcttccattaagccaataatggagtccacctatggcaaggatcaggctgtgaaatggacagtgtattggagaacattctttattgctgttgcggaactctttggatacaataatggagaagaatggatggttgcagttttcctattcaagaagaaataaagccgtcgtcaatgctcgtagtcaatgctcatttccaccaagaatcagctttgggcattaggggactaaaataagagcaactgtagaatcgctgaaaatttt

SEQ ID NO: 35 - DNA, 796 bp, Gossypium hirsutum
gaagtcagtcagtcggtcaaacaattaaattcctcttcagctttagcttccacttccacctaacatttccatcttcccaatctttcctcctccatcggcccgtggtctttgacttctccggctacgccgtttacaaagagctacattcagcaatatttgtaacagatggcttcttccttccgagcattcctaaacagtccagttggcccaaaaacaactcacttttgggggcctgttgcaaattggggttttgttctcgctggattggtggacatgaataagcccccagaaatgatttctggcaacatgacatcagcgatgtgtgtctattctgcattattcatgaggtttgcatggatggtacaaccacgaaactatctactgttggcgtgccatgcttcaaatgagacagtacagctctaccaactctcccgttgggcaagagctcaagggtatttgtcggagaagaaagacaaagctacattgcagtaaagcagcttcagttggagctagctgcttttcgtttctttccattccaagtgtctgtgagttttattgtgatctgtgaagattgtagtattctgaacttactattaaagcattcattttgactgctaaaccaataatgattgttggagtgcatcttgattggccctataatgtgttctgaatcttgattttacctgttaaaaaggtaaaattagcttagagttacaatcactgttgatttgggcatcaagtcatgtttttaataaatttggaatcgatttaacagatcacagaatgtataattttt

SEQ ID NO: 36 - DNA, 1624 bp, Gossypium hirsutum
gaataagttcatgtggtgtcacactgtcccttgatgtggcatattttagcatttaagcaaatttgtctctactctatacctctcttatccatctgctgcctcagcctcagcctcccaaatgacaccaaagtgaatcaatcctcaatctcaagcccctctaatcttctcaatttgaagcaacatcatagaactgcttccccttggttccactcttctgttactgttgaagggtcatgttgaataagctagccttgccagaatccagcactttcccaggaaagccaatgccacccacagctgaatgctggtttgatgatgcatgcatccttgacatggactactttgtgaagaccatctcaggcataaaggccaagggtgttcgtcccgacttagtaggctcaatcatagcacattatgcatcgaaatggctacctgatctatccggcaatgacaccgaaaagggtcctatgagcctccaagagtcatcgccggagagtgtcacggtttcatggatgaaaaagaggttctttgttgaaaccttggtgggaatcttgccacctgagagagattccatcccctgcaacttcctcctacgccttctccgaacggccaacatggttggggtggagccttcctacaaagcagagctggagaaaagaatttcgtggcagcttgaccaagcatcactgaaagagctcatgattccatcgtttagtcacacttgtggcactctgctagacgttgagcttgttataaggctggttaagagatttgctagccttgatgaaggcactagaagcggcattgcggtggttaaagtagctaagcttgtggatagctacttggcagaagcagctttggataccaatctgagtttggaggactttattgcacttggtgctgctcttcctagccatgcccgagccatggatgatggcctctaccgtgccattgacacttatctcaaagcacatccaggtgtttcaaagcaagataggaaggttctatgcagattgatagacagtcgaaaactgtcaccagaagcatccctacacgctgcacaaaacgaacgtttgccagttcgggcggtgattcaagtgttgttctgcgagcaaagcaagctcaaccgacatgttgattggagtgggtcgttcaacggaacccggagtccgaacccggcaggactggaagccccggttcggtgcatgtcgaaacgtgaaatgaacgctcaacaaatggagataaagaagctgaaggaagagctgctgagggtccaaaaccaatgcgtagcgatacaaatgcaaatggagaaactagtggataagaagaaagggtttttcaggtggaagaagctggggataatgccgtcgctgaagagcagcgtgagtgtatttgagaagattgaagaagaaagagaggctaactttgggaggcaaacccccattgatatcaaacataagcctgttcgtcctcccaagtggagaaaatccatgtcttgacttcattatgcaggggttcctaattaatttgctgctaaatttaatgtttatatatatatatatgttccttttcctatgttccatgtcgcgataataatgtaacaataataagattcgtattaaat

SEQ ID NO: 37 - DNA, 1080 bp, Gossypium hirsutum
ccaagaaaacattaatttttttctatactaaacgaggaaatggggaacagcataggaggaagaaacaaggcaaaggtaatgaaaatcgatggtgaaaccatcaaattaaagacaccaattcgagtttgggatgttctaaaagattatccaacaggccatgttttattagattcacaaaccgtgaagcattatgggatccgtgctaagccattagagccacaagagagcttgaaacccaagaaaatctacttcttggtggagctgccgaagcttgccgatgatgaagttcataacgcgccgaggagggtgcggtcaggggggattcatatgagtgctaaagataggttagagtgtttgatgttgtcgagaaggacggtgtcggacctttctatggttcgaccgtcgtcgacgagcatggtgcccgatggggttcgactaggtggtggtggtggtacttccggtggggggatgatgactgtgaaaatgaggttgcctaagtctcaaatggctaagttgatggaagagagcaaagatggtgttgaggtagctgagaagatccttgatctttataccggaaatggtggtagtggcggtgatgaggccggtaatcgaatccaccgtgaagcaccgtggaagcctggccttggtaccgttggagaaaactttaagcccaaacgtgagaagagagtgagctttattccacaagaagaaggtgaaatccatttagcaaatcacttgtagcagccaaatttggagtcagcatcaaaatccagcaattcagccccaatactagttttctttctaaataacttattatttatgacttgtttttcttttttatataatcacatgtattttcatctgttttacggttcaagtctagttctattcggtgaggtgacattcaggtaaagccctcccaacaatatcgactatagtgttcgaacttgatctaaatacctagagaagaagtctactttcacttcttccaagtggttggtacgatagatagttgaatatggattgtaaatactgaaatttcaaactagatttattgaatatcatatcttaaaggtggct

SEQ ID NO: 38 - DNA, 847 bp, Gossypium hirsutum
gtttgaagtggggagcaggttatctgcactgcaccacgtttcgaacaacccaacaagaaaaatcaccccaacccatcagatcccaaacagcggttcggctcctcccttggaatggaacacttctagatctactccttggaacaagttatgaaaatggctatatctcttgtactgagtcgactcattctcttcctcactctcacctgctttgcagccgtctcatcatctactacgaccacaacaactctaaaacggcactctgggtttctctactctagaacccgaggaaaatgcactcctcagttctggagcagcaggagagaggcgtggccaaggatggtcccacagggatcaacggtatcgaacgtgttcgggtcgagagcgagtgagcggtacagatcggatatgacattgttggaatcaagggctgtgaatgaagaagggaacgtgttcaatgagctgctgaagcaggcgagtgcagcattgctgaactcgtatgcgaggaaagggttcccttactcggcgtgggaagtgaagactctgatgattcaagggttggtctcggaatatgccgcagcacgcctaaccagactcttttccgttgctaatgatgcttgtatttagtagtattcgggttgatactagcttaaaaggcgataggagaagctagttttgcttgaagcagtacgactctgttctttttatttttagtttgtcaatttggtagattatcgcaaattaaatgtgaattcgatgaaagatatttctcattggtccttttaggcgctcatgcatgtcgaggtattgaaggattattgggaacttaatattgatggtgtactgtgtt

SEQ ID NO: 39 - DNA, 951 bp, Setaria italica
ctttaataggtggttgccaaacaggataagcagaggcagagagagagggagagggagagggggagggggagagagagagagatgggttctccagtgccgctccgtccccttgctcttgcctgcttcatcttcctctgttcatccttctgggcagcaaatgggatgtacggtagggttggtgcggcggcggcggaggtggagagcaggaggaggatgcggctgcacaccgacgggagccgcggcgacgcgcacgcgtggccggggtacctctacacccgagcagttgggagatgcacaccccagttctggagcagtggagctgagccgtggccaaacatcgttcctcaggaagcagctgtgtcaaaggtctttggctccaggtccgttgagagatacggaccacgcctcaccctgctggaagctaccatgagaaccgacgacatcggtggcagtgcctttgtgaagctcgtgaagcaaggaagtgctgctctcctcaatgcctacacgaggagaggtttcccttttgattcctgggaggtgaaggccttgctgttagaggcgctagtgtctgaggaggtggctgcagtccaggcagaacgatttgagcaggcgaatgagtcctgcgtttgatggatgaaatgatgatgatgctggagcttctgtccctgcttggaagctgtatcagaagggcgatagtgtattgtgtttgtagtaggtcacctcttctgtgactttggtgttgaggtctctgaagcagggccctcttttcgttggcataatatttctctagatgcagggtaatggtgtttgtgtaaggttatgcgcattgatgtgcaggccctaatgtatgcattgtacttttggtattgcaacgaacctacatggacttgtacacatttgtctagactatataatgaaatccttggcaaccccatgggtatgtcgttccat

SEQ ID NO: 40 - DNA, 3440 bp, Setaria italica
tcgcggccgggacagcgcgctcgccgctggtgcatgcgtgcgtgtgcgccttcgtgtcccgctctgaggctctggcttgctgctaccgccaacgcgcccccgcccccgccggcgcggcgcgcatgcatgagcgtccacgcatgcctgcctgtcgccccgcgttccgagccgagttcccctgtcaatagcagacgagccggcctgtgaccgagcggctgatccgattgggttgccgccttcggccggaaccatggatcagcagcggaggagcagcctcaggtcgtacgggtccaacgcctcgtcccagtcggggtccttcgacttcgaccacgaccaggacaaggagcgcgccggcagccagcacggcgacggcgaccgccgcgaggtcgtcgtcaagatcgatgccgaaccgcactcgccggtctccctcagcgcggccgccggcgtgtcccggaacaactccgcggtcagcactccgcgggccggcggcgcggtgagcatgctcgcggcgtctgcgtccgggtcgagcgcgtcgacctcgcccagcgtcggcggcgacgcgtcccgctccggcgactcgttcagcttcaagaaccgcccgccgcagtcgccctcgtcgccgggggagtccagcgaggacccgcccagccgcctcatcggcagcttcctccggaagcaggcggcggccggcggggagctgtcgatcgacccggacttcgaggtggacgacatgaggaggccaccgcgcgcgccgacgtccgtcagcgcatccagggagctgcgcgtctcgttccagaacccccacaagcggttctccccgtcgacgtcgtcggcgtcctcctcctcctacgacggcggcgacaaccgcaaccagagtggcatcgacggggacaccgccgaggtgctgcgctgcacgtcgacgtccaccggctcctcccttctggcgcgcagcaagacgcgctcccggctaatggacccgccgccgccgtcgagcgcccccgccaacgagccggacccccgcaagtcgttcgtctcgaagggcctgccgcccaagtccgggcagctccggtcgggtctcatcggcaagtcggggctcatcggcaagtcgggcggcttcgacgacgaggatgacgacccgttcgtcgacgagggaatgacctcggacttcaagcgcgacaccatggactgcctcctcatcatggagtgggtcagcctggtggtcatcgtgggcgcgctgatctgcagcgtcaccatacccagcctctccaggaagaaggtctcgggtctccacctctggaagtgggagctcctcgtgttcgtgctcatctgcggccgcctcgtctccggctgggtgatccgcatcgccgtcttcttcgtggagcgcaacttcctgctgcggaagaaggtgctctacttcgtctacggcgtgcgcggggccgtgcggaacgtgctctggctgggcatcgcgctcgtgtcctggcacctcctcttcgacaaggacgccaagcgggagacccacacactggtgctcccctacgtcaccaaggtgctgtgctgcctcctcgtcgccaccgtcatccgcctcgtcaagacgctgctcctcaaggtgctcgcctcgtccttccacgtctccacctacttcgacaggatccaggaggcgctcttcaaccagtacgtcatcgagaccctctccggcccgccgctggtggacgagagccgcatgatggcggaggtgcagaggctccagagcgcaggggcggccatccccagcgagctcgaggcgacggccatgccgagcaagtccgggcccgtgcccaagagcggccgcctcacgacggccccgtccaggcgagggggaggggtcagcaagcagctgcagaggcagaagaccgagcggcacctggacgatggcatctcgatcgaccagctccacaggctcagccagaagaacatctccgcatggagcatgaagaggctcatgaagatcgttcgctacggggcgctgacgaccatggacgagcagctcaagcatgcgacgggcgaggacgagctggccacggagatacacagcgagtatgaggccaaggttgcggccaagaggatcttccagaatgtcgccaagcctggatccaagcacatatacctgtcagatttgatgcgcttcatgaggcaggaagaagccttgaaagcgatggatctttttgaaggagcgcaggagaacaacagggtcagcaagaggtcgctcaagaactgggtggtgaacgcgttcagagagcgcaaagcacttgccctgacgctcaacgacacgaagaccgcggtgaacaagctccaccagatggccaatgtcgtggtcgcgttgatcgtgcttgcgctctggcttctcatcctagggatcgcaacgtccaagttcttcgtcttgctcagctcgcagctcctcgtggcggtcttcatgtttgggaacactctcaggaccatcttcgaggcgatcgtgttcttgttcgtgatgcatcctttcgatgtcggcgatcgatgcgaagttgatggaatgcaggtggttgtggaggagatgaacatcatgacgacgatcttcctccgatacgacaacctcaaggtgtattatccaaacagtcagctggcccaattaccgatcatgaactactacaggagccctgacatgggagacgccgtcgacttcactgttcatgtcggaacaccagtggagaaactgtccctcatgaaggagagactattgcattacctcgacaacaagaaggagcattggtaccctggctccatggtggtcctgcgcgacgtggacgacaccaacaagctgaaggtctccatctggtgccgccacacgatcaacttccacgacatgggcatgaggttcgagcggagagagctcctgctgcaggagatgatcaagatcctgagggacctcgagatcgagtaccggatgctgccactcgacatcaacgtccggaacgcgcctaccatccagtccgcaaggatgccgtcgacatggacgttcaactactgagatcatgctggataccttcgtcagacttgtttgtgaggttctgctctgaagtttgctagaagtagagtaagtattccagaatcctaagccagtgttccctgagtgctttgagctgtgacagcctgctgacgagagaggcaacaggtcttgctgtccctgcagccatcactagtgctttcctgtagttaattgtgttgttggtccgtactttttgtgcctatgatgacaagtagacatcttatatgctacagaataattgtgattatttagctcatctaaaagattgaagttatgaataattgtgtctatttcaattgatagaacaaaaggaattttatgaatttattctacatgcaaatattgtatatcatgctaattctcgaaacaaaaaggtacgccc

SEQ ID NO: 41 - DNA, 769 bp, Setaria italica
ggaaagatctgtcattttttttctttcctattccttctcgtttgcgcttgcttgcatttgcatccgtctcaggggaagcacgaagcagaggcgcgtcgccgaggatcggcggagatgcagatccgcgtgcgttgcgggtgcggcgattcgtcgtgcccggagtgggccgtcgtggagcttcagggcgtggtgcagccgcaggcatccttctccggcgacatccgggggctccacatcggccgcctctgctctgccccctccccgtcctcttccaagggagggtacaccttcacggtggggtaccatgaactcgccgggacgaaagtgaccttgaagaagcccctgctggtgctcaggaagaagaaggtgaccggtggtgctgcggatcaggagccaccgacggcggcggaggaggcggagctggaggtgatcggcgtcatccggcacaagatcctcttcaaggaccgccccaaggccctcatctcaaagccaccgaccaaggagaagaaggccgtgcagccagcagcaaattgacgccattcctggggaacggccagcagcaacttggtccagtcatgccagcgatttcgtggaccttgagaatctgaaactcccttggtttggctgtgtgcatccaaggttttctgaacatgccattgttctagtcatgattgggcgaaattggatgtcgtgttctgtggttggttgatgcactgtatggtctttcctctgcattcagtttaaggatgtaaccttgtactgtttctgt

SEQ ID NO: 42 - DNA, 760 bp, Setaria italica
gcggccgcctgcggaaaagatctgccattcccatcgcgtcttccaatcaccaatcttttcgcccagatcgcacacgaagtgaaatcctctgctaagttcacaagaagattcggcgttccggcggccggagtttccgcgatcaggcagcagatggggaactgtctcgagacgtctcgtcgcggtcgctccggtggcggaggtggctccgtgcattactccaagacgaaccccgtgtgggtggaggaggaagtggggaggaaggaggaggaggaggaggaggcgcgtaagggcgagagcgcgccggcagcgggggcagcggcgacggaggtgaagatccggatcacgaggaagcagctggaggagctgctgcggcgcgtagaggatggcaaggaaagcggcgacggcgtgccggtccgggatgtcatctccgagctcctgtacgtggccagcaccagctccaacttccggcacagggatgaggggcagtggcggccgtcgctgcagagcatacccgagtgagatcgaatccatcctacctgttgctgcatctacagcaacacttccagcatgatgtcttatcgttgcctcctacagtcctataatcctattgcgttagtactatcctagcaagagcatactccgtagtattcattgggtgtccatttgttcaggtcttggatcaagacatgagcttgcgataggctatgtagagagtgaattaaaacttgtgcttagttgagtagtgcatgtgaatttagca

SEQ ID NO: 43 - DNA, 659 bp, Setaria italica
agtgccccttccaaaccactctctcctgagcagtcagcagctcgcctcgacgacctgcggcgatgccgatgaacgcggggctgcgcgcgtaccgcgaggtgctccgcctggtgcggcggctgccggcggagacgcggccctactacgccaaatacgcccgcgagaacttcgtcaactaccgcgacctctccgccgacgacgacctcgccgccctcctccgccgcgcctacacccactcgtcatgggtcctctccaagtactcaatagacggggagaaggctgcggcgcggctcaaggatctcggcggcggccaccccgccgggcactgacgcgcgcagggtgttcgaccatatgccgttctgcgcttaatgcttcagtttagcgtttgcttgtgcttgtttttgtcaagggacttgcattattctgtgttgaagtgtatcaaattgagcgaataattccttataaagagttggtctcccgtattaaaaacggctttagtaccggttgaaaatccccctgtagtatcggtttctctagtatcagtttcgcaaccggtactggcaattcggtactagagggggtcctttagtaccggtccagttgaaataacgggtactaaaggatataaaaaaaaaaaaaaaaacaccggtggcgcgcct

SEQ ID NO: 44 - DNA, 1788 bp, Setaria italica
aggtgggaagggaaaaaataaaaataaaaaagccagcgccccggaacacggggagcgaaatcgcccggccaatccacccaccccaaccccgacatggaggccgccgccgcggcgcccgtgctcgacgccttcttcgccgggccgcgccaccaccaccaccagctccgccccaccgccgccgccggaggcggctgcagatccgcgcgcctccaggcccagccgtcccgcgccgccgccgccccctacgcccgcgccgactggcaggccgcctgcgccatcctcgccagcaactccagcggaggcaacggcggcagcaccagcagcgccgacgccagcaacagcaatagcagcagcaagcagccggcgccgcgggtcaacgggcaggagccgccgcggccgcccgcgctggaggcgacgccggcgccggtgcccgcggagctggatctggtgccggtctccaacctgccccggcccctcagcatcagcgacctgtccccggcgccgatgcacgggtcccagctccgcgtggcgtaccagggcgtcccgggcgcctacagcgaggcggcggccgccaaggcctacccgggctgcgacgccatcccctgcgaccagttcgaggtcgccttccaggccgtcgagctctggatcgccgaccgcgcggtgctccccgtcgagaactccctcggcggcagcatccaccgcaactacgacctcctcctccgccaccgcctccacatcgtcggcgaggtccagctccccgtccaccactgcctcctcgcgctcccgggggtgcgacgggagctcctcacccgggtcatctcgcacccgcaggcgctcgcgcagtgcgagctcacgctcaacgccatggggctcaacgtcgcccgcgaagccttcgacgacaccgccggcgccgccgagcacgtcgccgcgggcgggctccgcgacaccgccgccatcgcgtcggcgcgcgccgcggagctgtacgggctccaggtcctcgccgacggcatccaggacgacgccagcaacgtcacgcgcttcgtcatgctggcgcgggagcccatcatcccgcgcaccgacaggcccttcaagaccagcatcgtcttcgcgcacgacaacgacggcacctccatcctcttcaaggtgctctcggcgttcgccttccgcgacatctcgctcaccaagatcgagagcaggccgcaccgccaccgccccatccgcctcgtcgacgacgccaacgtcggcaccgccaagcacttcgagtacatgttctacatcgacttccaggcgtccatggccgacgtccgcgcgcagaacgcgctcgccgagatccaggagttcacatccttcctcagggtgctcggcagctaccccatggacatgacgccgtgggacgccgcgccgtcctcgtggtcctcgcgcgtcgacaatagcagcagccagcacttgtagagattgctgaatgctgatcaatcaatcagccaaggtagccacggatcgatcgatcaatcaatcaatggtgaattgccacttctttcaattaggaaggaaggacgcacgaaacgtttcttggttctttcattcgcttttgttttggaggagatcaaactgcatcgcgtttggtcgatgctttctcctcgatgctcctagctcccttttcgatttgtgttcatcaaatccagagaggcggtagaggggctcttgttgtacgctgctggtgtatgtaagtacagtatattcttatacttgtttaaacctttgaagaaatcaatcatgcgaaaccatgga

SEQ ID NO: 45 - DNA, 706 bp, Setaria italica
agaggggccgcctgcaggaaaagcagatccgcgcacgtctcttgagtcttcttcttccttctcgtcttcggatcacacagcggtgcgtgctaggcgagacagcgggagcagagcaggggagtggggcaggggcatcatgttggaagggaaggcgatggtggaggacacggacatgccggcgaagatgcaggcgcaggcgatggcggcggcgtccagggccctcgaccgcttcgacgtcctcgactgccggagcatcgcggcccacatcaagaaggagtttgacacgatccatggaccgggatggcaatgcgtggtgggctccagcttcggctgctacttcacgcacagcaaggggagcttcatctacttccggctcgagtcgctcaggttcctcgtcttcaaaggggcggcagcatagcaaagcaggctggtaacatcacggccaggaaaatcagatgcaccgtgctattttctcctccggcttttgtggagggcgactaggtggcgccgcagccggcacggcggatggcgtgtgcgtgcgtatgtgaaattagttgggtgtatacggtagtagatgtaacattgagcaagaatgcaaacagtggaattcatctctggtcaaattgcttttatgtacgaaatccaaatggatggatgctagtgatgtgtaaatcgaaacttgaaaactggggacaattttaatcca

SEQ ID NO: 46 - DNA, 1600 bp, Setaria italica
gttcaggatcactctctcggctgccactggtccgctccgctctgccgcttgcccgcttccaccccactccgctctcccccgttcccccgccgagatattttcctgcgagcccctccccccggccatgccgctgctcgccgtcgcctcctccacccgcgccgcggcggtgcggccgccgcgcgcctcggcggcctcgggcgaggcggcagcgtcggaggccgcggggcggaggcctgtgaaggtgatcctgccgaagaagaagccgcagaagtggtcgacgggaatggagcccggggagtacggcggcgggccggccaccatcaagccgcgcaagtactggtgggggaaggaggaccgcgaccccgtgggcaacaccgacgacttcatctggaacaaggacttcctcccccacatggagcgcgtcatcgccaacggcggcgctgccgcggaacccacaatcacccgccgttccccggtggacgaggaggagtcaggatttctgagcatcaaccgtgccatgagccttgacagtgtggaggttgacctgagcaaggagcttcaagcgccgaccaggccaatccttcaaacgcaggttgaggctgccaggagaggccgggccattggtgctgaggctgtgaatggtgccacctctgcaagatggaggctagtcccgactcgccgggagcaggctaagtgggacagagcagccaaggcagctactggtggcagcgatgttatactaagggagtccaagtcaagagtgcagcaaggggaccctaaggaattggcagctagggccagagaggactacctaaagttgaaacaaagattgcagctgctcactttaggcattggtggtgttggtgtagtctctgcttatgtttcatactctcctgaaattgctgttagctttggtgcagggttgattggatcattggtgtacctccgcatgcttggaaccagcgtagattccctagctggtgggactggagaaactgtcaagagtgctgctgcacaaccaagattgcttattccagtggtacttgtgatgatgtataacagatggaatgggatattagttccagactatggcttcatgcacctggagttgataccaatgcttgttggattttttacctacaagattgctacattcgctcaagcaattcaagattcgatacctgcagttgaaaaacgtgaagtttgaacagtcctggtgaatagaaaataaaggtcttaccctacgcactgagggaagattggccattggtcaatcagatagtaaggttggtttggaagaatctgatctgacgtcgacaccaagtagatgagatgctcattgaggatgccatctgaaaacttttagcggttaaccacatattttacacaaatattctactattaaggtggtaccacattcattccatgttgttaacacgtagatcatcaatgtacaaatttacaacatggaaactttatcacaatgacagcagatagcaggacgaacaaattaaatggtatacagtatacaccacaactgaatgtaaataatgcagtctgccagtatacttgtttaaagaaaatcgggccttacaaatgc

SEQ ID NO: 47 - DNA, 3498 bp, Setaria italica
ccggcaccggccacctacctgctcacccaacctatcgcatataggaggggggatagggggagtagcagtaggcagtgtagcactgcggctcctactactcccaccacgcctccaacccccatgctataccaatccgccgcaggtctctatccagtccacttgctctctctccctcatccgccactgcagcgagctctcgcttcgtcgtctctccctttccctcaggagtggcagatctgttcgcgtgatccccgacctggatcttgatgatttggcgactatgagtggtcgattccttcgggccagctggttatagggaagtgtggtttcctgatcctctgtttcaacctcaggacattgaattgaatctagtgataaccgtgtattgttcattcacaaagatacctgaaacttctgcttcatatgatcacccatcataaagatgccaacgaaaggacagtttagcagcgaaaggaatgtgaagatcatatcaggtcgtgatggacaaaagaagggaaattcacagcatgaccaaattgcgcacgtgccgaaggacagggtcacagcagccaatggaaatgtagatggaaaaattgaagatagaatcagagttgcaaagaatgataagttccgaaggcaacgggagtcttggagtggggaaaaggctgcatgcatgaagggctcaaaaccatggcctggtcgaaagacgactactgttgatgaacttgtcaagcatatgtcaaatgttccttcttatttacagcgtaaagagacagctgaccatcttcaagacaaggcattgaatgttggagttcttgagtggggccttctggctaactggtctcagcaacaaaagcatgagctcgctagaagccatggagcctctccatctaatactagtaggtctgtattattctcatctccatcacattcttccgcaagccccagcagcagatctcttgagagtaatcaatctacccccatgagtgaccatcaccattcatccatcagagctcagcagagtagactgtcggataaacagcatgggacggccagatattcacctagtccaaattctgccgtattgagcttgttgccagggcatggtaaacatctctctccagagaacagctgtaattatgttggctcgggtctcaggaatgtttctttacccgcagactctctaggttcttcctctagaagttttggaagacatgaaatgggtgaagatgaagagactagaaggaagattgaagatgttgtccatcactgttctcgtagactctttacagacagtgataaaattgggaagaatttcttcacatcaaataacaatgattccatgtgtaatgatcctgaacagagcagtgtcttgaatggtgaaaattttgagtcactaatatctgatgctgtgatggacacacctagaaatggcagtaggttacctgatgttttcttggaggatattgagccatcccatgaatttcctcgaattccatactcatgtccacttcccatcatagattcagctgctaaagagattggcaccactagcactgaagctagagataattttgttggtacagatgcaaaactaagtaagaacggtaaccgaaaccgatctgccatgagtggcgctgagaatcctccccaatgttctgcaaagttcagtgatagggtgcctgatcgccatctaggttctgggatgaatcgagtgagccgcagctctagcctgaaggagacaccatgtgctcgacaacctgatgcagtgccctctgttgataaaataggagacaggtcatcatccaacagcaaaggtaggcgaagcccattgaggaggatgttagatccaatattaaagccaagacattctagtccagtacgaccttcatttgttccgaagtgtcatcttccagtcaataccactaaacagtctctggacatgggcagatcagtgccacagaatgtgcagcgaaggtcagttgatatggtagtcaattcgaattatccaactgaagcaaacataaaccagcctcctcatgtgctgttaaacagtgcaagatacctccagcaagaaaaggattcaccaacgacaaggcaagcgcttctgcagctagcatggaagaatggcttgcctttattcatgctgtcgtatggtgagtctgatatcctggcagccactgtgagaaagaagagcatctctgagaaggatgatctggaaagcacatatgctgtattcactgttgaagaacctaagaaaaaaagtggagcttggatcaaggcagggggtaagaacaagaaacatcacctgttatccagcatagttggagaattaaaggtcacacgccgaaaatcaagatgccaccacacaaagaatattcatgtacacagggagtttgtgttggttggttccgaatttctaccatcatctgaagaatcaggcgattcacacatcagcggagagcttgcagcttttatcagcgcacttcctcagcaagaagcagaaacttcaagtcaatcatcttcacagaatgtgggacaaaataattcggcgccgattggctgcggttgccccccattgggaaacttccagccttgtaccaggaatgctaattctggttcagccaatgttattgccgtactacctgatggcttccatggcacatcgacatctgggcagccattgcctttgatcgagaggtggaaatcaggaggaacttgtgactgtggtggatgggatgaaggttgcatcctgagtgtcctcactggtgcggccccagaaaatgatgccattcaggctaaccaggcaatggatggcagccagcgatttgagcttctagctcagggtcgatcgcgagaagacaggaatgccttcagtatgatttccttcaaagaggggctgtatacagtggaattcagatcatccattgctttacttcaagcttttgcaatgtgtatagtgatgcttcatgggaggttccctagcaggatgcaagttgcttcgcaagcagcgcaagagcatgatctccttgccaatcatgagctcaagaccatggcagccagtcaaggtagagctccgaccagctatgtgccccatcggccacctctttctcctgtaggccgagcctagcttgttgcaattaaatgtatgttctttctgtgtcctctcttcagttgtgtagtgcctgtgggatcaatataccatggtcctatggtccatatgcaatacgcatatccaaagtgacaatccctgtgcaatctgctttagaggtagctatctgtacatgttgatgttgtatgactgctgctatgatgtggctgcaaggtccatctcagcgcttagttaccctttatatgttcaccccttgtcagttgcttctatgctgaaaggatacacacctcctgtctattgggacccctttttcatagtggccgttgcatcagcagcagcacttatgcacccgctgaacctctatctggatgtctgaagttgcatgc

SEQ ID NO: 48 - DNA, 2085 bp, Setaria italica
agaaaacctcctcggccgaaacagcaaaaccctttccctccctcctctcagatctcctcctctccctcacaccccaaaccctagcttcgcccagcccccaaccatggcggcgatgatgcaaccgcagatcatcctgctcaaggagggcacggacacgtcgcaggggcgcgcgcaggtggtgagcaacatcaacgcgtgcacggcggtggcggacaccgttcggaccacgctggggccccggggcatggacaagctcatccacgacgacaagggcggcgtcaccatctccaacgacggcgccaccatcatgcgcctccttgacatcgtgcaccccgccgccaagatcctcgtcgacatcgcaaagtcacaggactccgaggtcggtgatggaactactactgtggtgcttctagctggagaattcttaaaggaagcaaaaccttatgttgaggatggagtgcacccccacagtctaattcgcagttatagggctgcgggcaatatggcaattcaaagggttaaagaattggcagttagcatagaagggaaaagccttgaagagaagaaatcattgctagccaagtgtgctgccacaacactctcatcaaaactgattggtggtgaaaaagaattctttgcttctatggttgtggatgctgtccttgccatttgcaatgatgacaggcttaatcttattgggattaaaaaggttcctggaggtaccatgagagattcatttctggtgaatggtgtggcattcaagaagacattttcatatgctggatttgagcagcaaccaaagaagttcctaaatccaaagattcttttgttgaacattgaactagaattgaaatctgagaaagaaaatgcagagatcagattatcagatcctctgcaataccaatcaattgtcgatgctgaatggaacattatttatgacaaactggataaatgtgtgaaaagcggagcaaagatagttctgtctcggttagctattggtgatctggcaacacagtattttgcagaccgagacattttctgtgccggtcgtgtcactgaagaggacctgcaacgagtggctgcagcaactggtggaaccgttcaaacttctgtaaataatgtcattgatgaggtacttggttcttgtgaggtatttgaggaaaaacaagtgggcaatgaaagattcaacatatttagtggctgcccttctggtcagacagcaactattgtcctccgtggtggtgcagaccagttcattgaggaagctgaacgaagtctccatgatgccatcatgattgttaggagagctcttaagaactctacagtcgtgccgggtggtggtgcaattgatatggaaataagcaagtatctcagacagcatgcacgaaccattgctgggaagtctcagttctttgtaaattcgtttgctaaagcccttgaggttattccacgacaactttgtgataatgctggatttgacgcaactgatgtgctcaacaagctcaggcagaaacatgcatctggtgatggtgctaattatggtgtagacataaacactggtggaattgctgattcctttgctaactttgtgtgggagcctgctgttgttaagatcaatgctataaatgccgcaacagaagcttcctgccttatcctgagcgtcgacgaaacagtgaaaaacccaaagtctgagagcgcacaaggtgatgctgcagctggtgcaatggctggtcgtggaggaggtgcaatgcgaggccgtggcgggaggggcatgcgcaggcggtaaattgagccacgtcgactctgtaacttcatgtttttgatcgcctgagggctgttgtatcataactgcacgtgtgatgtgagtgattcagaagcaatgatagcctttgtttcagaacagcagagatataccaggcatttatgaatgtagccgccaccggttgtgatatagttagatctgagccttgtttttttttctctcgagctaaaggatgtattccttttgttgcgatccttgtgcgctgaagcctaaaattctgtgcgttgtttttggaacgcggatgctgtttgctcagactgact

SEQ ID NO: 49 - DNA, 1493 bp, Setaria italica
cgcgcatcgcgccacgccgtagccgctgccaccacaaggcgagcgctcccgttgctctgctcggcaacccaagcacgcagcttcgctagcccgggaggcccctgccgaactcttcgagggtcgctgcgctgcacgccatggagctgctagtgcgagcgggggcggccgccgcagccgcgtcctcatccccgcacccctcgctccagctcccccgcagcacctgcgtcgtccctggcccctgccgcccccgtccccgccgccccaggtacccttcgctccgcgccgcagctgccgcggcggcggtcgccgttgagccggaaacggaagatcagcagaatagcatttcagaaactgaggtgtttgcatgccctgtttgctacgaagcattgataagaaaaggcccaccaggcataaacttgccagcaatttataggtcaggattcaagtgttcaaaatgcaacaagtcatttaccagcaaagacatcttcttggacctcactgtgacttcagggacaaaagaatataccgaacagaagcctgctagaactgagctctttaggagtccgcttgtgtcatttctttatgagagaggatggcgtcaaaacttcaatcggagtggctttcctggtcttgatgaagagtttcaaatggctcaagactatttccaacctgttgctggtggtatccttcttgatgtcagctgtggcagtggcttgtttactaggaaatttgcaaaatctgggacatactcagctgtgattgctttggacttctctgagaatatgctccgccaatgctatgaattcattaagcaagatgatactctcctcaaagcgaatctagcacttgtgagagcggatatttcaaggctccctttcgcttcttgttctgtagatgccattcatgctggagctgctatccattgttggccatcaccgtctaatgcggtagctgaaataagccgtgtcctgagacccggtggtgtgtttgtgggcacaacttttttatcatctcccaggaacaacccattctctgttgaagcattaaggccactgagacagattgttggaccagttaacaccagctacaactacttcaccgaaggagagctggaggacttgtgcaaatcgtgtggccttgttaactacagcagtaaggttcagaggtcattcatcatgttctccgggcaaaaaccatactgaagatatctctccaacctctactgattcttcaggattccttgtaaaatgtatttactaaaaattattatatttacatctccaatagagaataatgtggctaagggttcctcatatctgtatagatacgtgtttctgaatgtattcaaaacaatggtgtacaaaaatgcatgctgcagattcttgagagaaacactacaagtgccctacttctctgtgatttattagcgcactcttctttttcaactttctcggttcgttgcttggctaggaggctataattgactgcatgta

SEQ ID NO: 50 - DNA, 2382 bp, Setaria italica
aaggcccaatcatggaaccaagccagtagccgtttccggtccgggtcctctcgacggcggcggcggcggcgccgccgccgcggcgttttccgatggtcatggcgatctccatccgggacaccttggagcggctgggggagatggtggatggctcatggctgcaaggtggctgactgcgaggtcctccgttgccgagctccatcgatctgccgactcgagcttaattaactggcggcggtcgtatactatgatactatctcgacgatttcaagttgcggggttctcgctcaggaatcggtgtaggtggaggagggaggggcatggcgccgccgccgcgtgtgtgcgtgaccggaggcggcgggtttatagcctcctggctcgtcaagctgctcctctcccgcggctacgccgtgcgcgccaccctccgcgacccaggtaacccaaagaacgcccatttgaaggagctggacaaggccccagagaatctgcgtctgttcaagggcgatgtgctagagtacgacacgctaacaccagcagtggagggatgtgagggggtcttccatcttgccactccggtgcctgaagataagatggttgatcctgagtcagaagtactcgaccctgctgtgaaaggtaccttaaatgtattaaaggtctgctctgctgcaaaggttcagaaacttgttgtcgtgtcctccaatgctgctgtggattttaacccgacttggcctcaagatacactcaaggatgagagttgctggtcagacaaagagttctgcaaggaaaatggggactggtactctgttgccaagattatggctgaacaggcagccttggaatatgcagataaaaatggactgaatgttgttacactttgcccgcctttggtttttggccctctgttgcagcctgtggtgaataccagcagcaaattcctcatctatgttataaaaggtggtcctgatgtgatgaacaacaaactgtggcacatagtagatgtccgtgatgtggctgatgctctgcttctgctgtacgagaagaaagagtcatctgggagatacatctgctcgccgaatcacattcgcaccaaggatttggtggccttgttgaagaagttatacccacagtacaactgcgtaaataacatccttgatgtcgatcagaaagcatcgctaacatgccagaagctcatggacctgggctgggaaccaaggacactggaggagacgctcgcagacagcgtcgagtgctatgagaaggcaggcgccctccaggatgtgcccgggcatccttgccgccttccccatctcttccgtctggctggggatccgaagaacgccatcctgacgcagctggacggggcctcggggaacctgcggctgttcaaagccgacgtcctcgactgcggcacgctggcggcggcgttcgcgggctgcgagggggtcttccatccggctaccccgaaagagttgatggatcctacggtgaagggcaccaagaatgtgctcgaggcttgctcggccacgaatgttcagaagctcatcgtggtctcgtccgttgctgcttcctgctttgaccccaactggcctgaaggtaagctcaaggatgagagttgctggacagacaaggagttctgcaaggacactcagaattggtattctcttgccaaaacagaagcagaagagatggcgcttgaatacggcaagaaaaatggactgcatgtagttacattttgccctggtctggttgttggcccattgttgcagcatgtggcagtcaataccagcagcaaagttctcctatacatcataaaaggaggccctgacacattaagcaacaaattctggcccttggtagatgttcgtgatctcgctgacgctatgctcctagcatacgagaagtctgaatcctctggtagatacatatgctcattggaccagatggacataaaggatttagtttctttgatgaagagcatgttcccaaactacaattatacagacaaaatggtcgacgtggattacaaggtttataccacatcagataaactgaagaacctggggtggcagccgaggaagctggaggagacgctcgcggatagcgttgagtacttcgaaaaggctgggcttctgcaggatgcagacgggaaaccttgccggcttccctatttttaccgtgtgaacgctgaggaatgaacgggatctgtgctcttatgatcgaaatatattacagaataaaacgtagatatttgcggctatacaaggacgcagctatgcaccttattatttcagctgatctcttggcgccataccgccttgaacagtatttgtttatgccaactactgtgagatgttagggcctgtttgtttcattggaattggc

SEQ ID NO: 51 - DNA, 2120 bp, Setaria italica
gcctttcggttagtagtttaatcgttttccacttttcctcctcgtcttctgggctctggctgccaactccaagagcggcctgccaatccgaggagtgagggagagggaggcgcgcaactggtgcgcaaatggcaatccgatggcaccgccgcggttcttctcctcgtcggccgggcgcgctggagctccgccggtcctccttgtccattggctgccaaccccaagagtaaccaccaatccaaggagtgagcaagggggtgcacgagtggcaaagcatcaatccgacggcaccactgctcttctcctcgctaacccccaatggtgataacatgatatcgatgtgaagttttgtggcacttgtatcccttacaagtaagtgttcgggtgatccttttgagcaaatggaaggcactaaccaaccccctggaagcaggatgcaaggggctccctttggcagtttagacttacatggcaactctatggaaacacatgctccaaacttaggaaagcagatctttatcaactctcaaatacctgggaccctcacaatgaacagggcttcagagcctgatgactttcctgggtttcagttcaaagaagatggaaggagtgataagaaccaccatcagcacagtcatcactcaaagaacggcttgattgatgacgagggacattatatgactgaagatgctaccaatacccccagtgtcaaaggcaagaaggcctctatgtggcatcgcatgaagtggacagattcaatggtaaagcttttgattacagcagtgtcttacactggagatgatcatggtgctgatttaggtggtggcaggaggaactctacaataatgcagaagaagggcaaatggaaggcgatatcgaaggtcatgggggagagagattgccatgtgtcaccacaacagtgcgaggataagttcaatgaccttaacaagaggtacaaaaggctgatagacatccttggtaggggtactgcttgcgatgttgtggaaaagccagaacttcttgatagcatgaatcatctttctgataagatgaaagatgatgtgaagaagctacttaactcaaaacaactgttctttgaagagatgtgttcctaccataacaacaaccgtaggaaattgcctgaagatcatgcacttcagcattcactactgcttgctctcagatgtaaagaggaccatgatcctctgagggatgcaagtggagatgctgatgaagatgatcaaagtgcggattctgatcatgaggagaatgatgatgaagagcaacatcctgtgcatacaaacatgagggagccctccatggacaaaagggctcgccacggcgatgcagctttgctcacctcaagctctcatgaaggtattaagaggtctgatccccatggcataacagtggacatcaacaaggctttcccagatggaaccaactgggctttgttgcaacaggacttggcttcacaatcactagaggtccggaaacgtctcttgcagattgaagaaaagaacctggaactcaaaaagcagtgtgttaagtgggagcgattcaggaagaagaaggatagggagatagaaaggatggcgatggagaatgagcatatgatgattgagaataagcaattggaacttgagctaagacagaaggagctagagttagagcttaagctaaaaggccaggccaatcatgcatgacctttggttgatcaaagcttctattctgaaggtcgcagatggcttctgattcagaacggagttgcgcttctggaagagttaaaggtggcgggttatcagagtactcggataaccatttctgtgcatattacttagttctgtgtggtgtactggttgggcctcctgcttgtaacattcccctcttgggcagtagcagtatcaggcttgatgtgctgtgtctgtaaggccgtaacttgaactatgtcgtggtaccttttcctcttcagcttttaatcttttatgtcagggtgttaaaagaacctgaagagtaacagttttagctgaaggaagaaatctggggttcaagaatggagtaaaaaggaggaataataataattaatcatgtgccattgcaaacggcttttcctcatttga

SEQ ID NO: 52 - DNA, 1689 bp, Setaria italica
actccccgcgcggccgccaccgccagcccgccgcgtcctcgagcgccccctccagttctccgcctctccttcctcccctcccctgcaatggcgtcggcgggagggccctccggggtcgtagggattagtgtccgtccggactccagtgcggcctgcctctttcagaaggttggagcccgatcgaattccctccctggcgcagcccctgttcaggttcgccggtgccacaacaaggcccgcaatggccaagctatcaggtgtgcaatggcaactggaaaagagcagggtgcagtcaccactactagtagtgatcaacacaaaggtggtttgcgtggcaaattaaacaaagttgttttagcttatagtggtggcttggatacatcggttattgttccatggctcagggagaactatggttgtgaagtcgtttgtttcactgctgatgttggccagggcgccattgaattggaaggattggagaagaaggcaaaagctagtggagcatgccagcttgttgtgaaggacttgagagaagaatttgttagtgaatatatatacccctgcctgcgagctggtgcagtttatgaaagaaagtatcttcttgggacttcaatggctaggcctgttattgctaaggcaatggtcgatgttgccaaggaagttggtgcagatgcagttgctcatggatgcactgggaaaggcaatgatcaggttcgctttgagcttacattttatgctttaaatcctgaactcaaagtggttgcaccttggagggagtgggacatcacagggcgtgaagatgctattgagtacgcaaagaaacataatgtgccagttccagtttcaaagaaatcaatatacagccgagaccgaaacttgtggcaccttagccatgagggtgacatcttggaggacccagcaaatgagccaaaagaagatatgtacatgatgtctgttgctccagaaaatgcaccttcggaacctgagtatctggagattggcatcattgcaggtgttcctgtttccatcaacggacgggacctgtcgcctgcatccctccttgcggagctcaatgaaatcggtggaaagcatggaatcggacgcattgacatggtggagaaccgccttgtaggcatgaagtctcgtggtgtctacgagacccctggtggcaccatcatggcagctgcggtgcgcgagctggaggccctgaccttggacagggagaccatgcagtggaaggacatggtcgccctcaagtatgctgagctggtctacgcaggccgctggtttgacccgctccggcagtccttcgacgccttcatggagaacatcactgcgacgactactggttcggtgactctgaagctgtacaaggggtcggtgaacgttgcgtcccggaagagcccctacagcctctacagggaggacatctcttcgttcgagaacggggagatctacaaccaggctgatgccgaggggttcatcaggctctatggtctcccgaccagggtccgggcgatgctggagaagggcatctaagttcctctgtttgttctgaaaataaaagccatcattcggaaactgtcaaagcgtttccagcgattgcggaccggttgttttgtatacgttgtttgagtttcaacgaatgaactctgaatgcatttgggtgacagaatggacgtgaatctt

SEQ ID NO: 53 - DNA, 2465 bp, Setaria italica
gttgaaattaacgaggccgacgacggggacggcagggacggggccgggcgggcggacagcagcgaaacagccagcgtaacagccagtgtgacgcgcccgagaaagaaagcgagcaagcaaccgacgctgccctcgtcggtggccaagcgcccaagacaagagcaaccggacaagctagcccacagctagcgagcctgcgcgctgctgcggccggcggcgacgaaagcgaggaggaggatcggaggaggaagtggtggagaagggcgggcgccgtgcccgcgatggtggtggcgagggcgaagaaggcggcgcccgcgggcgccggcggcgccggagctggcgcgcggcggagcggcgtcagggtgggccccgcgaggctcgagggcctccccgcggcgtggccggcgggcgccgctgccgtcaaggtcaagtggcccgcgccggggggcgcgctctcgcagatgctcacgggccgctgggcgcgcggggtcaccgccgtcgagcccgtcgccgcggggggcaccgtgaggtgggagccgcgagacggcaaccgcttcagcctccacgtcgagcccgccggcgcgcgcggccgcaccgagcgcggcgtcttcttctccctcctctatggattccaagaacagggccggggcaaggacctggtgaggctggaggagatcgggacagccatgataagcctggaggagtgctgctgggagatgcaactgcagcagcagcgccagcagctggtggttgtccccatcagggtgaggaaggatggatgggcaagtgatgccatgctttatgtgaacgtggagctcgtggacatgatgaacacacgctccgacattgaaagggctgtctcgttcagggagaagccgagaacgacgagcaagccgccgccgcatgcaatgcgagaccaccggaagagcttggaggcagcggcgtaccatgacgttcttgatctgaagcagctgctcgacctggctgagaaggaaggccgggtggctgtgtacgggagcaagaggaactctgacaccagcagcgtgagcagcttcagtagcagcagcagcagcagcacgatcagcatcagtagtgccagctccagcggcggcgcgagcccggagctcgcctcgacgtcgaagcgccggttcttgccatggatgcggaggagcagggacttcgacaagaggagcaccgagtcgctctcccaagaactgccgatcaagtgcatggacgacgatccggccggcagctgggagacgcgcgagttcacgagcagggacgcggagacgaagctgaggacgccggtgttcttcgcgtccatcgaccagcgcgacggcagcgccggcggggagagcgcgtgcacggcgctcgttgcggtgctcgccgcggcgctccacgccaaccacccggcgatgccgacgcggccggagctggacgcgctgatccgtgacggctcgtcggagtggcggagactctgcgacgacgaagcccacatggcgcggttcccgaaccggcacttcgacctcgagaccgtcctcgccgcccggacgcggcccatcgccgtgcagcacgacaggaccttcgtcggcttcttccagccggagagcttcgcgtcgctctccggcgccatgtcgttcgacgacgtctggcgcgagatcgccggcggcgagcgcgagccggggcgcgcggacgtgtacatcgtcagctggaacgaccacttcttcgtgctcaaggtggagagcgactgctactacatcatcgacacgctcggcgagcggctgcacgagggctgcgacagggcctacatgctcaggttcgacggctcgtcggagatgcacgcgctgtcgacgccggcagtggacgacggcaaggaggaggaggtgatcgtcaccgggaaggagtgctgcagggagttcatcaagaggttcttggccgccatcccgctccgggaggagcttgagatcgagaagaagggcgccggcagcgttggcgcgccgcaccagcggctgcagatcgagttccacttcacggtcctgcaggacgacgagagatgaccacttggtgtggtgatctgatggcagtgaggggatgcttcttccctgattgcaatgtacactaacataatgtaaattcatctacactgtaaaggaacaggaagtgcagcacgtactacaaattacaggctaggattgttggttctctttgtaccagtttagataggacacaggcagaggaaaatacaggaaggatacagggtgctggttgggtatttttcacaggggttttggatccatctctggatcccttcacttgtgacataccattttgcaagcgagctcagagttacatgaagtttactttgcccatctcccacttgtgatccgagccatttgcaacaccttttattgaaagattcagggggaataaaaccttctccctaacacacagagagatagcactgg

SEQ ID NO: 54 - DNA, 1877 bp, Setaria italica
gcaagtacgcccactggccactgccccccaggccagcaagcccccgccaccccccgagctcgtcgtgggcatggacatgtccgtcgcttcctcccaccacctgcggccgtcgccggccggtccggcgcggcgccctggcttcgccgctgccgccgcgccgcgcgtggcgctccggcccggcggtgcgtcgcccccgtcacgcggccgctgcgccgtcgcggctgcggcgtcgggcgctgggggcgaggcggcttccgcccccgccgcggtgacggcggtcgcccccgcggccgccgccgccagggacaaggtgcggcggcacacgatttcggtgttcgtcggggacgagagcggcatgatcaaccggatcgccggggtcttcgccaggagaggctacaacatcgagtcgctcgccgtggggctcaacaaggacaaagccctcttcaccattgtcgtctccgggaccgacaaggtgctcaaccaagtcatcgagcagctcaataagcttgtcaacgtcctcagtgtcgaagatctatctaaagaacctcaggttgagagagagctgatgcttataaaactaaacgtcaaacctgatcagcgccctgaggtcatggttttagttgatattttcagagcaaaagttgttgatatatctgataccacccttaccctggaggtagctggagatcctggaaaaattgctgcagtgcagaggaacctgaggaaatttggaatcaaagaaatttgccgaacgggaaaaattgctttgagacgtgaaaagattggtgccactgcccgtttctggcgattttctgctgcttcttacccagaccttatagaggcactgccaaaaaatccacttacatctgtaaataggacagttaatggcagtttggatcaaccatccaatgctgggggtgatgtttatcctgtggaaccttatgagagcttatcgatgaaccaagtacttgatgcccattggggtgttcttgatgatgatgatgattcaactggacttcgctcacataccctctccatccttgtgaatgattgtcctggtgtcctcaacattgtaacaggggtctttgctcgcaggggctacaatatacagagccttgctgttggcccagctgagaaggaaggcatttcgcgtattacaacagtcgttcctggtactaatgaatccattgagaagttagttcagcagctttataagcttattgatgtgcatgaggttcatgacattactcacttacctttttctgaaagggagctgatgcttattaaggtttctgtaaacactgctgctcggagggagatcctagatattgctgaaatcttccgagcgaaacctgtcgatgtttctgaccacacagttacgctgcagctctctggggatcttaacaagatggttgcattacaaaggttattggagcattatggcatttgtgaggtcgccagaacaggtcgtgtggcgctggtccgcgaatccggagtggactccaagtacctccgcggcttctcgctcccgttgtagcccggcatttgtgatgatggcccagcaaagcgcgtgcctggttgctagagcagattgtgtagggaacccttgttcggttttgtgcatctgcaggacttgtttctttcatttcatttcgtcgactccttgactttctttcttaataatatgctccttggtggacgcaagctgaggttgtatggaggtgtttggttgccgcactggtaacattaacgggactgaaaataaatcacaggagcatttgaggtgggatcgctgtttacaggatttgtttggttggacaatgtaacggtattagataccggtacaactatttggtttgcaactcaggtatcggaag

SEQ ID NO: 55 - DNA, 2254 bp, Setaria italica
cccttcgcctgttcgccaccaccgtcttaatggtcgctccggtggttgcacccacccaacccattcaccccggcgtcgcccccggccgtgcccgccaggtcttcctcttcctcatccatcctccaccgccggcgacccctatatattcgcgcccaacctccccgccccaccttccaagcccacccacacccactctccctctcctcaactccgagttctcgacgccgcgcagcaccccgccgctcagctagtagcctcgcccatcacccttgctacctcgccgcgccacgccgccaggcaccatgagcgccgcccagcaagcagaaccgaccacctctcccgcctcccccacccccgccggcgccggcagcaccacggtaatcaagaacgcccggcaccgcccgagcgcgctcaaactctgctaccacgttgccatctccaacctcccgtacctcctcctggcccccttcgcggcggccctcttcgtccgcctctcccggcactcccccgccgacctcgccgccgcgctcacctccaacccacccctcaccgccgccctcgccgcgctcgccgccgtcctcgtcaccatctacctcgcgcgccgcccgcgggccgtctacctcctcgacttcgcgtgctacaaacccggcccggagcacgtggtgacccgggagacgttcatgcggcagtcgacggcggcgggggtgttcacgggcgacaacctggcgttccagcggaagatcctggagcggtcggggctcgggcaggagacctacttcccccgggccgtgctcaacgcgccgcccaacccgtgcatggcggaggcgcgagcggaggccgaggccgtcatgttcggcgccatcgaccaggtgctggcaaagacgggcgtccgggcgcgcgacatcggggtcgtggtcgtcaactgcagcctcttcaacccgacgccgtcgctgtcggcgatgatcgtcaaccattacaagctgcgcgggaacgtcgccagctataacctcggcggcatggggtgcagcgccgggctcatctccatcgacctcgccaagcagctgctccaggtgcaccggaacacgtacgcgctggtggtgagcatggagaacatcacgctcaactggtactggggcaacaaccgctccatgctcatgtccaactgcctcttccggatgggcggcgccgccgtgctcctcacgaaccgcggcggcgcggaccggcgccgcgccaagtaccagctgatgcacacggtccgcacccaccacggcgccgacgaccgcgcctaccgctgcgtgttccaggaggaggacgagaccggtcgcgtcggcgtggcgctctccaaggacctcatggccgtcgccggcgaggccctcaagaccaacatcaccacgctggggcccctcgtcctccccatgtcggagcagatcctcttcctcgcctccctcgtggggcgcaaggtgttcgggctccggtcactcaagccctacatcccggacttcaagatggcgttcgagcacttctgcatccacgccgggggccgggccgtgctcgacaccatcgagaagaacctcgagctcagcgcgtggcacatggagccgtcgcggatgacgctgtaccggtgggggaacacctccagcagctcgctgtggtacgagctcgcgtacacggaggcgcaggggcgggtgcggcggggacaccgggcgtggcagatcgcgttcgggtccgggttcaagtgcaacagcgccgtgtggagggcgctgcggaccatcgacccggcgaaggagaaggttgggaacccgtgggtggaggagatacacaggttccccgtcgaggtgcccaaggtggagagcgtcgtcgtcgcgccggcggcggcggcggcggcggcggcggcggccgaatcgtgaggagcgtggagcatgcggctcttgtatttgaatttggaaaaaaacatgtggaattataaaagtgtatgttgatttgagttgagcgtggggttaggtttgtaaacatacaagaacgaaatttggtggttggttggttggagatgtatgtagctgacatgtatgtgttggagcttcgataggaagcaaaaaagtaaacctgatgttgattctttgcgttgggtcgggttaatttggcgttgggggaaataaggaatgcaaaattgtataaaaactcgaaactgattgtgtaccattagcactcagcgttgtaacgttcatgcttctatcttaatataaagatgtgcaat

SEQ ID NO: 56 - DNA, 2181 bp, Setaria italica
aatcgccctgctaatcgcgaccacgcaagaacagctcatctcgacctgctaatcagctgctcgcttgcgtgctctgcccgcctaaccgcgctttgtttagctacagagccggcgactttgtttccctcccgcggcgtcggtataagtagtcgcggtcgccgccgtcgcctcccttcctcgcaccctcctctgctctgcatcgacccctctttcttcttcttcttcctctgcccggacggcctctacctggtggggctccacacccccaaccaatccccgggcctctgctctggccgccatgaattcctgctcccggggccttgccgtggacgacgggctgtgcgcgggcggggatctggcgcggccgtcctcatgcctgctcgtcgcttcctctccctgtagcctgaccaagcagctatagcgagcgagagcagagtgcatcggccgagttgaaattaagcaagccaaacctccctccctcgcgcagctcggcgcctccttcttgggcgcccaaggaagcgacttcggagtacagcaacagcaatggcgggagctggttcccagtgacgcgcgccatggatccccagccgttcgtgcgactctccgtcggccagctcggtctcaagctccccggcgggaacgccagcaaggcgtcctcccggctctgcgactgtgagatccggctcggcggtttcccggtgcagacggcgcaggtgcccctgatccactcgccggagttcaacctcgaccccttcaccaacgcggcggtcttctccctcgacgagtccgacctcaggtccctggcggcgccggggtgcttccgccccccacggccgtgcctcgaggtcgccgtctacctggcccgcttcggcggcgcgcgctgcggcgtcacgtggaggaagcggctcgtcggcgtgttcagggtggagcttgcgtcgtcgtcggagtggcgcgacgggaagcccgtgctgctccaccatggctgggctggcatcggcaagggtgcggcggaggccaggccggagctccacctcagggtgaagatggaggccgacccccggtacatcttccagttcgacgacgaggtcgcgctcaacccgcaggtcgtccagctccatggcagctcccggcagcccatcttcagctgcaagttcatccgcgaccgccgcaggccgtctcagggtgacgggcagtactggtcgagctccggcggtagcgaggagacggacatggagatggcgatgagaagggagaggaaggggtggaaggtggtgatccacgacctgtcggggtcggccgtggcggcggcgttcatggccactccgttcgtgccggcgccgggcggcgacacggtggcgcggtccaacccgggcgcgtggctcatcgtgcgcgccggcaccacggggtcgtcggacagttggcagccgtggggccggctcgaggcgtggcgggagtcgtcgtcgtcggcgccggcggcgagcagcagggacacggtgcggctgcggctgcacctgctcccggacgggcaggacgactgcgtgctggtgtcggaggcgccactgggcagcgacaagggcggcgagttctccatcgacatggacaggcaggcgccggcgccggtgccggccgcggcggcggcggcggggcactgcgcggtgagcctgggcgccgcgtgcgcggggggcgggttcgtgatgagctgcaaggttgagggggaggcgcggagcagcagaccgttcgtgcagctcgccatgcgccacgtcacgtgcatggaggacgccgccatgttcgtcgcgctcgccgccgccgtcgacctcagcgtcaaggcgtgccggccgttccgacggaagcccggcaagaaggccgcctcgccgtcgcccgaccctctcgagctcgacacgtagaggcacatgcagctcaggacacactgtaaattgaccacgacgtacgtagcatccatccatggccatgggatccaaatccatctaactctgtaaattcacttgttttcaaaaactggacagcatcgcttgcaggaatcaaaactctcttgttgtttgaaaggctccgtttggatcattgcaattgaattccattctaataatcataatttagacacaaattaattaaactaatatagttgtatgtggaatatatttgtatattattgttggccacatg

SEQ ID NO: 57 - DNA, 2053 bp, Setaria italica
caaccagccaaggcaagcgagcagagctcacggggcgcgcgcaaaggcagagccgccgcgagagctaacggccagcccggcccgttggccacttggcctccgcggcgcccgtcctgccgatggcggcggctctgcagccacggcgggcgcggctcctccttttcctcgggctgctgctccacgccctggcgcgtggggccgtcgaggcggcggcgccgttccgggcgagggacgtgctgccgctgctaccgcggcggctggcgtggcagctcatgggcgccacggcgcacagcgccgtcgacctgctcccgtccttcgtcggcgccgtcgcgcccggcggggcaccggcggcctggcgtggcgcgtgcttcgcggagaacgaggccgtcctcagcctcacccccggcgccggcgccggcgcggttggccgcaacgggaccggcgggggactccacggcaacaccagctccggcctcggcggcgccgtcctccacctcaagactgcttcacctgagagctggacatgtatggatctgtatgtgtttgcaactccatacaggatagcctgggattactatatgagatcaaatgaaaatcacacctttgagattaaggcatgggaggaagcagcagaactggaatatgtaaagcagcatggcattgccgtctttctcatgccatctggaatgcttgggacgttgttatccttgattgatgtcgtacccctgttttcaaacaccggttggggtcaggatgcaaacttggcatttctccagaagcatatgggaacttcatttcagaaacgttctcagccctggtctgcgaatataagaaaagaagatgtacattcgggtgactttttggccctttcaaaaatccgaggacgatggggtggatttcagacattggagaaatgggtgaccggtgcatttgctgggcacactgcagttttcttgaaagatgagaatggcaccctctgggttgcagaatccggctatgaaaacaaaaagggtgatgaaatcattagtatgactccatgggatgaatggtggggaatggcacttaaagacgattcaaatcctcagatagcacttctgccattgcatccagatgtacgggccagattcaacgaaagtgctgcgtgggattttgccagaagcatgtacggaaaaccctatggatatcataatatgatatttagttggattgacacaatgtcagacaattatccgcctccccttgatgctaacctggtaatggctattatgtcaatgtggaccagattgcaaccacactatgcttctaacatgtggaacgaagcccttaataaacgacttgggaccgagaaattggaccttcacgggatcattacagagaccgaaagacgtggcttgtctttcaaccagctgctcaccatacccgagcgagacgactgggaatacagcgatggcaaatcgacgacgtgcgtggccttcatcctttcgatgtacaaggcggctggcgtgttcgctcctttcacggagtcgatccaggtgacagaattcactatccgggacgcgtacatgctgaaggtcttcgaggacaaccagacgcggctgccggggtggtgcaacgcggcggcggacaggctccccttctgccagatcctgggggagtacaagatggacctgccggagtacaacaccatcgagccctacgccaacatgaacgagaactgcccgtccgcgccgcccacctacagccgcccggcgcgatgctgacggccgccgtgcaaaccgtgtactaagtgtaaatagactacgcacgctgcgtgtgctgtgcggtggtctcgctgtatgtgcggctttgtccacagttcctttctctcacaagtgattgctctgtgactctgagcagagcatatagtattatgcagaggtagttctcgttcatgctggctgttgttcaggcgccgattctgtcgttcttggccgctgtaaagtaattatctggacgtacagatcatgtgaataattggaatgacgatagtactgaagagctttattttttccaa

SEQ ID NO: 58 - DNA, 1514 bp, Setaria italica
catcgcgccgcggccggacaccacttcagcagccaggaaaatctcctgaaccccgcccgaacgagggaaaaaggggagctaaaccctcgccgccgccgccatggccgacgagatcgacgagctgattggcttcctctccgaccccaagccgcaggtgcggagcgcggccgtggacatcgtgcgggggctgacgggcggggaggacggcctgcgggcgctcacggtacgcgccgaccgcgccctcccggcgctgctccgcctgctggcctccgccgcgggaagcggcgcgggggaggccgcggcggactcgctcgtcaacctcagccaggatgccgccctcgccgcccgcctcgccgcgcttggcgccgtcgacgccgccatggacgtcatcgccaggcgcgccggggagcagccggcgctcgcgcgaagcctcgtcatgctgctcgtcaacctcacccacgtcgcgtccggcgtcgccgcgctcctccaggttggggatgaaaaggtgcaagggttgtatgttgcaaagctggtgcgatcattctgtaggtcatccagtgattctgaagagcaagacacttttgaatatgttgcctccatgcttgtcaatatatctaaggtcgaagctggaaggagaatattgatggaacctaagagaggtcttctcaagcagattattcgacaatttgattcaacaaaccaactgagaaagaaaggggttgctggtacaatccgcaattgttgctttgaggctgatactcagctacagaatttgctttctttagcagaatatctttggccagctctacttttgcccgtggctggaaagaagatatatactgaagaagacagatcgaaaatgccacttgagctgtcaagtgcactctctcatgaacgagaagctgttgaggattctgaaattcgccaacataccttggaggctatctatatgattgtattgcaggatgatggccgacgttccttttggtcagttaatgggccgcgaattctgcaggttggttatgaggatgaagaggacccgaaagtgatggaagcatatgaactgattggttccctgcttgttgggaagggcgaaggtgaacaagagcaaggaggagagaagtctcaatgaccccaccccctgaaataaaatggtggttctctcagtttctcacaccatcacttcagaacatggatatgcattaactgggcttccagtagttttcgctgaaactgattgggaattgattgatcagcgccatgttaaatgtatggtcggatcagggcggaactgagcctgcattggaaactgctggaattcacatgttgtgcctaacgctgacatttctgcctgtatacttggagatgtgtgatatcaagtgtatcaagttcttgcaatgttcatgagttgaactacaaccaaggtgtaataggacgtttcgataaatatttttctccttttggatatatatcctgtggattccaaatatcagtttttgaaatataagcgagga

SEQ ID NO: 59 - DNA, 2062 bp, Setaria italica
ctctgctcgtgctctgcacttgcgccgtcggtgcggggaggaagagacgacgacgagacggcggcggcggagacgcgtcggacggattaagccaagatcgcggccactggtcctgctgcagcggcgggggtgtccaagaaatgagcctgcggggggacccggcgccagccggggacgagacggcggaggagctgctggagcgggtccaggggatggtgccggcggcgctggaggcggcgagggcggcgggcgggttcccgggccggtggaaggcgatcgccgccaagctggagactctgccggcgtgcctgtccgacctgtccagccacccgtgcttcgccaagaacgcgctgtgccgcgagctgctgcagtcggtggccgccacgctagccgaggcggccgacctcgccgggcggtgccgggagccgcctccggacgggaagctgaggacgcagagcgccatcgacgcgcttgccgggaagctcgacctcaacctccgggactgcgcgctgctcgtcaagaccggcgtgctgtccgacgcctccggcccgtcgccgccgccggaggctgccgcggcggggtcgccggcgcacgcggacgtccgggagctgctcgcgaggctgcagatcgggcagacggaggcgaagaaccgggccgtggacgggctcctcgaggcgctgcgcaaggacgagaagagcgtgctcgccgtgctcggccgcgccaacgtctccgcgatggtgcagctgctcacggcgtcggcgccggtggtccgggggaaggccgccacggtggtatgccaggtcgcggagtcaggcagctgcgacgggctgctcgtgtcggagggcgtcctgccgccgctcatcaggctggccgagtccggcagcctcgtcggccgcgagaaggccgccctcaccctgcagcgtctgtccgtgtcccccgacgtcgcgcgcgcgatcgtcggccacggcggcgccggcccgctcatcgagatctgccagacgggggactccgtctcccagtccgccgcggccggcgcgctcaagaacctctcggcggtgccggaggtgcggcaagcgctggccgacgaaggtatcgtccgcgtcatggtcaccctgctggactgcggcgccgtgggcgggtccaaggagcacgccgccgagtgcctgcagaacctgacgtcgagcaacgacggcttgcggcgcgctgtcgtgtcggagggcgggctgcgcagcctgctgctctacctcgacggcccgctgccgccggagcccgcggtgggcgctctccggaacctcgtgggggccgtctcgcccgacagcctggtgtcgctgggcgtgctgccccggctggtccacgtgctcagggtcgggccagtcggcgcgcagcaggcggcggcggcggcgatctgccggatctccagcaccgccgagatgaagcgcgcggtcggcgagcacgggtgcgtgccgctgctggtgcggctgctggaggcgaagtcgagcggggcgcgcgaggtggcggcgcaggcgctggcgagcctggtgggttgccctgccaacgcccgggaggtgaggaaggacgacaagggcgtgccgaggctggtgcagctgctggacccgagccccgccaacacggccaagaagtacgccatcgcgtgcctgctgacgctgtcggcggcgaagcggtgcaagaagctgatgatctcgcacggtgccatcgggtacctgaagaagctctccgacatggacgtcgccggcgccaggaagctgctcgagaggctggagcgcggcagcctgcgcagcctgttcagtagggactagcatagcagctgtaaaaagtattaactaaagcttcgctcgctgcttatatgatgatacgtaccatgaaattttccttttttgatgtaacatgtaaaaatcaagtgcagtttcacataccgtcgatgaaatggtgctgtgcaggagtttgtgttaactgaatatattgagctgtagcagggtgatggctcgagttaggagcttcacgctctgaataaaatgatgagcaacattgttccgttctgaaa

SEQ ID NO: 60 - DNA, 3950 bp, Setaria italica
taaacctcacagcgcaccaccacttccctttccctcgcccggaactcctatccaaccttcacccaagcacccaacccgaaagggggagcggagccgcagaagcggcggagccccgagcccgcggaggaggggagaaggccgactgatgcgcttccatggccgcccgcgcgctgggcccgctgcctcctctcggtagcatgtggggacccccgcgcgccgccgccggctcccccgccatagaggcctccgccgcggccgctcatgccgcaccgcgcggcggagccgcggtcagctcggccctgtccggccttcgcggaaggccctccttgtgttcggtgcaattcatggatggtcttagaagcaatattcaagcagaagtgaacttggctctttccccaaaggcttcgatgtctaatgggagtgacgattcgaccataacctgtaaaggattctgtacaatagcatggaacctgaaagctgatgtacaagatggttacctaatattcataacaggagaccctgttaccttgggctgttgggaatccaacatggctgttcagttggctcctgttgaaaacgataatatatggacagctgaaataaaggtgccatatggggtgcacttcaaatataattattttgttcgagaagaaaaaggttcctgttctgatattatatggaggccaggtccagattactccttatcaataccttcagttggccggaaaaagcaggtcattgttgtgaaagatctatggatgaaaaccagtgtggcaggtcttcctgctccttcgtggggatcatggctgatggaagctggttctcttgaaggtgaatttttcgagggtggaaatcatcaaagcattgtggaagctcactctgctagggatacaacagatcaagatttatctgtaggtgagcatattatattgaaaatggggaatggcacacctttacattcaaagctgttgtcagagagtctatctaccaaaatgcacaatcgtataaccgacaaaccaaatgccaataatataagccaacatggaaggtatcaagttgtagaggagccatggattcttgaatctattgcggcttcaaagaaaccagttgcaagagtcaaagataagaaaggcaaaaagaagttttccaataataagcatgattttagcaaagctagtgaaaacgtgcctcaagaggatcagcctgttgaagagccatggttatttgaatctatggtggaagcaaatgaaactatagttcatgctgatggaaaaatagaagccaaggatattatcagaaagctaaggaaaatagaaaagcctccagcacctttggatgagaataagccccctacttgtgaaccttcatcaagagttatacttattaactcctctgtctgcactatgcagagaattgcagtattagaagatgggaagctagttgaactcctgctggaaccaatcaagaacaatgtacagtgtgatagtatttacttaggtatagtaacaaagcttgttcctcatatgggaggagcatttgtagatattggaattttaaggccttcacttatgagcataaagcaaaaccgagatccttttgtgtatcctcaagttgtaaagaacagtagagcagatcctgttgatgattcttactataatgaagataaccttccaacttatgacgaagatgatgatatgagtgatgatgagtttgcggatgaagaaactcatgatggctcatcatcatttccagttgagaatattacagataatgaagaaggcatggctgatgctaaaatagacattgtcgatagtactgaatttgaaggcatttctggttatgatgaagacaaagatgatgaaaatgatcacatggaagatgaatatagtgaggaaatactgcaagcagatcagtcagaaatttccaatgatcttaagactttatcttcaattcaacatgctttgagagaatctgatgacgacacaaatggaagcaggtggtctcaagttcgcaagggcactaaaattatggttcaggttgtcaaggaaggattaggttcaaaaggtccaacacttagtccatttccgtgcctgcgaagccgattttggatattggtttcccgtggtaacaaagttggagtatccaaaaagattactggtatagagcgcaccaggttaaagggaataacaaaattattgcgacctcctggatttacattgacagctcgtacagtcgctgctggtcattcttgggaggaattgcagagggaccttgatggcttgctatctgcctggaaaggaataacggaacatgctcaatctgctgccttggctgctgaggagggagtggatggtgctgttcctgtaatgttgcacagagcaaagggtcaggctctatctgttgttcaagatgattttaatgagaaggtgaagagactggttgtggattctcctcgaacatatcatgaggttacaagctatctccaagaagttgcacctgagctctgcagtcgagttgatctttatgagaaaagaaagcctatatttgatgaatacaacattgagaaggagatagacaatatcctttgcaaaagggtaccgctacaaaatggtggttctctggtcatagaacagactgaagctcttgtttcaattgatgtgaatggtggtcacagtatgtttggtcagggaacatcccaggaaaaagctattttagaagtcaatcttgaagctgcaaaacaaattgcccgtgagttgcgcttgagggatattggtggtattattgttgtggattttattgacatgacagatgattcaaacaaaaggctagtctatgaagaaatgaagaaagcagtggaaaaggatcggtcaacagttggtgtttcagaattatcaaaacttggtttgatggagataaccagaaaaagggttcgaccaagtgttacattcatgatcagtgagccttgcacatgctgccatggtactggtcgtgtagaagctcttgacacatccttttcaaagatagaacgtgaaatatgtcgacgccttgctgcctctcggcgaaaatcagaccctgagaaaccaaagtcatggccaagatttgtgcttagagtggatcatgagatgtgcacatatttgacatcggggaagaagacaaaactaggacttctgagtagctccctcaaagtgtggattttattgaagatcgccagaggtttctcccgtggagcttttgaattgctaccatactcagaggagaaggaaaatggtgaggagaaagaaacatcatcagagtcaccacagaaagagggaagccccaaactctctgtgtttcctatcaagaagtggatgagccgtgcaaagcgagcgaagtgaacctcttaaaaacgtgacaattttattggcatgtgcccttccgggctattcacagattataataacaagagcaaaatcaagaagagggtgatgcatttgattcgcagagatcccagcatcagatatccagatgacctcctgaccaaattacatttgcagttttttttcagatctgtgatgcaaaatatctaggttttaggaaggaagagtagaatgagtattttggagggaaactagactatcagtatgccaggagcaggaggctctgggtttaggggagatcctagtggcgtagcttttccatgctttagagcagttaacttgctagaggcgatcccaatgatttttgtaattcattatcaagacccttattcaaacttttccagtaggcgtgcagtagaaatggattcattctgacatcggaaggcctgccgtctgcggtaggtccgaccatacgccattttcatttaaaattatgctgaagcttatgtgactgtagacataaactcggatgcacccgtacttatgaaactgctactggaaaatggcttatcggttgcatgctagaagtgcgaa

SEQ ID NO: 61 - DNA, 1509 bp, Setaria italica
ctctcctccgagcctttccctgaacttcgatggcgggtggtttggactttggagcggcgatgtggaatcttaagcgccttttcttttccacccctgctcttcttttcgtctcaaagataatcatgggagatggggctttactgtaagaaaagggaggcggttttttaggtccaggaacggcggattcgggtggtttgcttcttttccgagtccaatgttggtttatgaatggcgcgatgaatctttggggggttttgaagcgaggctgcgaggcagagggaggctaccgacgagttctgggtctgattctctcctgggcggggagataaatcatcctgcctggtttcttggcgaggaaccgacaaatcggtcaatgtttgtcgtgaagtgctctgatgattgaaagatgctgtttcggttaatgctcttcttctgcaagtgttactgtcaaagtgagcttaaagttattgaggatgtcagaacgttctgagagtgcaactgaaaagattatgagcagcatcattgacaccattgctgacaatcttcctaagcagaagtctgggcaatttggtccaggctcggtctctgacaaagtgaagaacaagctgtttggtcgtcagaagaccctgcatggagctctgggtggtggaaaacctgctgattgcctgttatggaggaacaagaagatatcatcaagcgttctggctgttgcaacagctatctgggttttcttcgagtggcttgattaccacttcctgacaatcgtttcatttgcccttgttcttggaatggtcgtccagtttgtctggtccaatttctcaaacatgctaagcggatctccttctcaagtgccccgagttgagttgcctgatgagctgtttgtgaacattgctgttgcaattggtgcgcaaataaacaagttcctgagcttccttcaagatctgtcttgtgaaagaaacttgaagcattttgtagtggcgattgctggactgtgggctgctgcagtgattggaagttggtgcaatttcctgacagttatatatattggatttgtttgtgctcacacacttccagtgctctacgagaagtatgaagaccaagtcgacaatttcctctacagccttcttggtctgctgcaagatcagtatcagaagctcgaccaaggtgtcttgagcaagatacccaaagggaacctgaaggctaagaagaacgagtagtttagcagctggatgtcaagaatgaatgggctggtgaactattgctgtgccctcttgtgcgttgcaagcttgtatcaattgttacttgaacgctgcgtgtggctttctgaacatgggcgctagttcattgcccaccgccaccgggtttagacttctaagctgcaatgtatgtcatctactattcgtgttctgactcatttacattccttctcctattacttgtgggatattggctaattggcaagtaatgaagtgtgcccatgattcatttctgaaaactggaagttgcggg

SEQ ID NO: 62 - DNA, 2060 bp, Setaria italica
ccaacccaacgtctcccaactcaaccccgaaactgcaaaacccacgcggccacgcccccaaacaaaacaaagcggccacgcccacgctaaaacccttctcccacatttatcccccacgctgcacatccttctccggtttctccccttctcctcaacccaccggcagcagcagcaccgtaccgacaccgcggcgccatggccgcctcccaccaccaccgcggccacttcttcctcctcgccctctccctcgccgcgtccctcgccgccgccgccgactcctcctccacccacaacatcacgaccgtcctcgacgggcggtcggagtacacgctgtacaacagctacctctccgagaccaaggtgtgcgacgagatcaacagcgagcacacggtgaccgtcctcgtcctcaccaacggcgccatgtcctcgctcgtcgccaacctctccctcgccgacatcaagaacgcgctccgcctcctcaccctcctcgactacttcgacgagaagaagctgcactccctcgactccggctccgagctcaccacctcgctctaccagaagactggccaggccgctggcaacatggggcacgtcaacatcaccgacctccgcggcggcaaggtcggattcgcccccgccgcgcccggtgccaagttccagtccacctacaccaagcgcgtcgacgaggagccctccaccctctccgtcctcgaggtctccgaccccatcaccttcccgggcctcttcggctccccgtcggcctcttcggtcaacctcacggacctcctcgagaaggccggctgcaagcagttcgcgcgcctcatcgtgtcgtccggggtggtcaagatgtaccaggccgccatggacaaggcgctcacgctgctcgcgcccaacgacgacgccttcaaggccaaggacctgcccgatctgagcaagctctccagcgccgacctcgtcacgctgctgcagtaccacgcgctgccgcagtacacgcccaagtcctcgctcaaggtcgccaagggcgacatcccgaccctggcgtccaccggcgcgggtaagtacgacctctccgtcgtctccagcggcgacgacgtgtcgctggacaccggcaaggacaagtcccgcgtcgcgtccaccgtgctcgacgacacccccacggtcatcctcacggtggacaaggtgctgctcccgcccgggctcttcggcggcgcgccgtccccggcgccggcgcccggaccggccgccgacgtgcccgcttcggccccggctcccgaaacatccgcgcccgcgccctctcccaaggccgccggcaagaagaagaagaaggccaagtccccttcacactccccgcccgcgcccccgtcggactcgcccgacatggcccccgccgacgcccctgagggcgacgcggccgacaaggtcgagtcgaagaagaacggcgccgcggcggcggccgcgagcttcgcggccacgggggcctgtgtcgccctggccgtcgcgtccttcttgtgagcgggcgagcggcaggtgttcgacgccgagcccgcccccgtagttctctctctctgagcatgcgtgatccgacgcgatgcaatctgttgttgctcgtgagttctcgtgggctccattgataatttgacatgctcatctcatcaggtgtttcttctcctccttgtttgctggttggtagttagtaggaagtaggatttggtcctccacttctcaggtggagaccgtgattgtgatgcttttgctagtattgagcccggaactgtcatttgaggttgatcttgtgtcttgtgctccttccaggctccagctgcattttgcatatccagccagtagtttcctgcagcttcttgcaattccttgtcattctttgatctttaaccgtactacgccgccggcgatggcccttgtggcaggaggttggattgatgtggctaatgattgttagcactagtgattttataatgctataagatttggtcactcgtgtactcctatatgaaagcagtaagcaggcaggcgaaaaatgtgatccgtattaattcaactga

SEQ ID NO: 63 - DNA, 1506 bp, Setaria italica
cggcctcctcctccaatcctccgaacgggcgctccacggccgactcagcgcctcgacctccgatccagcggccgaaggcagagagaggtgggagcagcgagcgcatttgcaaacaattcgactggcccaatggagcaagaagacgaatcagaaggtgctgcagcggagcaaccggcggacgaagcagaggagcagctcgccgacgatctcctcctgcacttcgagcgagtcctccactccgaccccctcattgacgaggtggggttcttgcatccgacgcagttcggctcgctaggctgcggccaagatggcgattctgcatcccaggctccggagttccagcacaggtacttctggtgcagagaccacaagcttgccatctgctctgagatcctgcccaagctctaccgcgccgcccgcgatgcgtactacaacacgagaaatgctccatcacaagcagttcatctgatgagcctcaccaaggtgctactcatactttgccctgacatgcttaccgcatggaactccaggaagatggttctgtcggagaaatatgatctcacaaagctcaaggatgagctgcaattgtgtgcgctgatcctttcctactcgccaaagaacgagagcacatggagccacaggagatgggtgttaaaacaagttgcagagcaaaaccaagatatggcacagcttgtagagaaggaatctgtactagtgaaagagatagcagagaggtcaaagatgaactaccgtgcatggaggcatcgatgctggcttattccttacatgacaagaaaacaggtgctggatgaactgaagaagtcaacaagatggagtgaactacatgttgctgacaactgctgctttcactaccgcaggtccctgcttcttgcactgctagacagttgtctagggaatggagaggattctgtcagttgggagtcagaaacttgcatgctctggaaggatgagctgaggtggaatgaaatgcttatcagacgctaccaagggagagagtccttgtggaaccaccggaggttcctttcacaatggtggattcggcagttgttttctgttgaagaaacctgcccctcaacgacatcccaggtggatctgttcatcacccaggagataggcctgctgtcagagtgcctgaatgaccctgcggatgagtttggggagtcatgcgtccaagcagagctttcagcactctacattctgtggatatcgaagcaagtcccagctgtgaaagggaagctggaagagaggctgcattctgtttccattgtggggttgaaggatgttctagtaagagcctgccgaccggagaagaggtggctgtggatgaatctgcttggcctgcctgatcgatcacagtgacgacatagcattgcttattgaaattgagggtgtctgcttcgattgcagttgtgacgaaacacaatggattgcattttgtaaccaaacaaacggcaaggagacctttttaattaagcgtttgcttca

SEQ ID NO: 64 - DNA, 1467 bp, Setaria italica
gaaccgcgggccgcggccgcctgtctccagagttcagacagaacatcgatgggcaaaagcgggaagaagcccagggaatcgcaccggcagggccgcggccgccgcgcgtcgcacttcgacgacgacttgccttcatcagcctacgacgccttaccgccccaccataatgactccactgacgacgacgacgacaccaacgaagcaacagcggaggacgaacgagaggaaaatggggaagctggcgagcaggaccagtggccagcagggtccatgccctccaagtttcacctgtaccagctctccgtgcagtctccaaagggggacatcagctacctgcaaaagttcttcctgatgtacgttggcgggcgcgtccctctccacctgcaggaggatttctgtggcacggccctcctcagtaccgagtggatccgtactgatgcaagaaggacagcaatcggcttagatttggaccttgagtcacttgagtggtgccttgaaaacaacctaagcaagataggagctgatggctattcaaggatgttgcttttccatggaaatgttctacaacccaaggaagcccgtcttgtcaagcaaaagttcagtgatcttgtgcaaggccttgatgtaagcagcgagaatggctcttcaggaagtaacagttgcgagcagccaggtcttgctaattcgaagtgcttagccaattcaaccatgtcagaggcagctttgcctggaagggatattatctgtgcattcaactacagctgctgttgcctgcatagtcggaaggacttggttttgtatttcaggcatgcattcagctctctctcgaaaagaggtggcatatttgtaatggatgtatatggtggcacatcatctgaacgcaagctacgtctccaacggaaattccccagcttcacgtatttctgggatcaagaagagtttgatatcataagtcgccaaacaaggatcagtctccactttcaagctggaaagaagcaaatgctgcggcatgctttcacataccattggcgcctatggtcgataccagagatcaaggactgcttggaggaagcaggattcaagtccatccacgtttggatcagggagatgccaaacacccagtcaaatggaaacgccaaggaatacaatgccaaccgagatgtgaagtacgaagaatcgcagcgtttcaatcaaggagacgcttggaacgcctacgtcgttggcgttgcaaacatctagctggcgcatggcgcatacgcgaatgtgatggaacctggtggctcttagttttccctttcaattaatgttgtctgaacgctcacgcttttatcatgacttttgcctcgcattgctgcaaaggtatgcagagtgtactactatcacataaattctgcactcgatcttgaacattgcttgggttacggtttttattttcatttcagaatgaattgttatcacatatcaaaa

SEQ ID NO: 65 - DNA, 1180 bp, Setaria italica
actcactcacagtcacagtaacacaagcacctgagcgctcagacaggtcggaatggcgctcgccgccgccgtcctcctcttgctccctggcattctcttcacagcgatggcggccacgccgtaccctcacggccgcggcggcgacccgctcctcggcgcgtccaagaagtacgagggcagctccgacctggtggacctccggtaccacatgggccccgtcctctccgccgcgccgctccgcctctacgtgctctggtacgggcgctgggaccccgcgcaccaggccccggtccgcgacttcctcctctccatctccgacccgtccccgccgcggccctccgttgcggactggtgggccaccgccgcgctctacgccgaccagaccctcgccaacgtcacccgacgcgtcgcgctcgcgggggaggccgccgacgagtccgcctcgctcggccgctcgctctcccgcctcgacatccagcgggtgctcgcctcgaccgtcgccgcgggccacctccccgcggacacccgcggcggcgcctacctcgtgctcacggcgcccggcgtcggcgtccaggacttctgccgcgccgtctgcggcttccactacttcaccttcccgtcgctcgtcggccacacgctcccctacgcgtgggtcggacacagcggggggcgctgcgccgacgtctgcgcctacccgttcgcgctgccgtcctacatgtcccggagcggcatggcggcgctgcgcccgcccaacggcgacgcgggcgtcgacggcatggtcagcgtcatcgcgcacgagctggccgagctcgccaccaacccgctcatcaacgcgtggtacgccggggaggaccccaccgcgcccaccgagatcgctgacctctgcgagggggtgtacgggacgggcggcggcggcgggtacgccgggaaggtggcggtggacaagcaggggaggagctggaatgtgaacggcaggaaggggaggaagttcttggtgcagtggctctggagcccagaggctaaggcctgcgtggggcccaacgccagtgactaggctgcgttcgtcaccgctagcatgtaggagtagaatattataggagcattatcgttttgggcgatttgtaatcgtattttttcaatttataaagctattaattcgattattattcgcatttgggcc

SEQ ID NO: 66 - DNA, 1956 bp, Setaria italica
ctagtcctacgcacggccacagcccacggccagtcggtctcggtcctctccggtctccgcgcacaaccaagaaagctagctaatctcaccgttccgcatgaactccgaagccgaatgcgcagcagctccggccgccgccgatgcggtgggcggtggcggcggcagggcggaggtcgacacgtcggcgccgttcgagtccgtgcgggaggccgtcgaccgcttcggcggcagcgccgcctggttcgcgccctccaagaaacatgaacactctgaacaagctgcagaagccatcgacgtacaagagcaggctgctcagctagaaaatgaggttgcccgcaaagagagggagactcttgatgtgttgaaggagctggagtcaaccaagaaagtcattgcagacctgaagctgaaaatacagaaagaagccactgaaacatcccctgatgaagctgtcaagtctgaggaaactgatcaggtttctgcgccaggacctgaagagcagcaacctgaaaatgttaccgtggatatggatggcatggaaggcatagaagaaaatccgcagctgtcttctggttcagttttggtggaacttgagcaagccaaagaaatactgaacagaactacaagtgatctggcacaagtgcgggctgcagttgagttactgcgaaatagcatagcgaaggagaaaatattacttgaaagaggccaagaaaagctttcctctaacacctccttggtttctcatttggaggatgagcttgatcagacagcacaaaagctggaaactctgaaggatctgcagaagagacgcaaagatccctcagacatttttattgagatcaagaaaatgacaactgaggttcagcagctcaggagcatggcaaatgattcaaaatctgaagcgatgttgttggctgcagaaatcgagcaggcaaaggccagcattagcacagctgagatcaggtgtattgcagccaaaaagatggaagaagcagctagagcagcagagtcccttgcacttgcagagatcaaagctctattgagcagtcaaagttcttttgaaggtgacaactcttctgatggagtgactctctcaatagaggagtatttcacactgtgttccaaaactcttgaagctgatgaaaactccaagaagaaagtaggagatgctatgttgcaggtggatatagctaacagctcagagtccgagtcggttaagaggctcgaggatgccaaagttgaggttgaagaatgcaagaaggcgctacaagaggccctaaagagggttgaagctgcaaaccatggaaagcttgcagttgaagagatccttcggagatggaaatctgagagtggacacagaaagcggtctatctgcggatctccgaagttcaaaaacgcagcccatcctcgtaaagattcacacagcatggatattactgatgatgtttcagatagatctttcaagcaaactttgtcaattgggcagatactgagtatgaagttaatggggcctgatgggtatgacaaaagtgtctgggacgacaaggcaagcgagatgccaaatatctcacttggtcagattctgaaccgcagtggtgttttgtgtagagaagatatggctccccgcaaaagaatttcaggaaagaggaagaaatttgcattgactgggctttctgttctcctggcgaagcaatctaagagcaagaagaagagagaatccttttaaactgatactgattgtcccaaaaagatcatttagtgtgttacttcgtagtattgtactatgtagcagcagttcaccttgtcattagtagttaatcttcacgctatttaccatctttaggtcctcgtatggaatgtaaccggtagcaatttttgctgctaactagagtagagttgacagttctctaccttgtatgctattgagatctatatgattggatccaatgtttttta

SEQ ID NO: 67 - DNA, 2407 bp, Setaria italica
gacgacacgcccttcgccgcttccgctgctctgcaggctcatgtccactgctggtgcggcatcatcaacggccaagctcgccggcgagctccaccgccatgtcaagtgacccctccgcgcgctcgtcgccttcctcctccgccgcgtcgcctcccaatgacgcgcggcggagagaccaagcaggacaggcgacgccgccgccagggggagaggcgatcgacaccagcggcaagagccgccggggccggcggcggcgcgtgccctggtgcccccccggcctcggcgcggcgtggccgctggacccgcgggcgaggtgggtccggcagtggaaccgcgcctacctcctggcctgcgcggcggggctcatggtggacccgctcttcctgtacaccgtgtccgtgagcggcccgctcatgtgcctcttcctcgacggctggctcgccgccgctgtcaccgcgctgcgctgcgcggtggacgccatgcacgtgtggaacatcgcgacgcagctccgcttgacgcggggcacggcggggagcaagcgcgcggaggggagctcgggcgacgaggagcagcaggcggcggcggccgcgggggaggaggaggacgacgacgaggagggcgccgacgaggtcgcgcgcaagctcccggcgggcgcgaggtccaagaaggcctcggtgctggacttgttcgtcatcctccccgtgatgcaggttgtggtgtgggttgcggcgccggcaatgatccgcgcggggctgacgacgccggtgatgacggtgctgctggtggcgttcctgctcgagtacctgcccaagatctaccacgccgtgcgcttcctccgccggatgcagggccactccggctacgtcttcggcaccatctggtggggcatcgtgctcaacctcatggcctacttcgtcgccgcccacgccgtgggcgcgtgctggtacctgctcggggtccagcgtgccagcaaatgcctcaaggagcagtgccagctccaggcggcggccggggggtgcgcgcgcagcggcgcggtggtggcctgcgcagcgccgctctactacggcggctccccctccgccgccgcggcggggcacctcggcgccggcaggctcgcgtgggcccgaaacgcgccggcccgtgccacgtgcctcgccagcagcagcggcgacggcagcggtggctaccagtacggcgcgtacaagtggacggtgatgctggtggcgaacccgagccgggtggagcggatgctgctccccatcttctggggcctgatgacactcagcacgttcggcaatctggagagcacgacggagtggctggagatcgtgttcaacatcctgaccatcacgggcggtctgatcctcgtcaccatgctcatcggcaacatcaaggtgttcctgaacgcgaccacctccaagaagcaggcgatgcacacgcggctccgcgccgtggagtggtggatgcgtcgcaagggcctgccccgcgggttccggcaccgtgtgcgccagttcgagcggcagcgctgggctgccacccgcggcgtcgacgagtgccagatcgtgcgcgacctccccgagggcctccgccgggacatcaagtaccacctgtgcctcgacctcgtccggcaggtcccgctcttccagcacatggacgacctcgtcctggagaacatctgcgacagggtcaagtccctcatcttccccaagggggagacgatcgtgagggagggcgacgtggtgcggcggatgctgttcatcgtgcgtggccacctggcgtgcagccaggcgctgcggaacggcgcgacgagcagctgcacgctggggcccggcaacttcagcggcgacgagctgctgtcgtggtgcctgcgccggccgttccgggaccggctgccgacggcgtcggcgacgctggtgacgctggagagcacggaggcgttcgggctcgacgccgccgacgtcaagtacgtgacgcagcacttccggtacaccttcgccaacgaaaaggtgcggcgcagcgccaggtactactcgcccgggtggcgcacctgggctgccgtcgccgtgcagctggcgtggaggaggtacaagcaccgcaagacgctcgcgtcgctctccttcatccgcccgcggaggccgctgtcgaggtgctcctcgctcggggaggagaagctacggctctacaccgccatcctcacctcgcccaagcccaaccaagacgacgacttctaggcttctagcctctaggccggtcgaggctggatggctggctggctggcttcatcatgcaaattagtacacgacattgatgcccgatgccctctgctggtgggcggggttgtacagtaatatggttggacggtccaagcatgttccgatcatcacggaattcctcggcagagagaaat

SEQ ID NO: 68 - DNA, 2068 bp, Setaria italica
ttttggcgcaaaagaaatctgtaactaagttgggctgttcaccacgaaatcttcttggcccaagcgactccttttccgtgggccacgcagcaaaactccacccgagtcccgagctagcgatatccgttgcagtacgacggacttgaggagcgctctcgcttgctgccggcggcaactgcagcgatgcgagccgcggcaggaggccgcgcggtgttccacctccagcacctccgcccgcgccctccatgccgagcttctcctgctcccgccaccgcggtcctcccccactccgcgcccgcgagccgcgcctaccaccgccgcctccccaaaggctttttacctactctggagccgggggtttcagcagtctacttgtgtcggcgagtacactccacaacatgtagtgtttcattggatggcagattacagggagagttagatggtgcaaagggagaagtgcgaaaacatgaaacagttggtgcatttcaaaaaataccaatggtgatgcctgcaaccgatatacttatgtcagcacaaaggaaatcaagaaatgtgccaccgacaaagggcatagcaaatatcgctaagcgcgaaaggaacaaaggtgcgaaacaacttgatgccttaatgaaagaactttcagtaccactgagaacatacacagaaaacttccctaagaggagagatttgcatccttatgagaggtctctcattgagttgacttttggggagggttattatgagcaggttctaggacgagtcgatgctctcaggaaaaggattacttctgttggaaagcaacatgcttcagtgtgtgctaagtcaacaacaaaacgtgaagcagaggagcgcctcgctgagggcaaaaagagacttgaagaagctttccagcatggacagcatgccattgatgatttagtaaatgtagcaaaggctttgcgttctatgcctgttgttgatctacatataccgacactatgtctagttggatcgcccaatgtgggaaagtcatcattagtccgcatattatcatctggaaagcctgaggtctgcagctatccattcacgacaagagggattctaatgggtcacattgtatccaatcatgagcgttttcaggttacggacactccaggactacttacgaggcatgatgatgacagaaataacatagagagattgacacttgctgtcctgtcttatctaccaatcgctgtcctgtatgttcacgatctatccgaagactgtggaacctcagtagccgatcagtacacaacgtacaagcatatgaaggaaaggtttggtgatcgcctatggatcgatgttatatccaaatgcgatcttttgggcaagaaagcgcctataagctttgacgacgctgatgaagatgtgacacaatacagaaaattcggtccagaaggtgccctccgggtatctgtgcagagcgaaatcggcgttaaagagctaaaagaaagagtgcaccagctcctgacctcccaaatggctcggatcaaagctgacaaggcggagcatgaaacacaggaagctggcgttagtgttccttggcgaagttagagaatgaatacttgcgcacgttcgatgtttatgtaaattttccactcatgaggaccgcaactaatttgtgagtgtcttgcaattttggccatttcgatgttttagtatgtctccttgctaagttcgtcatttttctccacaagctcactgcaagtatttttcagcagggagttgttcctttcaagaccagatttgatctccgtgagctcgtttttcaaaccaagcaaaattttgacttgctcctcaagttgagcattccttgcctcgagctgcattaccctaccactctggactagcatgcttttttgtctagccatggccttctccctagcaactttctcaatgattacagactacagaatcaaagcacccatatgaagacattctaagggataaataataacaagatgaaataacaagagaacagaatagcaagtcaccttgtatccaagggtagcgctcatcctcactaagtcctcttccttaaaacgcc

SEQ ID NO: 69 - DNA, 1873 bp, Setaria italica
cccgcacggcaccgccaccgcttctccaccaccggccccgcgcacgcacgtacgcgccccgtgccgggctttctcatcctttccacgctgtcgcgggcgccttctctctctctcccccctcccctgctccgttcccccttccggcgttcacaccgcctgctcagcctcgcgtcttacaagaggcgtaggcgcgtagcctccgatcccctgagaagcggaacggcacgcgcgcgctgttgccccgatcccctgagagagggcggcggcgcgagagctgctcgcgtcggcgactcgagccgccggcgtttgcgaagttgctgcagctgcagcttgcgcccgggtgcgtgggacatgagctgcttcggctggttcaagcggcggtcgaggagcgtcggcgggtcggcggggaagcgtggggcgtcggcgccgccgtcgggcccggcgaccacgacgacggtgtcgggggtgagcacgagccggtcggacgactccggtgcggtgcggccggtgagcaagtcggcggggtcggccgcctcgtcgcagtcgcagcggagcatctcgtcgctgtacgaggagcggggccacggccagctgcgggtgttcgactacgaggagctcgaggccgccacggccgagttcagccgcgcgcagaagctcggcgagggcggcttcggcagcgtgtacaagggcttcgtccgcgccgccgacggaaagggggaccgcatccccgtcgcagtcaagaagctcaaccagcgcggcctgcagggacataagcaatggttggcagaagtacagtttcttggtgttctggagcacccaaatcttgtaaagctacttggatattgcgctgttgatagtgaaagagggccacaaagattgttggtgtacgagtttatgccgaacaagagcttggaagaccatttgttcaggcgagctaatcctcctctgtcgtggaacggaaggcttcaggttatcctgggtgctgcagaaggattggcttaccttcatgaaggcgtagaagttcaggtaatctaccgggacttcaagacctcgaacattttactggacaaggacttcagagcaaagctgtcagacttcgggctagccagggagggaccaactggagcaaacactcacgtctcaaccgcggtcgtcgggacgcacgggtacgcggcgccggagtacatcgattcggggcacctgacggcgaagagcgacgtgtggagcttcggcgtggtgctgtacgagatcctgacggggcggcggtcgctggaccggaacaagccggtggcggagcagaagttgctggagtgggtggcccagttcccgccggacagccgcaacttccggatgatcatggaccccaggctccgcggcgagtactcggtgaaggccgcgcgggagatcgccaagctggccgacagctgcctgctcaagaacgccaaggagcggcccaccatgagcgaggtggtcgaggtgctcaggcgggccgtgcaggcggccgagccggatggccgggcacccggtgccggcgccgtcaaggggaagagagccgacgcggccgcgccgtccaggaggtgattgctacagagtcgtcggcgcgcgaaggctctggttggcagagccaaagttagacagggaggggagactgatatgctgtcatcggacgtgacagcacagcacacaaaagagtgttagttttggggtgtatggtgtgggttagtggcggggggcttacaaatattttttgggcacattacttagataacttgtgtacatagagacggctttggcggattgaagttttcctttccctttcgaaagtgagaattttgaaagaattttgcactggctctaagaaatagattcgcac

SEQ ID NO: 70 - DNA, 2493 bp, Setaria italica
agcttctccatcttgagcatcacagcactttcccccccccctccccctcccccctccctcgctttcccttttcgtggccatttgctgctgctcacctgttcttgccagccactttttcgagctaagcgtactacactgtttaagctcagctgttacagttaatcagctcgcagcaaagcccttcgtgcttgcaccctcctctaccacgagagcttagcgaagtacagctcgaagcctcagaggagctagagtgtggcttgtggtcttgtagccaagtttttgctgatagcaagagagccttcgatccgattgcagcggcctcccaccgctccagctttccaatcggcggccagcgccctccagttctcccacttcgcttcaatccaagaagcgcttccacctttttttttcttcccttttttctccctcagtcctcgcccgtttgtttccttcccccaagaagcttggagtaaggcgccgccgcggcccaccactcgcggaggtcggtgtgccttggtagcacgcgctgtccccgggctccacgcatggcggcattacagcaccttggcaaggcggtggacgggaatttccggggggcggcggcggccggcgggatggtgcggccaccgcccccgagcctcatcgccccgaacggcaccgccgccgcccccaggtcctccgcgccgccgagccgtcgggaagagggtgcggcggcggcgaacggcggccctgacctccccgcgccccgttccgtcagcaagccgccgcctgggaagaagttttccaccagagcagctggcggcaacaagcccaggaagccggcgccgccgctctggcagtggcaggctgccttcttcgtctccttcgcgctcaacgtcgggctcttcctccgcacccacccctacgtcaacagcacggtccctccgcaccacgaggagcaccagcaggcctgcctgatgcatctcgacgctgcagacaacagcggcaggagaacggcgaggcagcaggaggagcccgtggcggccggggcgccgtcgacgggcaagccggcggtgacgccggagtccgtgatcaacctcgaccacggtgacccgaccatgttcgaggagttctggcgcgggacgggttcggcggcggagatcgtcatcccggggtggcagaccatgagctacttctccgacgtcggcaacgtgtgctggttcctggagcccggcttcgaccacgaggtgcgccgcctccaccgcctcgtcggcaacgccgccgtcgacggctaccacgtcctcgtcggcaccggctccacgcagctcttcatggccgcgctctacgcgctctcgccgccagccgccgccggcgccggcgcgcccatgagcgtcgtctccaccgcgccttactactcgtcctaccctgccgtcaccgacttcctccagtcggggctcttccggtgggccggcgacgccaactcgttcaagggcgacgcctacatcgagctggtgtgctccccgaacaaccccgacggcaccatccgggaagctgtcctgtcctccgagtccggcaatggcatagccgtccatgacctggcctactactggccccagtacacccccatcaccaagcgcgccgaccatgacatcatgctcttcaccgtgtccaagagcacagggcacgccggcacgaggatcgggtgggcgttggtgaaggaccgcgacgtcgcgaagaagatgaccaagttcatcgagctcaacaccatcggcgtgtccaaggactcgcagctgcgcgccgccaaggtgctcagggcggtctccgacgcctacgagctcccggaggcgagggaggagcaccgcctgttcgactacgggcgccgcaagatggcggagcgctggagcatgctgcgcgaggccgccgccgcgtcgggcatcttcagcctgcccgacgagacctccggccactgcaacttcgccaaggagacggcatccactaaccctgcgttcgcatggctgcgctgcgacagggaggacgtggaggactgcgcgagcttcctccggggccacaagatcctgacccggagcgggagccagttcggagcggacccgaggtacgtcagggtcagcatgctggacagagacgacgcctacgacatcttcgtgaggcgcctcgcctcgctcaagtgaagtgatcgaggaggacgacgcgtggttcgaccatcgatgccgcacacctccggatgtggcgtcgccgcgtcggcatgcccgtgggagcatgagtagagcagaagtatcagtagagtaggaaagaagcggaagaggagcagcgttttgttttgctcttctgctgtgtgttgtgttgtgttgttggggatgtagcagcatctcgaaaatttcttataaaggtttttcattttttccttcttgctaattgctagtatgtgagactgaactgacgtaacaaaaaagatcgaactggaaatacacttgtgagctggacataaatggcaaa

SEQ ID NO: 71 - DNA, 853 bp, Setaria italica
caaatacaaaacgctcgagtcctccgtaaccctaaacccccaaaaccctcgtcgcctcctccgtccatccatccaatcccaatcctcggggcgagcgcgcgcggagagggagaagattccctcggcgatggcggcggtggctagggttttccgcgggtcccggttcctcatgtccccggcggccggcgcggcggcggcggcgggggccaagaaggcggcgccggcgccccaggtcaccaaggcggacgcgacggcggcgaaggagaagcgcgggatcatgaagccggtgccggtctccgaggagatgcggaggttcgccggcggcgcgcccgagctcgcccgcccccaggccgtcaagctcatctgggcccacatcaaggccaacggcctccagaaccccgcaaagaaaacggagatcaactgtgatgccacgctcaaaagcttgtttggtgggagggacaaggttgggatgctggagatctcgaagctactgaaccctcacttcctgaagaactaacaaaagcagcagatggatccagcgatagtactttattggatggccaatccatgttaagtccaggttccactaggtagttaagccaaagtcatgtgatggcgtcaagacttcagactttgttgagcggttgggtttggggtgtgatgcatgtaaaaaggattcccagtgttgtggttgctcttgtgatcctgcaagggcactggtgtgcacaatgatgtgggaaatgcttattcgctaatggcacatcttcctaatcgtatgtttatgcctatcttgttgcagtgaaatgattgtgatcaagtattatggtcacttgcgtgccattgcatacttggg

SEQ ID NO: 72 - DNA, 675 bp, Setaria italica
caactatttaactcactccaccagtccacccatctcccctcccaaagcaaagcaccggcaccacctcacctccaccatcgtcctcccttcaaagcatccttcacgttctcccctgctcctccaagcggttggaattccggagcagcaagagaggaggcatggggttcgtgctggtgatctccctgcccttcatcttcttctccatcctgctcggcttcggctgctacttcctcggcaagcacaggggccgggaggagatgcgggccggcgtcggcgcgcagatctacggcacgccgctgccgccgcccggcgtcgtcggcgggtcctcgccggcgcatgagccgttccacatgaagaaagaaggggctgagaacgtctgagtgggatgtcgtttcgggatttgtttggtttaactgatatagttcattcttttcatctatgctatgttgcggtgtacattgagcaatttggtgcctgtatttgttacttcgttcaggttcaggggaaatggtgattgtggtgtgataaaacgtaatcacagtatgtgcttgtaagcagtaccaatatgcattgtataatggtttgtgtttctcaatgtttggcaagctctgttgcaaggtttgtacgaaaccacaatttttctagactttgcagttcccttgcctgttcgtggaa

SEQ ID NO: 73 - DNA, 731 bp, Setaria italica
gagcagagaaccaacagtacagttcgattcagcaggcaactcgatcgagcaaacatctctgaacctctgatcccttctcgaatcgattcctcgtctattccagagcccgcgctcagctcgtcggcgagatggcgtacatgcgcgtgacgcaccgcgacgaggagggcaagaaggtgacggagaagatgcccatcccggagacgcgccgcccggacacggccaagcacttcgagcgcaagctggaggagcagggcttccaccgcctcgagcgccaccccgccaacgcgccccgcggcgtcggcatcggcaccccgccgcccaagtccgggcgcggcggcaagtacacctgggagggccccggcggcctcgtccaggacgagctcgacccggcgccgccagccatcgaccccaatgatcccaactacgaggaggacgatggagccgtcggggctgaggatgatgcggccaaggaggtggtcgtcggggaggtggaggtcgccaaggtcgccgaggagagggacggcgtcgccagggttgacgtcgcgccgcagctcctccaggagcagaagcagtagctagttccggttgcttcagtgctcactgctcagctagctcatcgtggtgtgggttttgctccgtgtggagctaatcaacttgggtgtgaactgtgttttggtgtactaatcgtcaatcaataattgaatgtgaattgaactccaattaactcataa

SEQ ID NO: 74 - DNA, 2886 bp, Setaria italica
acacagcagcaccgtacccacagctagccacccacccactccagcctccaaggaaccgtagcagccgctgccacttcagcgagtagcgaagatgttcggagtgaagatcccgatcatcgacgacctgacgggcggcaacaagcatggccacttgaatggcaacgtggtgctcatgcgcaagaacgtcctcgacgtcaacagcatcgccggctccctcatcgacggcatctccgagttcctcggccgcggcgtcacctgccagctcatcagctccacagtcgtcgaccccaacaacgggaaccgcggcaaggtgggcgcggaggcgagcctggagcagtggctgctgaacccgccgccgcttctcgccggcgagaaccagttcagcgtcacgttcgactgggaggtggagaagcacggcgtccccggcgccatcatcgtcacgaacaaccacgcctccgagttcttcctcaagaccatcaccctcgacaacgtccccggccgcggcaccgtcgtcttcgtcgccaactcatgggtctacccccagtccaagtaccgctacaaccgcgtcttcttcgccaacgacacgtacctgccgagccagatgccggcggcgctcaagccctaccgcgacgacgagctccggaacctccggggcgacgaccagcagggcccgtaccaggcgcacgaccgcgtctaccgctacgacgtctacaacgacctcggcaacccggacggcggcaacccgcgccccaccctggggggctccaagcaccacccctaccctcgccgcggccgcacgggccggaggcccacggagacggaccacgactgcgagagcaggctcacgctgctggatgacgacgtctacgtgccgcgcgacgagcgcttcggccacatcaagtcggccgacttcctcggctactccatcaaggcgctcgtcgacggcatcgtgccggcgctcaagggctacgtcggcgtcgagttcaactccttcaaggatattatccggctgtacgagggaggcatcaaggtgcccgacgtccccgcgctcgaggagatccgcaagcagttcccgctccagctcatcaaggacctcatgcccgtcggcggcgacttcctcctcaagctccccatgcccaagatcatcaaagaggacaagaaagcttggatgagcgatgatgagttcgccagggagatactcgccggcgtgaaccccatgatcatcaagcgtctcacggagttccctccgaaaagcacgctggacccgagcaagtacggcgaccatacgagcaccatcacggcggcgcacatcgagaggaacctggagggcctgaccgtgcagcaggcgctggagagcaaccggctgtacgtagttgaccaccacgaccactacatgccgttcctggtcgagatcaacaacctggacgacaacttcatctacgccacccggacgctgctgttcctccgcggcgacggcacgctggcgccggtggccatcgagctcagcctccctgagctccgcgacggcatcaccgccgccaagagcactgtgtacacgcccacgtccaccaccggcgccgaggcgtgggtgtggcacctcgccaaggcctacgtgaacgtgaacgactactgctggcaccagggcatcagccactggctcaacacccacgccgtgatggagcccttcatcatcgccaccaaccggcagctcagcgtgacgcaccccgtgcacaagctgctcctcccgcactaccgcgacaccatgaacatcaacgccctcgcgcgccagaagctcatcaacgccggcggcatcttcgagatgaccgtcttccctcgcaagtacgcgatcgagatctcctccaaggtctacgggagctggagcttcgccgaccaggccctccccaacgacctcgtcaagagaggcatggccgtcgaggatccctcgagcccgtacaaggtgcggctgctgatcgaggactacccgtacgcgtcggacgggctggcgatctggcacgccatcgagcagtgggtggctgagtacctggccatctactaccccgacgacggcgtgctccaggccgacgccgagctgcaggcgtggtggaaggaggcgcgcgaggttgggcacgccgacctcaaggacgagccgtggtggccgaggatgacgacggtggcggagctgaccagggcctgcgccaccatcatatggatcgcgtcggcgctgcacgccgccgtcaacttcgggcagtacccctactgcgggtaccacccgaaccggccgtcggttagccggaggccgatgccggcgccgggcacggaggagtacgcggagctggagcgcgacccggagaggttcttcgtgcgctccatcacctgccagttccaggccgtggtggggatctcgctgctggagatcctgtccagccactcctccgacgaggtgtacctcggccagcgggacacgccggggtggacgtcggacgccagggcgcaggaggcgttcaagaggttcggcgcgcggctggccgagatcgagaagcgcgtggaggccatgaacgcggacccccggctcaagaaccgcaacagcccggcaaagttcccgtacacgctgctctcccccaacgtctccgaccgcgagaacgccggcgtcaccgccaggggcatccccaacagcatctccatctgatggatcggctgaggataacaatattcaacgaggaagtagcggtgggtgattcccgttatattctgtttcatttcatccatgagaagtgtgtggagtggtgtgacaataaaggatttgtagccttgggcgtgtaccaatgatgtacttgcattgctttgtaattgtaaggtatcccaataatgaagcgaatatatatcctg

SEQ ID NO: 75 - DNA, 1289 bp, Setaria italica
aaacagtctctctctttctctctcgtgcgcgacaaggcgtcctcgggcggcgtgagggcgcgatggcgagtggctgcggcgggcggcgggggcggaagccgagggcgagggcgcggggcaaggggaagaagaccaggtacctcagcctcagcgatgtcctgattaaggtggaggcggaggcggggacgccgccgcggtcgcaggaggatgagcccgcgccggtgtgggaggaggcggaggtgaagcaggaggacgccggggatggaggcggccagcagcagccgccgcagcaggtggagccgttcgcgctgcacaacgaggcatccaccctgttcgcggcgctgccggcgccgtcgctctccgacatcctcggcgcctccgctggcggcggcgacggcgacgagtcgccctcgccgtccgcgtcgccggacgggggttccggggggtcggagttgccgtgcgcccaagaggaggacctggcgcggcgcgcgctaaggggcagggagcgttgggtgtactgcagcagcggctcctcgccgacggccaccaccgccaccacgtcgtcgtcgtcgccgtgctcctccgcggcgagcacgggcgcctcggtgcggtcgctgctgctcaagctggactacggggagatcctcgccgcatgggcggaccgggggtcgctctacatcggcggcggcggcggaggcgcggacagcgacgccgcgccggagctggagctcaacgccgtgttggtggaggtggagccgcctgagcatgccgcgagtgcgccgccaccgccggcgccggcggcgttcgcgtggaccgcggcggagacggaggcggcggggcgcgagagggcggagaaggtgaggcgatacaaggagaagcggcggaaccggctgttcgcgaagcggatccggtacgaggttcgccgggtcaatgccgtcaagcggccgcggttcaagggccgtttcataaaggaacatgaggatatcaagctccagcccacatagcccccctggcttcttccatcaccacaaggatagcccgtgtatatacggttagttgccttgttgtcttatcccagttattctgtatcctctaccctgggcaagttgcaagcttcaggtgtagatcagtagaggcaaagtcatatttcgtaggatgaaaataacagaacttaaaagattgacccatgaggtcagtgatccaaggcgatctgttcgtcgtttcttgatctatcgtttggattactcgtttgcaaactgtgaacaagggcaatgttcagttggctacaa

SEQ ID NO: 76 - DNA, 1849 bp, Gossypium raimondii
tttatcttctcatttcttcactgtgtatagagaataagctaaaaagcaaatcaaaccatcttccaccattctttgttgaacatatggctggaggggagcagaaaaagggtggaggggagcagaaaaaggctggcggtggagggaaaaagaaggaagtgaagaaggaaactggtttgggtctctcctttaccaaggatgagaattttggtgaatggtactctgaggttgttgtcaatggtgaaatgattgagtactatgacatttctggatgttatattcttaggccatgggcaatgtcaatatgggagaacatgcaaacgttcttcgatgcggaaatcaagaaaatgaaagtcaagaattgttatttccctctttttgtatctccgggtgttttgcaaaaggagaaggatcacatagagggttttgctcccgaggttgcttgggtgacaaaatctggtgagtctgatttggaggtgccaattgctatccgcccaactagtgagacagttatgtatccctactattctaagtggataagaggacaccgtgacttgcctttgaagcttaaccagtggtgcaatgttgttcgatgggagtttagcaaccccacaccatttatcaggagtcgtgaatttctatggcaggaagggcatactgccttcgcaaccaaggaagaggcagacactgaggttcttcaaatattggagctataccgacgtatatatgaagaattcttggcaattcctgttacgaaaggcaggaagagtgaactggagaagtttgctggtggactttacacaaccagcgttgaggcatttattccaaacactggccgtggtattcaaggtgcaacctcccattgtttgggccaaaacttcgcaaaaatgtttgagataaactttgaaaatgaaaagggggaaaagtctatggtctggcagaattcctgggcatatagcactcgaacgattggggtaatggtgatggttcatggggataacaaaggcttagtgctgcctccaaaagtagcagctttgcaagttattgtgattcctgtgccttacaaagatgcagatactcaaggtatctttgatgcctgtgctgccactgtggcaatcctctctgatgctggtattcgtgctgaagctgatcttagagagaactactcacctggttggaagtactcaaactgggaaatgaaaggtgttccactaaggattgaaataggacctcgagacttggcaaataatcaggtgcgtgcagttcgccgtgacaatggagaaaagactgatatctctagagtctttttggttgaacaagtaaaaggaatgttggaaaagattcaacagaacctatttgatgtggcaaaacaaaaaagagatgcctgcattgaagttgtaaaaacttgggatgagtttataaaagctctcgggcaaaagaaactgatcttagctccttggtgtgatgaggaggaggtggagaaagatgttaaagctcgaacaaagggtgagatgggagcagctaagtctctatgtaccccatttgaacagcctgaacttccagaaggtactaaatgctttgcttctgggaagcctgcaacaaagtggacctattggggcagaagttactaggtttattcactttttaaaaccatctccttttcatggttctttgcctgatgtcaacggttctggtcattggggccattgtaaacggggaaattttcaatttaaaattgttatatgaaactgatgagaggattcagtttttaatcatgttaaaacttctgtgatctttctttttcctttttgtctgaattttgctttgctataatagatatactgtgttttat

SEQ ID NO: 77 - DNA, 1694 bp, Gossypium raimondii
gtaaaaaccaaaagtacacctgtcggaccaaagtaaacaacaaaaaaaaagggaaaataaggcaaagaaaatctttcatccatggtgggtcttggcgataacaacaatcccagttgccaaaacaacatcagcagcaaagcaaaagacaagaagaagaacaagaagaagaagcgtgggggaagcaagagaaagatgacggctgagcaaacctcggctttcaaatcggtgaccgaatgggtttatttagaccggcaccaccaccccaattcttcttcgacggcgggtttatcgtcgtgggtggtggatgattttggtgtgcaaaagagtttggggagagggacggagaaaatggtgtttgaattgcattcccattcgaaacacagtgatgggttcttgtctccttctaagctcgttgagagagctcatggcaatggggtgaaagttcttgctctgacagatcatgatacaatgtctggaatcaccgaagctgtagaagctgctcgcagattcggtatcaagataatcccaggtgttgagatcagcaccatattctctccaagaaatcctgaaatggaggaaccagtgcacatccttgcatattacagcagctgtgggcccacgaggtacgaggagctggataaattattggctaacataagggagggacgttacgtacgtgctaaggacatggttttgaaactcaataaactcaagctacctcttaaatgggagcatgttacaaagattgcaggcaagggagtggctcctgggagattgcatgtggctcgagctatggttgaagcaggttatgtggagaatctaaagcaagcttttgcaagatatttatatgatggaggacctgcttattccacaggaagcgagcctcttgcagaagaagcagtgcagctgatatgtgaaaccgggggtttagcagttctcgctcatccttgggcactaaaaaacccgattcctatcataagacggttaaaagatgcaggccttcacggaatggaggtttatagaagtgatggaagactggcagcatacaatgacttagcggatacgtacaaccttctgaagcttggagggtcagattatcatgggagaggtggccatggtgagtccgaactaggaagcgtgaaccttccagtggtggttctgcacgactttcttaaggtagctcgacctatctggtgcagtgccattaaggacattctagagggttatgcaaaggaaccctctgatacaaacctcgccaagatagccagatttacaaggatgggcagtttcaagggaagtactcccttgagttgtggcaaggacttgattgatcgttgtttagcatcgtggttgactgcagaagaacagcagaatgatgaattcgaggccattaggttgaagctttcccatgctacgatcaacctcagtggagttcaagttcctatagagaccaaatagtacttgattggagggaaaaaaaagagattaggtaccatttgattcttgccattgttgcaaagataaagagcgagtggcatattcctttggttttgttcaaatctgaactagaactaatcatatttggtgattcaacccgtgtgtatttttggttttattgcctaattataaaccatgtaccatctatatcttgccttattttttgttctaatgctttgctctctagaagttcacta

SEQ ID NO: 78 - DNA, 2879 bp, Gossypium raimondii
atactttcctatcatttaactctaaaaagttaaagtctttctctttctgagtcagctcaggtctttaggttgggaatttgatagtcatggatggttggctgaagggatctaatagttttgtggatagggtaggactaaatgacggtacggtcttagctttatccggtcgggatttcgataaccggtttaagaatgagaaatgtgtcgatattccttcttcggaacctgttatgattccgggaaattcagggaacgtagtgtcttccttgggaacttgttctgatagagttggactaaatgatggtacagtgttggccttatccggtcgggattttgctagccagtttaagaatgagaattatgttgatgttcttcctttggaacatgttatggttccgggaaatttagtgccttcctttggaacctgttctgatatagtaggactaaatgttgatagccaacctgttccgattccgggaaattcagtgccttcctcgagtgtgaacgagggagatttgcatgaggattttgacttcagcgatgaagttcttaagtacataagtcagatgcttatggaagaagatatggaagataagacttgtatgtttaaagagtcatcggcagcacttcaggctgccgagaaagcattttatgaggttctcggagagaggtatccaccttctcctgaatatgatggtgatcaaaaccaagaaagctccgatgaaagtcatggtcaaaattgttggagatgtagtagtgcaagcattagtagtggtagcgtagttgatcccgggcacaaccacgatttcagtgagcaaagggctctgaacttcccatcccaggctagttcatctcatagctcgggaaacagtactggtagtgtggtagatggatatgcagattctccggtaagtactgttaggcttcctgaaatatttaacaatagtgagtctgccatacaatttagaaaaggcttcgaggaagcgagtaagttcctcccgaatggtggaagcttgtttgttcacggggagaatgacggattgtttctcaaagagctaaaggaagagactaaagatgtggcagtagataaggtggagaaggatgagatttcccaggatggatcaaggggaaagaaaaatccttatcctgaggatctgagtctagagtgtgggaggagtaccaagcaatctttagtttatactgagtctgctgtaagccctgaaatgtttgatatggtgctactaaattgtcaaagtgtaaccgagcttcaaaaagttttgcaagatgaaacgagcaagaatgtgcaacagaacggacaattgaaagggtctaatggtggaaaggcacgtgggaagaaacatggtggtaaaaggaacatggtggatttgagaactctcttaaccctttgtgcacaagccgttgcagctgatgatcggaggagtgctaatgagctaatcaagcaaatcaggcagcattcttcacctatgggtgatgggatgcagaggatagctcactatttcattgatggcctagaggcacgcttagctggttccgggacccaaatttacactgcgcttatcacaaagccgacttcagctgctgatgtgttgaaagcccaccatctgtttcttgctgcttgtccttttaagaagctctcaaatttcttctcgaataagactataatgaatctagctgaaaatgctgctaggcttcatattattgattttggtattctatatggtttccaatggccttgccttatacgacgtctctcgtctagacctggtggaccgcctaagttaaggattacagggattgatcttccacaaccgggttttcggccggcagaaagggtggaagagacagggcgccgtcttgcaaactatgcggaaacattcaaagttccgtttgagttccatgctattgctcagaagtgggacaccattcaaattgaggaccttgggattgatcgtgatgaagtacttgttgtgaactgtatgtacaggcttagaaatctactagatgagaccgtgattgtggagagtccaaggaataaggttcttaacttgatcaggaagatgaatcctgatgttttcatactggggattgtgaatggtgcttatagtgctccgttctttatcacgagatttagagaggctctcttccacttttctactttattcgatatgctcgagactaatgtccctcgcgaaattccggaacggatgctgattgaaagagagatatttggatgggaggcaatgaatgtcattgcatgcgagggtgctgaaaggattgagaggcctgagacttacaagcagtggcagatgaggaacatgagggccggtctcagacagttgcctctgaataaggagatcatgaagatagcaaaggagagggtagatacaggctaccataaggactttgtaatcgatgaggataatcgctggttgctccaaggatggaaaggacgaattgtttatgcactctcaacttgggttcctgccccttagaaggtaaagtcttgcgaagtactttatggtcggattgcaaccattgatggattcacatatatggagacaagtttcccaacaggttacataaataagaaaccgggggctgcttactggtatttatcgaaaaggtgaatccatcatgtaccgaattgctaacatgtaccagagaataatatcggtggtaagatgtattagatcgaagttagcagtttaggtgaacgttaagtaggtctgaccgtcttgagtttcttgttgtattggctatacgaggtaatgttaagtaggtctgaccatctgagtttcaaatcccgacatcattatcctcttattctcatattcaaatgcaatgaagttcattaatgt

SEQ ID NO: 79 - DNA, 663 bp, Gossypium raimondii
gacaccccatttctccctctctcaaactcctttttgctttgctatttgaagtaaagaaagaaaatatgggtgccttggactctctttctgactatatttctgatttggtaaccgtccatggcaaaagaaagaagcgtaaagtcatgcagactgttgagatcaaggttaagatggactgtgatgggtgtgaaaggagagtcaaaaacgccgtttcctccatgaaaggtgtgaaatcagtggaggtgaatcgaaagaaaagctatgtgagcgttagcggatacgtggagccaaacaaggtactaaacaaagtgaaaagcacagggaaaagagcagagttttggccttacgtcccctacaacttagtggcatacccatacgtagctcaagcatacgacaagaaggcaccgtcggggtacgttaaagaggcggtgcaagctttgccgagtccgaatgctgtggacgagaagtttgtcactttctttagcgacgaaaaccccaacgcctgttccatcatgtaggctggccaagagaattaaaggttaaggagggcatgtttgggtggataggacgcaattttgtctgtacaaatgcttaaatttggtgtgtagggttgagtctttgtgaaggaatttcgtttttgaaattttgtttcggaatgttgta

SEQ ID NO: 80 - DNA, 1167 bp, Gossypium raimondii
ggtgtctcatccaaatctattctcttctgaaaatatcctattcctttggaactctctctctctctctcccacatttttctcctcctttcttccctcttctctcattcatttctctacttctctccgccatggtttcgcaccttgtcaccactatccgaaatgtagttggaatcacagggaatgtaatctccctcttcttgttcttgtctcctgtaccaacttttattagaatttggaagaaaggatcagtggaacagttctccccagccccataccttgcaaccttaatcaattgcatggtttgggtggtttatgggctgcctatggtgcaccccaacagcaccctggttgtaaccatcaatggcacagggactgccattgagattgtatacctaaccctcttcctcatctattgccatgacaagaaaaagagagtgaaagtgatgctaatagtgctagttgagattatttttattgcgggtgtcaccgctctggttcttatcatagctcacaccactcaacgtcgatccatggtggtcggaattatagctattttgttcaatatcatgatgtatgctgcccctttatccgtcatgaaactggtgatcacgacgaaaagtgtggagtatatgccatttttcctgtcactagcatcctttgccaatggtgttgcttggactgcatatgctttcctcccttttgatccttttattgctgttccaaatggactagggacattgtttagtttagcacagctgttgttgtatgccacatattacaagtccacaaagagaataatagcagcaagacaagaggccaagatggagatgcatctctcggaggtggtggtcaatggtgataataaggatcccaaaaagaactccacagcaccttagagacccatccttctactatatataactagagagggtgtttaattttgttatgaacatcaatcaccataaacatggtgctatgcagcagcttgtttacctaatcattttccctttcaagtcttctttttcttttgcggggtaacgtgcgggctgaactatcaagttttagatttttgtaaacttattattatgtggcccaacttttctgcatatggttttctccaatccaataataagaggtccctgcaaacttctatgtttaaacctcagc

SEQ ID NO: 81 - DNA, 1262 bp, Vitis vinifera
aaccccaactctccacatctctctccctcaccttcactgacagtgaaactctgtgtgaagacaatggtgggttgtcaaaaatgatgaagggtaggagtttggtctgctttcatggcctgtcattgtgcttttccattctcatcatcaccgcagagggactgtttctccatgacccacaccagcctcaaaccttccagagcatccaaacccgttgttctctcttccattggcagcactaaagcctcctacaatgccctggtttttgaggctgctaggcttttgggtcctccagcaaaatttgacgcttcaaagctgaaagttgtgcccatgggagaagaaattgataattactctggaatcagcccaagagtatacaccctctcccactgtgactttacagctaatctaaccttaaccatatccaatatcatcagccttgatcagttgaaagggtggtacaacaaggatgatgtggttgctgagtggaaggaagtaaagggggaaaagtgtcttcatgttcactgttatttgagtggcccaagcctctttcttgacttggcagctgaattcagataccacatattctccaaggaattgcctctggtgcttaaagctgtgttacatggggattctgtgttcttcagagaacatccagagctaatggatgcaatagttcgggtctatttccactccagctcaactaagtacaattgtatggaatgttgggggccactgaaggatgctgcacagggaagacagggagatcacacccatggttcgttaacagcaagtaaggagggttctcgtcctcaaaattggggaaacccgaaatccatcttccaagctttcttcacgttccttctttgagttgggttgccagcaaaataatctcgaaggcaacattgatcatcaatctgaagtactgcaactattgggtgtcaaggcctaagaaggatttagctttcatgagaaatacaccaggaggccctttaattaatgggaatcctcagaagccagaaatctcattttgcagaaaaggaaatgtttgttttaggaatcatttgattcttttgcattcacatttctttgaatgcaattcttgtggtactgagtccatttgttcattccttattgatttatcaatggctggtgtctgttgctttgtatatccttttatttatcaatggctcttgcctttcatgctttgtgtatatatttgtggcttgtctggcatattatgtgactatagatgggatgaaact

SEQ ID NO: 82 - DNA, 2181 bp, Vitis vinifera
ccctctcagtcgttaatgcctcctccacctctctcctctcactctctcttttatcatctcctttcttcccccaaacccacccactctcttcccgaaaacagagaaacagtccatctttctcagggctttgagccatggattatcacatctatggcttccccaatctcaagatgatcaacatcctcttcctcgcttctttcttcctcctctctacccatgcccattcttctgcattgcccaggaagccctcttcttcctccaactctcctcaaatcaactccaactctgtcctcgttgctcttcttgactcccattataccgagctcgcggagcttgttgagaaagccctcctcttgcccacccttgaggacgctgtcggcaaacacaatatcaccatcttcgccccaagaaacgaggctttggagcgtgaccttgaccctgagttcaagcgctttcttctcgagcccggaaatctcaagtctctccagactcttctcttgtttcatatcattcctaaccgtattggttccggtgagtggccggaggggctttccggagaccccacgcatagcaccttgtccaatgatcggcttcgtttggagagtaagggttctggtgtgaggagtgtggatctggcggcggtggtccaacccgacgccgttcttcggcccgacggggttattcacgggatcgagaggctgttgattccccggtccgtcgaggaggactttaaccgcaggaggagtctccggtccatttctgccgttctgccagagggggcgccggaggttgatcctaggacgcaccgcctgaaaaagccagtgtcggtccctgccggagcccctccggtgcttccgatctacgacgccatggcccctggaccctccctagctccagcgccggcgcctgggcccggcggtccccgcggccacttcgacggcgagagccaggtcaaggacttcatccaaactctactacattacggcgggtacaacgaaatggcggacattctcgtcaacctcacctctctcgccaccgaaatgggccgattagtctctgaaggctatgttttgacagtcttggcacccaacgacgaggccatggcgaagctcaccacagaccaactgagcgagccgggagcgccggagcagattatgtactatcatctggtgccggagtaccagacggaagagagtatgtacaatgccgtgagacgcttcgggaaagtccgatacgatacgctgcgtttaccgcacaaagttgtggctcaggaggccgatggatcggtcaaattcggagaaggcgacggctcagcatatctttttgaccccgacatttacaccgacggccggatttcagttcagggtatagacggcgtgttattcccggcggaggagaaggagaccaaactcgaagccaaaacgagtcgggtcaccaagcttgttgccaagcccaggagagggaaattgatggaagttgcatgtaggatgctaggggcgtttggtcaagattctcgtttcactacctgtcaataaaaacactctcctccccaatttcacaaaacaaaatatgaaacatgtaaagatgaagaaagggtaaattcatttgtttttacgcagccatcaaccatatatgtcatttgtgtaatttggtttaagctccattggattcttaggctaaaagtgcatgtggggttataaatcttgcagttgtacgtagatgctgaaggggatgtgtgctggatttgcttggaaaccctgagaagagaaagttcattactgttattttgttatgaatactgtaattatcaatatccatttatatttttttttttcccaactgagtttgtgtttgtgtttgattcatcaccactggaacaccattgtcttccaccgaaactcactgtcattttttggctgatgggatccttgtgagtcaaatataaacctcctctgtttgatatttttgttttagctattgattaaataagaatgggttttgtatgtgtgcatggacatggaccttcatttggtttggtggtgtaatttgccagcaatggtggtggctggtgggtggcggtgcttttgtctcattgattctatttgtcgtgtaggacagcttgggtgcatagtttctcagggtaggaggggccaccgtcttattcctctaataattgtcaat

SEQ ID NO: 83 - DNA, 923 bp, Vitis vinifera
ctgtgttttggggtttggatttacatttgaaaaaaaacaaaatttttaagtaaaaagaaaaaagcaaagtcgatcgattttcagcttccgaaataacaataaatccaaaatcaaaagcgaagggcggaagatcaacgaatcggaaaattgtgtgacggagatcggaatctggatggcaaatctgtacgtgaaagcggagccgccggcggatctgaaccggaacacggagtggttcacgtacccgggtgtgtggaccacctacatcctcattctcttcttcgcatggctccttgttctctccatcttcggctgctctcctggcatggcgtggacagtcgtcaatctcttccactttttggtcacatatcacttcttccattggaagaaaggaactccttttgctgaagaccagggaatctacaataggttgacgtggtgggagcagatagacaatggaaagcagctcacacgcaataggaaattcctaactgttgtaccagtggtgctgtacttgatagcatcgcacaccactgactaccagcaccccatgctcttcttcaacactcttgctgtgattgtgctagtgatcgctaagttccccaatatgcacaaggtccggatctttggaatcaacgctgatcattaagttgggctggcaatgagaaaacagcttgggttttacctgataaaaggctgctgatccttaccctcgttctgctaaaagccaaatatatattttgtatagaagtcagaactggaaaggatgtttggatatgtaatgtttttacaagctctgttagatatttcatctttgaaataagtgtatcgagttttatctttgtacagtagggattctgtgtatttgccttatcacgcttgaaagtgcttttgttcccatgactcctgcatttgatatatcaaca

SEQ ID NO: 84 - DNA, 1224 bp, Vitis vinifera
gtcttcgatctgaagtctgcaaatggaccgtcccaattagtgcattgcatattaagttccaggatctggcattgaaaaccctaattgatcggtctcgacattcaaatggagttttggggtgttgaggtcaaagcaggagagcctcttgaggtggtacctggggatgacatgcttgttcacatttcacaggcttctcttggagaaatcaagaaggacaaaggaaatgagttggtttgtctatatgcaaatattggtgggcagaagcttgttcttggaacactttctgccgagaaattcccacagatctcgtttgacttggtgtttgaaaaaaaatttgagctatcccacaactggaaaaatgggagtgtgtacttttgtggatataaagctgctaattcagtggaatctgaatcatctgatagttcttctgattctgattctgaatttgaaattgatcttccacataataccactgtggataatgggaagcctcaacagcttaagcaagagaaacctgagtctgctgcagctaagcaggtgaagatcgtagaaccaaacaaagatgctaaatcacccaaggaaaatgatgatgatagcgacaaagatagtgatgaatcaatggatgatgaagatgaatcatctgaggatgaggatatggtcaatgatagaagtgcaagctcagaggatgaagatgatgatgagaatgaagacaatgaggatgacaaaaatgaaatctctaagaagaaagagacaccaaagaaggctggaccaagcaagaaaagacctacagagtctgtttcaaaaacacccgttcctgataagaaggcaaaatttgttactccccaaaagactgatggcaaaaaaagtgatgacaaaaagagtggtggtcatgtagcaacaccttacccttcaaagcaggctggaaaaactcctgcaaacacagaaaaacctaagcagcaggttcagaaatctggtggatcattctcttgcaagtcttgcaacaggtcattcaattctgagaatgctctacaaagtcataccaaggccaagcacactgctgctaagtaaagagaggtaaatccagtagttccttgtgtgaagctcaaacttgtctttttagctggtgaactgagtcatcgtcttaatgtccacggagtttattactgaaaacttggtgggatggattttggtgttatttttacctcttgttgatgaatgtctctt

SEQ ID NO: 85 - DNA, 1641 bp, Zea mays
cacggcgaacccgaatcccgagcacaggccgccgctcgctcgctcgctgcagctacgcacgcacgcgcctgctcctccccttagcttccacaaggctcgactcggccggcggcgatggcgcggaagaagatccgggagtacgactccaagcgcctcctccgggagcacctcaagcgcctcgccggcatcgacctccagatcctctccgcgcaggtcacacagtcaacggatttcactgagcttgcaaaccaggagccgtggctctcatctatgaagttggttgtgaaacctgacatgctctttgggaaacgtgggaagagtgggcttgtggccctcaacctagatcttgcccaagttcgccaatttgtcaaggagcggttgggagttgaggtcgagatgggtggctgcaaagctccaattacaaccttcatagttgaaccatttgtgccacatgaccaagagtactacctttcgattgtatctgaaaggcttggcaacaccattagtttctcagaatgtggaggtattgagatcgaggagaactgggacaaggttaagactatctttcttcccacagagaagcaaatgacacctgacgcatgtgctccattgattgccaccctgccattggaggtccgcacaaagataggtggtttcattagagctgtattttctgttttccaagacttggatttctcatttcttgagatgaacccattcaccttggtaaatggtgaaccgtatcctctggatatgagaggagaactagatgacacagctgctttcaaaaacttcaataagtggggcaatattgtgtttcccctaccatttggaagagttctcagtccctccgaaagttttatccatgaactggatgagaagacaagtgcttctctgaaattcacggtactgaacccaaaaggacgcatctggacaatggttgcaggtggtggtgctagtgtcatatacgcagacactgttggtgatttgggatatgcttcggagctaggaaattatgcagagtacagtggagctcccaaggaggaggaggttctgcagtatgctagagtgcttttggattgcgctacctctgatcctgatggccgtaagagagcccttctaatcggaggaggaatcgctaacttcacagatgttgcttctacatttagtggcatcattcgggctttaagagagaaggagtccaaattaaaggctgcaaggatgaacatttatgtccggagaggtggtccgaactaccaaactggactcgccaaaatgcgcaccctaggcgccgaacttggcgttccaattgaggtctatggaccagaggcgaccatgactgggatctgcaaagaagccattgattgcatcatggccgcgtaaatcacaaatgtggttgttccatttgaagtcacatccgttttgtactagacgttccttgtacgtgattgctctggtaaaacagagaacgatcattgtcatgagtaaactcggcctttgtaacacagttacgcaagtaataattaagatcttggtttggtgctctgccacccttctagggtgggccggtgaggtgaatgtacaaataacaatgcactttgtgatccaccagattgcagtgctctggtatttctagggtct

SEQ ID NO: 86 - DNA, 782 bp, Zea mays
ccaccagtcccaccaccaccaccctctgtcttcgcctccgctgccgattcgaaagcacccgtcctgtcccctcgcaaaaccctagctccagccaccatgaagggcaaggctgacacctccaagaaggacgagggcaggctccgggcgggcggcgccgccggaaagcgcaagaaggccgccgcgagcggcaagcccaagcgcccgccctccgccttcttcgtcttcatgtctgaattcaggcaggagtatcaggcgctgcaccctggcaacaagagcgttgcgaccgtgagcaaggcagcaggggaaaagtggcgtgctatgtcagatcaagagaagcaaccatatgtggaccaagctggacagaagaagcaggactatgagaagactaaggcaaactttgataagaaggagagcacaagctcaaagaaggctaagactgaggatgaggatggctcgaagtcagaggttgatgacgaggatggcagcagtgacgaggaaaacgatgacgatgagtaaacagtctccaaggtcacgaggtagcaaatcgagtgttaggtccccaattagcttactgttttgctgcctttaaatgttaagttgtttcaaacaggtgtttatgaaggggatctattagtttcgcgatgtcgttagtttagtgcattagcaaagaaaaagccgaatgctgctagctgttctgttgcttttcttttgctaaccacttgtgtcacaactttctgtacctgcttcattgattaatctagtgactagtcagttattggttc

SEQ ID NO: 87 - DNA, 1561 bp, Zea mays
gaaaagaaaagcacgggagacgggacgggaccgctgggcgcgccgggccgcgccgagccgagcgagtcgtccactctccactccgcccgccacgcccacgccccgtcctcgcttccgtctcccacaatccaaggacaccgagcagcaggcggcggaagcaacccgctgtgggggcggcgtggagtccagttttgctcggctcgtcgctgggatccgccggccggcgaagcggggaagggaagaggagcggagattggagagtacaagcaggggaagatgtcagacgcgctgatcaacggcctcgccggcgccggcggcgggatcatcgcccagctccttacctacccgctccagaccgtgaacgcgcggcaacagacggagcgcgacccctccaagccggcgttcaaggacggcgccgctcgccagttgtatctggttgtgaagaacgaggggtgggagcgcctgtatggcgggcttatgccctctctcgtcggcaccgctgcctcccagggtgtctactactacttctaccaaatattccggaacagggccgaggcaagggcccttgagcgatccaggagagggcttggcgatgggtctgtcgggatgctccagtctctcactgtcgctgccctgtctggctgtgtcaatgtactgctcacaaacccgatttgggttgttgttacacgaatgcaaactcacagaaaggcaaacaaacagcaaagacctcagggtttgaattgtgctcttgataagccccttgaagctgctacagctgaaaacgctccatacaaaacaattgatgtttttcaggaactctacaaagaatctggagttcttggcttctggaaaggggtaattccggctcttatcatggttagcaatcccgcaattcagttcatgctatatgagactcttctgaagaaattgaagaagagacgagcctctaattttaagggagctgatggattgactgctcttgaaatttttcttcttggtgctgttgcgaaacttggtgcaaccgtcgttacgtatccccttctagttgttaaggcaagacttcaggcaaagcacatgattaacgatgacaagaggcatcgctacaaaggtacacttgatgcgttcacaaagatggtacgatatgagggtctgtcagggatgtacaaaggaatgggcacaaaaattgtgcaaagtgtttttgcttctgctttgctttttatgattaaggaggagctggtgaagggtgctcgactattggtaactggtaacactagtctggttaagaaactaccatcaaagtcatcaagatgaactacgggcatcgcaagcgttagtatatcatcctaaaaagccatttattatccgcataaaccgtaaacaaggtcgacaagctatagagctcgcctctgctttggatatgtcaactgtaggttacacaatagccagtatgattcacgtagggaccaaagactatgttggatagatatttgtatcattcatgtagaatgtatcgtggaagatcgaaacagaagaaaataaataagtatgataatttgaactt

SEQ ID NO: 88 - DNA, 2228 bp, Zea mays
ttcaccggcacacgttacctcacttcacctaacctcgctataatagtaaagtgagagcgccgcaccaagccacaccaccagacgccacccaacaccctaaacccttcgacccaacccgcctccaactccaaagccgtcatggcggcgccgtccccgaccactaccgccgccgccgccgccgccgccacgacccaccaccgcgtgctcctcccatccgcgcgcccccgcgccgcgccctcttctctccgcctcccgctccgcgcgcagccccacgcccacgcccacgcccagcgcgcgcgcctcgccgcccccgtcgcggccgcggccccggccccggcggcgtcgacggcctcccccgagtcccccgcgtcgggcgccgtcgcggggaagcccacggtgctcgtggccgagaagctcggcgccgcggggctcgcgctgctgcgggagttcgccaacgtcgactgctcctacggcctctcccccgaggacctccgcgccaagatctcgctctgcgacgcgctcatcgtcaggtccgggaccaaggtcggccgcgacgtcttcgaggcgtccgggggcaggctccgcgtcgtcggccgcgccggcgtcgggatcgacaacgtcgacctcgccgccgccaccgagcacggctgcctcgtcgtcaacgcgcccaccgccaacaccgtcgccgctgccgagcatggcatcgcgctgctcaccgccatggccaggaacatcgcgcaggccgacgcgtcactcaaggctggtaaatggcagcgcaacaagtatgttggtgtatctcttgtgggaaaaactctcgctattctcggatttggaaaggtcggatctgaagttgctcgtcgtgctaaaggcttaggaatgcatgtgattgcacatgatccatatgcttctgctgaccgggctcgtgcaatcggggttgaactagttagcatggaggaggccatgacaactgctgactttatctcgttacacatgcctcttacgcctgcaacggacaagatgctcaatgatgaggccttcgctaagatgaagaagggtgttcgcattataaatgttgcacgtggtggcgtaattgatgaagaagctctagtcagggcacttgattcaggggtagtagcacaggctgctcttgatgttttcactaaagaacccccagcagctgacaacaagttggtactgcacgagaatgttactgtcacacctcaccttggtgccagcacagtggaggcacaggaaggggtggctattgagatagctgaagctgtcattggagctctgaaaggggagcttgcagcttctgcagtgaacgcgccgatggttcctgctgaggtgctgtcagagcttgcaccttttgttgtgctcgcagaaaagcttgggcgcttggctgtgcaactagttgctggtggtggtggtatcaagtctgtgaaagtgacctatgcatctgcgcgggcccctgatgatcttgacacgagacttctccgtgcaatgatcaccaagggattgattgaaccaatctccagcgtttttgtcaatctggtaaatgccgacttcaccgcaaagcagaggggagttcgcatcacggaggagaggatcctgctggacggctcacctgaaacacctatcgattacattcaagttcagattgccaatgtcgagtccaaatttcccagtgcgatatctgagactggagaaatcactgtggagggcagagtgaaggatggtgttcctcatctaacaaaggttggagcattccaggtggatgtgagcttggaaggaagcctcatcctctgcaggcaggttgatcaaccgggtatgattgggtcagttggaagcgtcttgggtgaggagaacgttaatgtcagtttcatgagtgtcggaagaattgctcctcgcaagcatgctgtcatggcaattggtgttgatgaggaaccaagcaagggcacactgacgaagatcggggagattccagcgatcgaagagtttgttttcctcaagctctaggcgcgaatgtatgtttgaagttgcaagcatggtgtgcaattttgatgtagctagcaatccggaggacggatggttctccttgaaataagcttttaggagtatttttgtagtggcgctcttgaatatggtctggtatcgatgcctacttttgaacggggtgtttattaataaaaacttatatatcaatgcttggctcattggttgattca

SEQ ID NO: 89 - DNA, 1552 bp, Zea mays
caagctctgctcctccttttccactgctctgcgtctgcgtctgcgtctgcactgcttcgcgtctccctccccccgcctccgcccccgccccggcaaaaagcaaaacacggccatggaaggctacgaccgcgagttctaccagttcagcgaccagctgcgcctgcagacggccgccttctcgggcctctccctcggcgactccatctggtcccccgccggccggcgcaacaacagcaacgacgtcctcttcgccgcctccgcgtcgcccgccgacgccgccgccaagagcaacgccgtcgtcgggctcaagctcaacgacggagggcccggcctcatcggctccgggaagctggccttcggcggcggcgccggaggcggcggcaccaacaaggccgaccgctacaacaacaacaacctccccaacaccgacaacaagaccgtgtacaacaccagcagcagcagcttcatgggcaacggcagcagctacgccaagaacaacaacaacaacgccgacatgctggcgttcgacaagatggggagctacggctacaacggcggcggtaataccaacaacaacagcaacggcgtggaggtgaagagctacttcaacaagtccgccgggagggcggcgagcaacaacaacaacaacaacaacagccacgccggcggcggcaacaagaagggcggcgccggggagtacggcaggaagaagcacgccaagagcgagggcgcggcggcggccacggacaagcagcggttcaagacgctgccggcgtcggaggcgctgccgcggggccaggccatcggcgggtacatcttcgtctgcaacaacgacactatggacgagaacctcaggagggagctgttcgggctgccgtccaggtacagggactctgtgcgtgctatccgcccgggactgcccctcttcctctacaactactccacgcaccagctccacggcatcttcgaggccgcgagcttcggcgggaccaacatcgacccgacggcgtgggaggacaagaagtgccccggcgagtcgcgctttcctgcgcaggtgcgggtggcaacgcggaagatctacgacccgctggaggaggacgccttccgccccatcctgcaccactacgacgggcccaagttccggctcgagctctccgtcaccgaggccctcgccctcctcgacatcttcgccgacaaggacgacgcctgatccccatcggatctgtcgtcgggccactcgaagctcggatgcacgaatgaatgaacaaacaataataacgaatggatgtgcatgtatatcgtcatgcgcatgtcccacgacgagacgggagtataccacggtgtagtagtattatattaatacgtaattaatatagtatgtccacctttgtttgatactactaagggctatgtattgaggcacgcgtcccattgttttgtttttataacacttgtgcgatggttgcagaggactagccctctttttttttggtaagatgtctgtattattattattattcgggttccactgacatggataaaaaccatctgt

SEQ ID NO: 90 - DNA, 1582 bp, Zea mays
cactcatatacacacactacacactccctcgcacagcacagccacgcacaggggtcaggtcagtcgcctacgaaattcaatagcacagcgagagccaaggaagaagaagaagcaagcggagcgccatggcggcgtccaacggcgagggccacggccggttcgacgtgatcgtggtgggcgcgggcatcatgggcagctgcgccgcctacgcggcgtcctctcgtggcgcgcgcgtgctgctcctggagcggttcgacctgctccaccaccggggctcctcgcacggcgagtcgcgcaccatccgcgccacctacccgcaggcgcactacccgcccatggtgcgcctgtcccggcgcctctgggacgaggcccaggccgacgccgggtacaccgtgctcacgcccaccccgcacctcgacctgggcccgcgggacgactcggcgctcgtcgcctccatgaggaacggcggtgccaccgaagtcgtcgccggggatgagtcgtcgtcctggccgtgggcaggcgtgttcagggtccccgacgggtggacggcggcgcggagcgagctgggcggggtcatgaaggccaccaaggccgtggccatgttccaggcgctcgccgtcaagagaggcgccgtcctcagggacaggactgaggtggtggacatcacctcctccaagcgaggtgaaggagaggggtcaatcatctcggtgaggacgtccagcggcgaggagttccacggcacgaaatgcatagtgacagtgggcgcatggacgagcaagctgatcaagtcggtgaccggcctggagctgccggtgcagccggtgcacacgctcatctgctactggaaggtgaggcccgggcgcgagcaggagctcaccccggaggccgggttcccgacgttcgccagctacggcgacccctacatctacagcacgccgtcgatggagttcccggggctgatcaagattgccatgcacggcggcccgccgtgcgacccggacggcagggactggtccacgggcgcgggcgacctggtggagccggtggcccggtggatcgacgccgtcatgccgggccacgtcgacaccaccggcgggcccgtcgtccgccagtgctgcatgtactccgtgacccccgacgacgactacgtcgtcgacttcctcggcggggagttcgggaaggacgtcgtcatcggcgcggggttctctggccacggcttcaagatgggcccggccgtcgggaggatcctggccgagatggccttggacggggaggcgagcacggcggccgaggccggagtagacctccgccccctaacgatcggccggttcgcgggaaatcccaaaggaaacctgtctgccagccaaggctgatcggcgacggggctctgtttcatggtttgatgtcaaagtgtgtgctctgcttgccaacttgtctgttaagtgtcttttgggttgttggatttaaaaaacaaaagtgcgcgcatctcctcagtgttttctgcaggctgcagtaataaactggtttggtcagttctattgataatgacagcaataataagttcgttattgtgcagatccct

SEQ ID NO: 91 - DNA, 1200 bp, Zea mays
cacccgaaaaacaaagggaaaaaatagtaaagaaacggagcgaggctcctcctcgtttcctatctatcctgatccaaatccgccctactcgcttcatatatcctcctgcgaggaaaacaattcattccgcgccgcatctgggaaggtctcgtcttgctcgcctccgtccgtcgccgcaccctgcgtcgtcgccatggccaccgacgaagccaccaagccgtccccgatcccaccctatcccgagatgatcctggcggcgatcgagggtctagacgacaagagcgggtcgaacaagtccgccatctccaagtacatcgagggcaagtacggctcgctgccccccgcgcacgcgtcgctgctgaccgcgcacctggcgcgcatgaaggagtccggagagctcgtcttcctcaagaacaactacttccgcgcgggcgcccccgacgcgccgccgaagcgcgggcgcgggcgccctcccaaggcgcgggacccgaacgcgccggcgccggcgcccaagtcgccgtcgtccacggggcgcggccgcgggcgcccgcccaaggccaagagcccgctggaagccgccgtgaagcaggccaccgcggggatgcccaagccccgcggccgcccgcccaagaaggccaagaccgacggcgccgcgtccccgtccccgtcccctgcccctgcccctgctggcgacgggtccacccccggcaagcgcggccgcggcaggccccccaaggtacgccccgccgtgcccagcgagacggccgcggcttgacgccgcttcttggggataatagttcgtcccgccgcgagatgggatggttagggcgtagcaattcgtcccgctgccgtgttaatgttggtaggcttggtctccatgcttcatctaattgttgtcgtcgtcgtcgtcgtcgttgctcaattaattaatggagtaattaggaggattcgatgtgctgtcttctgtgctgtgttgtgttcagttcagtttcaccgtgtgtctctggtgttatgtgctggatctgttgtaagctaagctagggagcttgagtgctgtgttggtcgattaattattataagctgctaatgtggatgtgtacaattaattagaggatggtgatgatgttcgtaaaatgttgatttgagggttttgcactcggctctactatttatatttctgatctgttggcactgctgata

SEQ ID NO: 92 - DNA, 1055 bp, Zea mays
caaccaacgaaaagcgcacgcgcacgcgcatcccggcagtcagtagcgcagctgcctctcctctctttggcccccggagccggagcaagagcgccgccaacagcccgctaccggcgccgtgtcatggcgggggctggagacaaggtggactacgtcttcaaggtggtgctgatcggcgactcggcggttggcaagtcgcagatcctcgcccgcttcgcccgcaacgagttcagcctcgactccaaggccaccatcggcgtcgagttccagacccgcaccctcgtcatcgaccacaggagcgtcaaggcccagatctgggacaccgccggccaggagaggtacagagctgtgacaagtgcttattacagaggtgcactgggagctttgctggtctatgacattaccagacgccagagcttcgatcatataccccgctggctagatgaactccgagcccatgctgacaagaacattgtgataatgctggttggcaacaagagtgatctcgaggagcagcgagcggtgagcactgaagatgccaaggagtttgccgagaaggagaacctcttcttcctggagacctctgcgctccaggcaacaaacgtagagagtgcttttcaaactgtcttgacagagatattcaagatccacagcaagaagaacatggtgtcggagccgaagagcaatggagctgccccagcaatgccggggacaaaggtccttgtcccaggtccggcgcaggaaatcccaaagagcaagtgctgcagttccatgtgatgcttctacgtttggtgctgggtgggttgaaaatatattcacgcaacattgtgttggttttaaatccctgctgaaatacttgggttttggcgggattgtattggaacaccggtgtattttagatatttgtcacaattgtgacatgagggaagggtgtgctgatgtattagttctcttgttctctaattgatacgttttatccctgctgcaagtatctgtagcaccgattgtttttgagatgcgaggtgtgaatttgccgtgtacaagaaataatccac

SEQ ID NO: 93 - DNA, 1870 bp, Zea mays
atagctctgccgcagagacttgctttgcttgacgttcactaggtgcaccaagaagccaaagccaatggcgactctacctctgctcctgcacctgctatgggaggcctctccgtgggcccgtgcaggcgcggcgacggccgccgtggtgctggtgtggctagcggcctggacgcttgagtgggcgtggtggacgccacggcggctagacagagccctacgggcccagggcctcaagggcaccaggtaccgcctcctcaccggcgacgtgagggagaacgctcggctcaaccgagaagcccgcacgaagccactgccgcttgggagtcacgacatcatcccacgcgtgctacccatgttccacaacgcggtgaaggagaatgggacaaattcattcacttggtttggcccgattccgagggtgataattccagacccggaattaatgagagaggttttgtctaacaagtttggccactttggcaaaccactgtttagccgtgttggcaagttactagccaatgggctcgctaatcatgaaggcgagaaatgggcaaaacacaggagaattctcaaccctgcattccaccatgagaaaataaagcggatgctgcctgtatttgctacctgttgtgccgatatgattaacagatgggaaaattcaatgtcttccaaggaaccttctgagatggacgtctggcctgagttccaaaatcttactggagatgttatctcaagaaccgcatttggtagcaactatcaggagggcaggaacatcttccagctacaaggagagcaggctgaacgccttatacaatcttttcaaacaatatttatcccaggctactggctcttgcccaccaaaaataacagaaggatgaaagaaattgatcgggagatccgtaaaattctgcatggaataatcaggaaaagagagagggcttttatagatagtgaaggaactaatgatgacttgctaggcttattggttgagtcaaacatgagggaatcaaatgggaatgcaaaactcggaatgactaccgaagatataatcgaggaatgcaagttattttactttgcaggtatggagacaacatcagtcctgcttacatggacgttaattctgctaagcatgcaccctgaatggcaagagcaggcaagagaagaagttttaaaccactttggaatgggtacaccagactttgataacttgaaccgcctgaagattgtaaccatgattttatatgaggtccttaggttgtacccaccagtagttttcctatccagaagaacctacaaggaaatggagctcggtggcatcaaatatccttcaggcgtgagccttctactgcccatcatcttcattcaccatgatcccaacatctggggaaaagacgcaagcgagttcaatccacagaggttcgaggatggcatttccaatgcgaccaagcatcaggccgccttctttccatttggatggggtcccaggatctgcataggccagaacttcgcgttgcttgaagcaaagatggcactgagcaccatcctccaacgcttctcctttgagctctcatcatcctacactcatgcgccatacaccgtgataactttgcatcctcagcatggtgctcaaatcaggttgaagaagctttgaccatgatggtcatactgaatgccaaaacatgcactcctagtaacatattgtgattgttcatgtatgcaggtttaaatttagctttgatatgaataatgagaaccaagtgtgtatgaatggagtaggggtgtaatcggatcggatacgaacggatattgcttgtaccatatttgtttcatattttctgtttggattcagataacatcaagttgtgtcgga

SEQ ID NO: 94 - DNA, 2904 bp, Zea mays
gcggcgcagcccaaccaaaaccaagcaaacacaacctaaacccatggccgcccttgttttctccaaacaaacaccacatgcaaagccgctaaaatccatttggaaccgatgacacagagaaacggacatcccctctactagttttctctctctgccgccgtccgccggcctcgcgcaccccgtccccgccggcaatcgatcccacttgtcccaggacgcctccgccggccgtcaatcgtgcccctccccagaactcgcactgctctccgtcagttcagttaaaacatgactgctcagacaaagaagagaggcgctacagaaaatggggatggtgttggtttgggtcttgctgccttcattgcaaacaatgaggatgtgggtcccgtagtccggcacgctttcgagtctgggaagcctgaagccctcttgcacagcctccagaacatcgtgaagaataaagaggttgagatcgaagagatttgtagactccactatgaggaattcatccttgctgttgatgagcttcgtggtgtcctggttgatgctgatgagcttaagggcacattatctgatgagaacctgcggttgcaagaggttgctagcgctttgctactgaagcttgatgagctttttgagatttattctgtaaacagtaacgttggggaagccctagctacgttgaagatttgtctgcaagtaaccaacctctgcaaggtatgcaacagggacattaccgaagcaaaattactttctgcattgaaaacattggagttgattgagaaggactacctgcaaaatattccactgaagcttctgaaaaaggtcattcataaacaagttcctatggtaaagctgtacattgagaagaaagtttgtagtgagtttaatgagtggcttgtgtatatcagaaggactgctaaggatattgggcaggtcgcaataaaccagacatctctgactcataagaaagatcagggaatttgtgcccgacaaagggaagcagaagaatctagcctcgttgggttcgacgtgaatgcttacaccttggatgtggagcacatggctgaggaagcaatgctggaatttgatcttgtgccagtgtacagggcacaccatattcacataggccttggtcttggggagaagtttcgagaatattactacaataacaggctcatgcaactcaatttggacttgcaaatttctacatcacaacccttcgttgagtcctatcaacctttcattgctcaggtagctggcttttttattgttgaggaccgtgtctttcgaactgcagatggacttctatctgagagccaggttgatactatgcttgaaacagccatttctaaacttactctgatcttagaggaacagttctctcgcattcatgctgccaaccacctcctcctcataaaaggttatgtcagcctttttggtgcaaccctgaagaagtatgggtaccgatccatgtcgctggctgaaatccttgataaaactagggacaagtatcttgaacttcttctttctgactgccggaagcagctcaacgaggccttctctagggactcatatgagaggatggttataaagaaacaaaatgaatacgacgcaaacatagcggcattccaacttgaccccattgatggagtatcaaatttgccatacgtcgctccattttcctcctctgttcccaatgcttgtcgtattgtgcgttctttcatcgaggagttggtcagctacttgtcactcagtggtggcgtaaacgtctatgatgtggtgaaaagctacttggacaagttcttgattgagacgttgaatgatggttttctgaagctgatacatggtggatccctggaatttccacaggtggtgcagatcgcaggaaatatcgccgttctcgagcagtcctgtgacatgttcctttggcacgccgctcgactttgtggtgtccctaggtgcctcctcgagaagccccattctggattgagtgccagagctgtgctcaaagcctcccagaatgcggcatacaacggatcggttactttggtgaattccaagatcgacgagttcatgctgcagctgactagcatcaactggaccccggacgaagctccagagcacgccaacgactacatgaacgaggtcatcatctaccttcacgaggtggtgtcttccgggcagcaggccgtgccaagggacgcgctgttcaaggttgtatctggcgcgctgagccacatctcggactctatgacgacggtccttctcagtgaccgggtgaaaaggttcaacgcgaacgccgttgctagcatcgacgtcgatctgagggcgctggaggggttcgctgacgacacgtaccgcacggccgggtttctggacctgagaaagggaaccagtttcagagagtgtctagccgaagtaaggcagctcacaaaccttctgctgagcagccagcctgagagcttcgcgaaccctgcaaccagggagcagagctacggagccttagaccacaagaaggtggcgataatttgtgacaagttcaaggatgcccccgacagcctgttcgggagcctctcaggccggggcacggtgcagagcgcccggaagaagtccctggatgtgctgaagagaaggctaaaggattttagctagctggtgagctagatcatttagacaagctagtagcatagtacccctgttttagtgccagtcgtatccatttaaaatttcttttccgtctttctttattccctctttaatcgacttcccgtttcatgcgccgaagagaaggctgaaggattttagctggggtttgctggtgagctagatcgttaaataagctagtgctctgtttagggaagaagacaagtggttcggtgtgtaaagccatttcaaatttctttc

SEQ ID NO: 95 - DNA, 2640 bp, Zea mays
ctaccctatttcaaaacatttcaaaccactcttcgcccccttcctctcctctcatccccttcccccctccactctctcgtgtgtggtctcgcccctgaggttcctgatcgcaccatctccctccggcgacagtccgccgccccgccccgcgcgctcgacgaggccgctccgggtggtgaagagggtgctgctgcagtgtctcccctctcgctatgagtagtgctgtgaaggaccagctacagcagatgtcgacgacgtgcgattctctcctgttggagctcaacgtgatttgggatgaggtcggtgagcccgacatggcgagggaccggatgctgctggagctcgagcaggagtgcctcgacgtctacaagagaaaggtcgaccaggccaatcgatgcagggcccagttgcggcaggccattgcggaggcagaggccgagctcgctggcatatgctcggccatgggcgagccaccgatacatgttagacagtcaaatcagaagttacaaggtttaagggaagtattgaatgcgattgtcccatacttggaggagatgagaaagaagaaagttgaaagatgggaccaatttgttgatgtgatcgagcaaattaagaaggttgcatctgaaatcaggcctgcagattttgtaccctttagaattcctgtggatcagtctgatctgtcattaagaaagctggaggagctaacgaaagagctgcaatcccttcagaaggagaagagtgatcggctgaagcaagtcatggaacatcttaacactttgcattcgttatgcgaggtgcttggtgtagacttcaaacaaacagtaaatgaggtgcaccctagcctgggtgaggctgatggatcaaagaacctaagcaactgtacaattgaaagccttgcatcagctgcaagcagactgcgtgaattgaaagtccagaggatgcaaaagcttcaagatttggcctctagcatgcttgaactttggaatctcatggatacaccacttgaagaacagcagatgttccagaatgtaacgtgcaatattgctgcttctgaacatgaaataactgagcctaacacgctctctattgacttcctcagctacgtggaatctgaagttttaagactcgagcaacttaaagcgagcaagatgaaagaccttgttctaaaaaagaagacagaactggaagagcataggagacgtgctcatttgattggcgaggaaggctatgcagctgaatttagcgatgaggctattgaggcaggagctgttgatccttcgctggtgctggaacaaattgaggctcacattgccacagtgaaagaggaagcctttagcaggaaggatattctcgagaaggttgaaagatggttgaatgcatgtgaggaggaagcttggctggaagattacaacaaagatgacaatcgttataatgccgggaggggggcccacttgacactcaaaagggctgagaaagctcgtattttggttaacaagatcccaggactggtagatgttttaaccacaaaaattgtagcctgggaggcagaaagaggaaaggaattcacatacgacggtgtccgccttatgtcaatgcttgaagagtacatgatcgttcgccaggagaaagagctacagaagaagaggcaaagggatcagaagaaaatccaggatcaactcaaagctgagcaggaagcgctctatggatcaaaaccaagtccttctaagcctcaaagcacgaagaaggcgcctaggcactccatgggtggtgcgaaccgaagactgtctcttggtggagccactatgcaagcccccaaaacagatatactgcactccaagacagctcgtgccgccaagaaggctgaagatttgggcgctttatctcctagtagtagaggcttggacattgccggtcttcccatcaagaagttatctttcaacgcaagcactttgcgagaggcagaaacaccgcgcaagccttttgcccagatcatgccaggaaacaacgtctcaccgatgcctacgcggcccatctccagcgccacagaggaagagaacaaaacccccaggacatttgtaggagggctcaatgcgaaaacgccggcgacagtgacggctcctatgcagatggcgatgacaccagccgtggctaacaaggtcatagccactcctgcaacccttttccaggagaaggcagattcgccagcactgccagcggacatcgagtactcgttcgaagagaggcggctcgctgtttacctggccaggcaagtggcttaaactcggtcattcacgtagttgaaagctgaactgactgcgatttctcgtcagaggccaatgttacctgttggtcgatactcgatagtagtcggcctcgttcgtaccttgcagtactattctgattcatagccatatttgctacagctagtaaggatttatttgggtactctaatattgatctcaatccacatgtgttgaaatgaattggagtgtaaattaatttaagttacacttcaatctatctcaatacatgtggatttgggagttttagacccgtatcgtaagttgtatagcttcacctggttgcatcgtggatgacctgttattgtttattactgttatccaaatatcttgccgc

SEQ ID NO: 96 - DNA, 1275 bp, Zea mays
aactgcctcacgaacgccacgccgccatttcccgcaagcaaagccatccaaaccgttcgctactgcctactactagtagctcgatcgtcgtcgtcatcttcgtcgtttcgctctcagttggcggttagctagcttgcatactagcatcaggtgccccttgccgagccgtacgtgtcgtcgtcgacgacgatggtggcggcgcccagcaagtgccggccgtcggcggcagcgctggtggtggcaccgccgggggcccctcggcgccagctgcggtgccggtgctgcgaggacacgctgggcgtcccgcgccgccggctgcagccgcagctgcacctgaagcagcaggcacctgcggcgacgaccgcccccgccgcggcgccgccgccgaggccccggcggatcgtgctggtgcggcacggcgagagcgagggcaacgtggacgaggctgcatacacgcgcgtcccggaccccaggatcgggctcaccgccaagggctggcgcgaggccgacgactgcggccgccgcctgcgcgacctcttctcctctggatcccgcgaccaggacgactggaaggtctacttctacgcgtcgccgtaccgccgcagcctggagaccctgcgcggcatcggccacgccttcgagccccaccgcatcgccggcgtccgcgaggagccccgcctccgcgagcaggacttcggcaacttccaggaccgggagcagatgcgggtggagaaggagatccggcaacgctacggccgcttcttctaccgcttccccaacggcgagtcggcggcggacgtgtacgaccgcatcaccggcttccgggagaccctgctctccgacatcgtcctcggccgcttccagcccccgggccaccgcagcaccagcggagacatgaacatcgtgctcgtctcccacggcctcaccctccgcgtcttcctcatgcgctggtacaagtggaccgtccgccagttcgagggcctcgagaacctcgccaacggcggcgagctcgtcatgcagactggagaaggcggcaggtacagcctcctagtgcaccacacgcccgacgagctcagggcgttcggcctcaccgacgagatgctgcaggaccagatgtggcagaagacggccaggcccggcgagctcaaccaccgcttcatgacaaacggacagtccttctttgatccatttactgtaatctactagttcttgacgaccgaccacatgttatgtatgtgataagtgattaaatgtttttttttatggctgtacaca

SEQ ID NO: 97 - DNA, 811 bp, Zea mays
gcaagatataataccatttaaaaaaggtatctctcagacattaatattcacactaaagatgtgtctcagactctatataactacgagcaaaccaagatcatcagcaagcatactattagacataccggtatatattattgttcttagtcatcgcacaagactcttgtcaacaagaccaacaacaggatgaggactgccgtgcatgctgcgctttgcattgtgcttgtgataatgtcttcaacactgtcatcttgcgaggacgatgagaaggtatctatcgcatgtgacacaggatgcaatgccgcgatctcccgtctcaaatgcttcctgatggcctattctgaagggaaagtgttggtcagcagcaactgcgaaacgccgaccaggtgcggctgcgtgtttcgtcacaaacaagatgcaacccttatcgccggcgacgttggcaacaaaaagggatattgatggcagacgtgtatttcttggttgaataatatatactgctagaattaatatgggcaccaacaacgaaatatctataatgttattcttcagtgtaatgcttccagcatgttctgttttagtataactaaatatctatctttcccccccaatttaagtttttttttggttctccatacgtggcctctaaaataatcagcctatatatcgtgggtgttttaatttctaaaatggagcatggtgcagtagtctcggaccactaccggaatcagcttctttgccgtgtgtctgagacacacggcaaaggctattttacactcggcaaaggctttgccgagtgtaacactcggca

SEQ ID NO: 98 - DNA, 1799 bp, Zea mays
cacggacacatatctataacaatataagtcatatatgtacataagttatcgtgttattatacgattccgttgcaacgcacggtcactcacctaataatatcttatttcagaccatgagtaccccccttgtgggcactggggccggcaacttcagcagtcagcacgagaacaaaggtagcaaagcaccgggcagctttccctttacgcttcccagttcccactccactcatcctcacgcgccgccgccaaccggcgagcaaaccgaacgaaccagcaatgccggcggccgatccccccgtcactgacgcggtccccgatgaagatgcggctccccgaccatctccacctccgccgccgccgcggccccggcccctctccctcgcctccgcgctcccattctggttctacttcgccgccgccgtctccctcctcgcgctcctcctcccccacctcctgcctccctcctctcccgcgcctctcccgcctctcctccttggacacctcgccgcaggccgcttcctcaagctcgatccagcccccggcctgttcgccgtgacctcccgccccacggccgccgccggcgactcccccgcgcaccgcgtcctcgtcctccctggcctcgccgcgggctccttgtccttccgccgcgtcctctcgtcgctctcctcccgcggcgtccacgccgcggcgctcgacctcccaggccagggcctctccccggcgtcgcccgccgcgaccgcgcccgcccggaccagcgcgctgcgggagatcatgaaccgaggcgtgttccacgccttcgagcatctcgtgcagaccggcgaggtcccgtaccaggaggaggaaccagccgcctcggcggcgcggtctccgcacgcgcccgacgaggcggccgcggccgtcgcgcgcgccgcggaggcgctcggcgtgggccccgtccacctcgtcctccacgactccgcgctcgcggccggggccgcgttcgcgtctgccaacccgggggccgtgcggagcgtgacgctggtcgacgccaccgcgtccctgccggcgttcccggccgcggtcttcgacgtgcccgtgctggggaggctggtgctccgggtgccggcgctgttccgcggcctggtgcggctgtgctgcgtccggggggtcggcgccgaggaggcagaggcgtaccgagcagcgatgcgtggggaggggaaggcagaggcggtggtcgaggcatggaagtcgatgaaccacagcttccagcttggggagtggagggtctcttcggaggaggtgaggaggctgccgatgctggtgctgtggtcgggttcttggtcagatatgtggatcgacgaggggaagaaagtggcggctgcattgcctgacgccaaattcatctaccactccggcggccgatggcctcaggtcgatgcctttgaggaaatttcaggggtgatcaccgagtttgtaacctcagctgaggaagctggaagcagcaggtggtgacgttgagtaggatatatacactccttcgaggatcgttgagcaaatgtaacctggagcagttttcagaccttttagttggtgggtgcagtgacaagtgcaacttgagattttttgttcctggagagtttctgcttgcagcgtctgtaccgagttctgactttacactagcgtgttttttttaactttaatttgttgctaaatggtgtacttgttgtcttgcttcagtttgtaaaacgtgtgtcactgactcatgctagtgtagtagcatgtactcagtttagcgtcgttttgaggtagcgtgttctgag

SEQ ID NO: 99 - DNA, 1905 bp, Zea mays
aatccaaaccctagagagagagagagagagtgtgtagtgtgtgtgtgtgagagagagggggattggaggcgaaggcagcgggctagcgctagcggaggaggagagatccgctgaggtggaacgcccgatcggcggagccccatccaccaccactccacaagatgcggggcgggacgctgcagatcaactggcacgaccagcagccggtgctcagcctcgacttccaccccgtctcccgccgcctcgccacagccggagcggaccacgacgtcaagatctgggaggtagcgtcggacggcaagctccccaccgccaccttcaagaccggcctggtccccaacaccaccgcccacagctccgcggtcaacgtcctccggttctccccttcaggggagtatctcgcctccggtgctgatggtggcggcatcaccctctggaaactgcatcccgctgacgacggcgaggcatggaaaattcacaagacgttactattccatcacaaggatgttcttgaccttcagtggtcgcatgacagcacatttcttgtttctgcatcagtcgacaacacttgcataatttgggaagctagtaaaggcacagtgcaacaaaagctagagggacatctgcattatgttcagggtgtggcatgggatcctttgggccagtatattgcttcactgagttctgacagaacctgtaaaatatatgcaaaaaagcctcagggcaaatccaagaacgcggagaggttgaactttgtttgccagcatacactagtgaaggtagaataccagaatcatgatgaatctaagccaccaaccaaatctcatttgtttcatgatgagacactaccatctttcttccgaaggttggcatggtcacctgatggatcttttctagtattgccagcaggcctttctaaacactcctccgaggtgattaatacagcttatgtaatgtccaggcgtgacctctcaaggccttcgatacaactccctggggcaagtaaagctatagtggcagtacgcttctgccctgtactattcaaaccacgtggttctaactcagatggtttcttcaagcttccttatagagttgtctttgctgtggctactttgaactctctgtatgtctatgatacagaaagtgttcctccaattctagtccatgctggtctacactatgctgccattaccgatattgcatggtcttctgatgctaagtacctggcagtgtcatcacgagatggctactgtactataatagagtttgagaatgaggaactgggacagcctcacatactccccggatcaaaggaagttgctaatgggaatctgacacctgagaccaagaagcctgtatgtgctgatagcatgaaggttgataatagtgccaacaagcttaagatggaagccagtcctgttgctgtaggagttagagcaccactgctgccaactgagaacatcaagagaacaggagagcttgccgaaggaaatgtaacctgtgaaaacaaggagccggtaacaatagacagtatggaagtagatgccgatgataccaaaggcaaggaggcaaccatacccgtggcagctgaagtgacaccgccaccagcggtaccggcagcgaagaacagcgcatctagtaagcctgctaagaggcgaattactcctatcgcaatcgactaggtagtagacgcagcagttagggttttgatgtgttatgtagtgatggcaagtactggatactatgtttaggctaccctgtaaagtcgtttgtgctgcggtgctcatcttctgctctagtcctcctgctcttgacacaattggggagaatgtgaacagaagggctgtgtgtatgtatgagcacactttgttatggcgcaacatgcaagccactaaccgacatctt

SEQ ID NO: 100 - DNA, 1305 bp, Zea mays
aaacaccatcaaacggcagcccatcggccgtagtatcttgctcctcgccctccatccgaacaacagcaggagcccgagcccgaacccgatattccgcattcctacccagcaatggtggcccttgtctaggtggacgcggtgcaagaggcgaagcgggggccgatggatgaggaggggcagcgaacgccgcagccgatggtggtcgcgcggaagcgccgccaagccacgccggatcacccaccctactgctggatgatcggcgaggcaaccgacgcgctggccgaggacggcggctcggaggaggactccatctctgcctttatccgcgccaggcaccccggcgtgccccccgcgcacgacaggctcctccggcactacctcggcaagcacgtcgccgagggcttcttcgtgcgaactgccacggggcggttcgagcgcagcccccaggagaacgctgatgaggaggagctcccggtggagcaggctgatcaggccggctcgtgcaagccggcgtccgttgggtcttcggtggtactggtagaggccaagcccaagcgtggccgaggcaggccgcggaaggatggctctccttcgacactggccgttgctgcaatgtcatcggttgctgttgccggcaaggacgaaatccatgcaccgtccttgaagcccaagcgccgtggccggcctcgcaggcaggcaggggcggaccacagggacaaggagcatgagcctccgcgtgagctggcactggtgatcctcggtgatagctctgccgcaccgatcatggacaagccatgcacaaccttggtccctccaaccacgccgcctgtggacggtggccagcctatcgacctggctctggcgaccaccacagaggtgcctgtgcctgaacctgcggcaacgcccgccatggacaaggacggtgccgatgccgatgcttcttcaatcgaatgacagcatttgcacagcgcccacttcgccagagcctggcagctgggcttgcaagctggcactcgtgcctgctgctaatggtttttgattgctgacaagaaggatggccttacggaggctccatctctgcaacctacaaggatgttcatcagcatcacaaggccggcactgctccaacactcaactctggcggcaagccggcaagggccgcaaatcagcggtggtggctagtggtgaccgtaattgactttagtgtgtcctcttctactgaattattaggtggcttagcgcttacgagaaactcagtcacaacatcgatttaaactgtggatgataactggcttatttgaatct

SEQ ID NO: 101 - DNA, 3195 bp, Zea mays
tggcattgctgaggaagcataaaagttctactgtccatacaagtacagaacttgaaccaaggaagaaactggaagaggcacgtgaacgcaagccaactcatgaaaacagcgtgaataaacgaagcagagaaagaacctacccttctagtgaaatggacagtaacctcttcaggataaaggaagtgacctcctctgtaaataagcaaggcatagaagtcaatggttcaactaataatcctacaaatggtggctatgaaatggtgaaaacttccacagggaccaaagatgatatctttggggatctccctctcctcgaattagaaagctccaagattatgtttcggactggtgttcatgaacttccaactgttatagaagaatcatttataacaaatcaaaccgaagcagattctataccagaagcagtacccttgcggctgattgatgcatctgacatcactgctcatacaccatctcctcttgaagacttggtgaaaagtgaagacaatgagccagcatgcatctcccacagtgatgtggaagggagttacccttccactgttgggattgatggcgtgccaaatcataagaacatcaatatggtgaaaccaggtcttggtgatatgcagttaaaacttgctgaagtgtgtgctttgggttctcattctgttctgaggtcaaaatatggctctggtaaccctctgcagggttgttttgatgtgaacaaaaactgctctcaggaaataaaaaaacatggttctaattctactagcagtccacctaccatgagaaccagaactgaagaaactaaatacaaagatgcaccagttaagtgcaagagtactgatatcactgatacagtggctgcactacctgcgcctgccaaccattcatatcaagctagtgtgttgccctctgcagtatcacgtacagttttcagcacaagtgttgattcaaatgacgtgtcttcattcagaagtctgcctgccaaggaatgcatcccaattaccagatctgggaacttcagaactaatatgtgcaatggaagtaagaaacatgtggatccatgtgcggcactatctacagataaccagggtacctcgcactcaaaacttgacccaattttcagtcctgctaacattggaatggcttttatgaagctaccgggccttcaaagaatggagatcttaaactacaatgcaaagataggtgaaaacaggtttagtaatgcagagtccatgaacacagtaagatatcagaaacaacagttgttgagtggcatgacctatgtaatgcaaggtcagaaacagattggtctaggcagctctcaagttaagagaccagctctggatgattatgggggccaaggtgatcatcatctgcagcaacccacggttcgtttgatgggtaagaccgtctcagtttgctcgcatagcaaggatcataacgtatcgaccatggataaagtgagtcctaacaatgttgccattgaagcaagccgcctatccacaatttcatgtcagttacccccaaagagatcgttcccttgtcagaattctgtgacacaaagagtgcatctaaacaattcttcagattttttggcaaggattccgaacaatagtgtgccagggcaaaatactactttacatgaactccatgaccaaaggccacaaccaacaaatagttctgcaacagtgaaaggttgcacttggaattttggtaatcagtttgtttgccaagctgaactcgataaggcagctatggtcagcgccaactctcaaaccaggcatctagagcttcatcaaccacctcatttgataagcattcctcagaatcaacagtctcatttgtggactcctgcagcacacactaggaaagatcagtgttttgtgggtccagcggtgaaccaatcttccccagttccaaaatcattgctaaatgcaagcatgaaggaaaaatatcagaattccactttgttgtcttacaatgatcctagttctatgcctattcgccaaccctaccagatacctggcgcaaagtcatcttctgcatctgtcatatccttttttgagtatggtgcggataattcgttgtccagaagctcttctcctggtctgagtctttctcttacaactggtttggctaatgagtctgtttcgacaagcagagcagcttgtgcgggcagtcttacaaatgcagatggtaggaaggctgctagctttgtcgaaccaataagatcagcttatgcagataatgtttcacagccacctgcaaagccaataagcaacagaacagtttatgcagcagataatgtttcacaacaacctgcaaagagacaacttgttacaggtagaaaggattttatgtctatgggcccaaacattgtgaaccattcacctggttggtcacttagtgatgcagttggtcctcaggtgcttgattttagtaaaagaatgggaagagatgctgctcaaatgtcaaaaaatgaaagcgacaatccaagggccagttccggttcagttccgcctattgaaacatggtctaggcctggggtggttgcaggggctaatactaataccatgttgaatccaggtcaaaacctgaatgatcattccaaactgctatactccaccaaattttcagttgacagcggtatcaattcagttatattatagtgaaaagcaagaaaaaataataataaggtgtccttgttgaagatagctctggagtttttcagtgttcaaacagtcaggcacaggaaacttgtaagagctctacatttctgagcatgttagtttagcaattgatggattgctttactcttgtaattttgccggtcaaatgtgcaaggttatttgattgtttgattccatgtcatgccatatctgaaaaaaagcttgagagttcaactgtacagattgtaactacttgtgtgttttgtgggcattcaatttctaaggcttacttgatgggcagcagttcgatttcacaggcggtgcactgtactatttaagcttgaaagtaaagcataaaatttactttcagccagtttctgtaaaccatcatgcaaacttttggatgctgctcttgattgatttgcaattattagtcactgctgttacaaagctgcatgtttcacctttttggctttcttaaatttgaaagatagtcgaagtgaacattcagaatgaaatg

SEQ ID NO: 102 - DNA, 715 bp, Zea mays
tcccgttccaactcctacctacgcagcagaggccagccacctccccgtcgctctcacgctcttcgtgcccgccgcctctcctccgtctctgcctctctccctctcccctcccgtctgacgcacatggcctccatcgccggatcttcggccctctccttcgccaggcccgtcaaggcaatcaacacaaattctctagctttctccccggcgaggaagggcaacacattcctccgcctgcaaccaatgcctatgagatctgtttcctgcgctgccaagaaggatacaacagacaaggtttgtgagattgtgaagaagcagcttgctcttcctgaccatactgaagtttgcggtgaatcgaaattctctgaactcggtgcagattcactggacacggttgagattgtgatgagtctcgaggagcacttcgatattagcgtggaggagtccagcgcacaaacaatcgccacagttgaagacgccgcggacctcatcgacaagcttgttgctggcaaagcgtagttctgtacctcctctatcgttgtcctaccactctaggtctatcccttgatctaggtttctatggtctgaagatttgtgattttctccgcactgttgttgctatccccgtgtcgtaataatacgagatgttttaagcggttgaacattacggtggtgtaatcagagtaatctgttgctgttaaggtgcattgttgta

SEQ ID NO: 103 - DNA, 3795 bp, Zea mays
cgcagatggatgcccgcccctcgattcgcccgcgctgagcatccgaacccggttcccgccgcctcggctcattccggcgctgaaagattcagctccgcgcttccggccgccggagctcggtaatggcggggttctagcgcggcggacttaaagatctagcctcctcttttcctttccattttctctctttcgctgctaccccctcacacccccacggcgatggtcacggagatggcggcgcgcggcggcgaggcggcggcgtttggcgcggagaccgaccgcggcgacttcgaggtgtttcgcagtggctccgcgccgcccactgtcgagggagccctgggcgccgccggggccgacggcggccttctcgtggacgacgacctccgcgccgacccggcgtaccagagctactactactccagtgcgcacctcaacccgcgcctcccaccgccgctcctgtccaaggaggactggcggtcctcgcaccaccgcctccgctccgcgggcttcggcgggatcggggacggcaggaggcagcagcagcaggcgtcggctgccgaggggactgtcggcctgcccgggatcgatcttggtcgccagaggagcttctccaccatctttcaggaagactcgtaccagcgtgatatggataggcatactgccagccacaatagtaatgacttactaggttcttctggaatacagtatggtctaaatcgtggatctggaactattggaggcctgcactctagcaatagtctacggagcttggatgaaattcagaacaatgatctgccatcaaacacatttgcttctattttagggtcatctctttctaggagtgcatctccagaccctgaacttgtgaggagggcccctagtccatccctgcctccaattggtgtgaaagttggtaacactgataagaagatcaatggtggttccacttctttccgtcgtagctcatccgcaatcggagaatctgatgatttggtggctgctttatctgggatgaacttatcatctagggcaatgagtgggcaaactatggaccagtctcagctctatcaggatgtcgataatgtccagaagttcctttttgatcgacagggtgaccaaacaactggaaatcagcagcactatatgagacgtcctgaacaaggacaatctaagttacccgatggatattctgccaatttggccaattcatctacaatgagaaaccagattaatgctggcagtttcacatcttttgacagtttgtctcttggatctgggtttgcttcccctaggattggttctagatcccctggagggactgtatcttctcgacaaaatttagctggtatgtctaacatgctaaactataatggaattggaagtccaactgcctcaccttctcttcagacttctattgatccggcatatatccagtaccttgctcagcttgcagctacctgtgatgatcctctaatggacaggggccatctaggaaattcttacatggacttacttggtactcataaagctaacattggccctttactccagtctcaaaaacaatatggttactatggcaatcttggatttaaccttggttatcctggaagtccattggcgagtcctgttcttccctcttcacctattgcgccaggcagtccacttaggcatggtgagcgcaacatgcgctttccatcaggcatgagaaacttcggtaattcctttggttcatggaattcaggcatgggtggaaagatggatgccaatttgatgccctcacttctggaggaattcaagagcaacaaaagtaaatcatatgagctctccgaaatagctggccatgttgttgagtttagtgccgatcaatatgggagccggtttatacaacagaagctagaaacagccagtactgaagaaaaggacatggttttttcagaaatcatgcctcaagctctcacattgatgactgatgtatttggaaattatgttgtccaaaagttttttgagcatggaagcactgcccagataaaggaattggccggtcagcttattggacgtgtccttgctcttagtcttcagatgtatgggtgccgggttatacagaaggctatagaagttgttgatttggagctgcagactaaaatggttgcggagctggagggccatgtcatgcgctgtgtgcgtgatcaaaatgggaaccatgttatacagaaatgtatagagtgcattcctcagcatgctattgagtttattgtctcgacattctatggccaagttgtaatgctatccactcatccatatggttgtcgagttattcagagggttctagagcattgtgatgatcctaaaacacagcaaataatgatggatgagattctccagtctgtttgcttgctggctcaggaccagtatggcaactatgttgttcagcatgttctggaacatggcaaaccccatgagagatcagctattattgagaagctaattggccaaattgtgcaaatgagccagcaaaaatttgcctcaaatgtcatcgagaagtgcttagtctttggaaatcctgtagaacgtcaggttctgattggtgagatgcttggatccactagcgaaagcgaacctcttgaggtaatgatgaaagaccagtttggaaactatgtggtgcagaaggtgttagaaacttgtgacgatcagcagagagagatgatcctaacaaggataaagacacacctgaacacactcaagaagtacacatatgggaagcacatagtagcacgcgtagagaagcttgttgctgctggagagaagcgccttgggcttcaaccagcatgcaccgccgcctgaagggcaaactctctagttgtacagctaacagttgctaggtttgcactcacatttttttctctctactaaaaaccctatatgaaggccccttttggcctcgccggaaaataaacactgtatgtttgcgcgaagagtgtacattaattctgtagcacaagacccatggggcggaatcaatggaggagtgatgcgtgtgagtccgaaggctgctgtaaagaggaagaagatggatggaaggagtgagaagcatgtcggttactctgccgctgtacaaattaaacttagctcttagagtgaggagaaagtaagctgttagctgtctgtctaaaaggaaaaaaaagaaggaaatggtgaggccatcagctccctcctgtggcttttcctgttgtctgtctggcctttgttgtaacataaagctgaggcgcactagcctgccttcgttttcacagttaagctgaagttattagtatcagctttcttgaactgtttggtatgtaatccaggtccctgatgtctgactgttttaattgcaatattcatcaccctgataaacttactttttgtttgttcttgttgagatgttctgttgtaaatttcttttctttttgccaatgttgcggtcttcgagactgctcttgcccttgtttttttgcatggagtttcaagggagagattgggatggtacatgtcctgttgtagtacatgttgctgtctgtcatggccagtccggacggttgtggcgccttgtactctctcacagtctcactcgtgcttcgtgtgcgtatatgctgagtggtagaatgagtgcaaccagttttttcttctgaataatggagcaacgttgagtatatttctagggccatgatcccctgaatcctatctgaaccggctctataaatacccgtgagggtaggcagtggcatcgcatcgccagctgcactgcactgcacaacg

SEQ ID NO: 104 - DNA, 1510 bp, Zea mays
ggagagcacagagagctagcatacatcgctagctcactttagcatatatattacataaatattggcatatataaactaaactgaattgaggacgatatggcccgcttggtctcttccggaatcattggtaaggggcacaacatctttgacgatggcggattcggtgaagtccatgctgacccaattaaagtcgagcgtccgcacaagcgtccgccgcagaagcagaatgcggagaatggaacgacgacgaaggttgatgagccaaaggaattgcctaagcacgtgtgcttcaagggagacaacgggctgtacctgagcgctcggatggtggaaggctacccctacctgcagtttgcgtcggacgacataggcgatccaagtgtgaggttcaccacgtacaactacatgatcgacggcaagcgggtgatccgcgtcaagtcggaccacttcggcaagttctggcggcgcagcccgaactggatctggtgcgacaccgacgacaccagcacggacaaccgtgacaccctgttcgaggtcgtcagggtcggcgacgacgcggacgccgtgtacgggctccggaacctcggcaacaaccacatctgccaccggctgacctacgagggcaaggagagctgcctgaacgccagcatacccagcgtcaggaaggaggcgcagctgaagatcgaggaggccgtcctgctgcggaagatctacggcgtggactaccacctcaaggacgccaagatcctgaacaacaaggtgaggaccctggtgactcgagaggcggtgaacgccggcagcatgcccagcaagaacacgctgaccctcaagtacgtggtcagcaacggcaagatctgggacgccagcaggtccttgaggctgggcatcaaaagcagcttccaagccggagtccccgaggtcgtgaccggatcgattacgctggagagcgagttcgacaccagctacatctggggcgagaacaccgtcaacacggaggagttctccaccgactacgaggtcatcgtgcctccgcacaccgtcatcacggtgcgcatcctggccacgcagggcacttgccaggtccccttctcctacacgcaggaggatattttgactaccggggagaagaaggtcaccaagtatgacgatggcatcttccgtggagtcaacagctttggtttcaagtccgaggtcaccgagaggaagatcaacggcgaatgagacgatgcaccactgtgccaaagtctgcttatctatctatatatatctgcatcaataattcagccacgtacgctaccatctgcatatatgtcagtataggtggcgcatgtattgcttttaataattggtgtcatctaagccatgcaagcatgtgtgctttatagctaatcatcttgcactacgctcgtctgtttatttgtatacgtaagtactgtacattgcatgcacatgcactctcatcacctgtaatgttttacttgaaatttattcaaaaataaataaaggcttg

SEQ ID NO: 105 - DNA, 2038 bp, Zea mays
agcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaccacgtcttctcctcccgcccgcgctccctggtgtccgacatcatcatgtacggcgccaccgactcgtgcttcgcgccctacggcgaccacttccgcaaggcgcggaagctggtcaccgtgcacctgctcaacgccagcaaggtgcggtcgcagcggcccgcgcgggaggaggaggtgcgcggcgcgctcgacagggtgcgccgcgccgccgccgcgcgggaggccctggacatgagcgagctcctgcactccttcgtcaacaacctcgtctgccgcgccgtctcgggcaagttctccatggaggaaggccgcaacaggctgttccgggagctcaccgacatcaacgcgggactcctcggagggttccacatccaggactacttccctagcctgggccggatcgagctcgtcaggaaggtggcgtgcgccaagaccaggcgcgtcaggaagcgctgggacgacctcctcgacaagctcatcgacgaccatgcggccaggatggcaacccatcaggacgaggacgacgataaggacttcatatacgtcttgctgtctcttcagaaggagtatggcctcaccagagaccatatcaaggctatcttgatagacatgttcgaggccggaaccgacacctcgtacatgacgttggagttcgccatgacggagctcatacggaagccacacctgatgaagaagctgcaggaagaagtgcggcggaacgtgccggcggggcaggagatggtcaccgaggacaacctccccggcatgacctacctcaaggccgtcatcaaggagacgctccgcctgcacccgccggtcccgctcctcctcccgcactactccctggacgcctgcgaggtcgccggctacaccatcccggccaacacccgcgtcgtcgtcaacgcctgggcgctcggccgccacagcggctactgggagcgcgagaacgagttcgtcccggagaggttcctcagcggggacgtggccggcggcgtcgacctcaagcccaacgagttccagttcctggcgttcgggtccggccggaggatgtgccccggggtccactcggcgtccgcgaccatcgaggcgatgctgtccaacctcatgtaccggttcgactggcagctgccggcggggatgaaggcggaggacgtggacatgaccgaggtgtttgggatcacggtctcgaggaaggagaagctgctcctagtcccacaggctgcgtgaggatgatgatgatactagtgcaatgcgatacagggttttaaattagtaacaccaaaggctgtgttactggaccttaattaataattaataaatgtgctactactatatagccaggcttcacagtgacacatacttctattgcccatgctacatatatgtgttcttatttacatccccaataagtgttattgtgttgtatcacatttacctatatatatcaaatggaacatttctcca

SEQ ID NO: 106 - DNA, 1161 bp, Medicago truncatula
ggcatatgcggcatgtgaatttgattctttggcggattcgatttgtcgtggtaaagtataataactacctaactcgctctcattcattcaccacacacacgaagctaactttgagaaacaaactaaaccatggctacttccgagaatgccgtcgaaagcaagagttctcttaccaaacttgctccaattgaagcagtgttgtttgatatagacggaactctttgtgattctgacccaatccactattatgcttttcgtgaaatgcttcaagagattggtttcaatggaggcaatcctataacagaagaattttttattgcgactgttgctggcaagcacaatgatgacattgctttggatctcttccccggtgatcgggagcgaggtttaaagtttgtagaagataaggaagccatgtttcggagattagcagctgagcaactgaagccgttgaatggtcttgataaagtgaggaaatggattgaagatcgtggattgaagcgagctgcagttaccaatgctccaagaccaaatgcagaactcattctctcaaagcttggtctctcagatttctttcatgctgttattattggtgatgaatgtgaacatgccaagcctcatccagaaccctacttgaaaggtcttgaagctctcaaagcatctaaggatcacacatttatatttgaggattctgtttcaggaatcaaagctggtgtggctgcagggatgcctgttataggtatatctactcgaaacccagaagacttgcttatgggagcaaaacctgcctttttgattaaggattatgatgatccaaaactgtgggcagcattggaagaacttgacaagtctggttctcattaaaattttgaattactagtccaattgacataatttcttgataaaaacaagtagcaggtttcatattaaattcaccggatcacctgtataattttgttgcagggggggtgatattattatactagtccataatcagtgttgctttgaaatcgagcaaacattagttttatttgtattttgtaataatgtgatagttggctatgatggtcaatgccaaggaattgcaatgcaatacacgtgagagatagtgagggaggaagggagggattttaatactcttccattattcattacacttta

SEQ ID NO: 107 - DNA, 2535 bp, Medicago truncatula
cacattctcgttttttttctttcttcaattcatcatctttctatttttccttaaaaatcgcaattccgattcccaatcatattcatttctacgttgaattcacaattcagatctctttctccaaaaatcaatgatttggcgttgaatgcatcattagtgttaattaatcaaatgcaaatggaattagcaacaatgagaatgagaaaatctttgatctattggatttgttttttggttattgggtttgttcaaattagcaaaagcaatggtttttatcttcctggaagttacatgcatacgtatgcaaatggagatccaatatatgccaaagttaattcattgacttctattgaaactgaattaccctttggttactatagtcttccttattgtcagcctctcggcggcattaagaaaagtgccgagaatcttggtgagcttcttatgggtgatcagattgataactcgccgtatctatttaaaatgaatgttaatcagtcgagttatttatgtactacggccccgttgaatgagcatgaggttaagctgtttaaacagagaacccgcgatttgtatcaggtgaatatgattcttgataatttgccggttatgaggtttgcgaatcaaaatggggttaagattcagtggacggggtttcctattgggtatacgccaactgatgggagtgcggattatgttattaatcatcttaagtttacggttttggttcatgagtatgaaggaaatgatgttgagattattggtactggggaagagggtatgggtgttattgctgaaactgataagaagaaggaatctggatttgaaattgttgggtttcatgttgttccttgtagtgttaaacgggatcccgaagttatgacgaagttacatatgtatgataatatttcttcaataaactgtcccaatgagttggataagtatcaaccaataagagagcaagagaggatatcatttacatatgaagttgaatttgtgaaaagtgatataagatggccgtctcgttgggatgcttatttgaagatggagggttcccgggtgcattggttctcgattctaaattcactgatggtgatcttttttctagctggtattgtttttgtcattttcttaagaacagtgagaagggacttggcaaggtatgaggaattggacaaagagacacaagctcagatgaatgaggagctttctggatggaagcttgttgtgggtgatgtatttagggaaccaggttgctcaaaactcctttgtgtgatggttggagacggggttcagattcttggcatggctggtgttacaattgtgttcgcagccttgggtttcatgtcaccagcatcccgaggaatgctgttaacaggtatgataattttgtatcttttcctggggattgcttccggatatgtaagtgtacgtctctggaggacaattaagggaacttcagaagggtggagatcgatttcctggtttgctgcttgctttttccctggaattgcttttacgattctaacagcactgaattttgttctttggggcagcaacagtacgggtgcacttcccatttccttgtatttcaaattgtttttcctctggttctgcatttcagtgccactcactctcattggaggatttttggggacaaaagctgagcaaattgaatttcctgtgcgaactaaccagattccaagagaaattcctgcacgcaaatatccatcatggcttcttgttcttggtgccggaactcttccatttggaaccctttttatcgagcttttctttatcctttctagtatctggcttgggaggttctattatgtttttggttttctgctggttgttcttttactgttgactattgtctgtgctgaagtgtcggtggtcctcacatatatgcatctctgtgtcgaagattggcggtggtggtggaaggcattctatgcatcaggctctgttgctctttatgtctttttgtactccattaactacttggtttttgacttgcagagtttgagtggacctgtctctgctatactttatatcggctattcgctgctcatggcaattgcaatcatgctttcaactggaaccattggtttccttgtctcgttctactttgtgcattatttgttctcatcagtaaagatagattaaggttgatctttttgctatctctcatcaactaaacaaaaggcatactggaaggagaattttgctcaattgttataacttctgcttgattctttttgtaactcgattgctttgtggcatgttgagtatggaaaacagatgctcctattgtgttaaatagttatatgattttatattgcaatgtaatctgcactttgttccgctttaactatcgtttttataccattttgtttcatgtgctttagttcgctttaactagcatttttataccattctgtttcatgtgctttagtttagtgaagttacttgaggaagttgtaattgctcagactgtttcatcccttattgaattaaattctgataaccaaa

SEQ ID NO: 108 - DNA, 2579 bp, Medicago truncatula
ctttctcaattctcctctcttctcttctcttccctccaattacacaaacacgctctctattcatctctactttaatcataaccaatttcataccaaccctaatcggaattgaaaatggcggtggaggagggaactggcggtggtggcacaactatcatcgatgagatttacgaattctgtgcgccgagattctttgatttcttgaaaggggaatccgatgatgatgttcgtagggctgaactttggtttcataccgctttatcttatgctccttctccattcatgcctaaaatcaaggctggtagatccattactgtagataccttatgtgattttagtgaagctgacaatatgccaaaggttgaagacagtgttcttgaatcaaatactcggccacagagcattactagcaaagtaaaggaagatgatagagccaaggaagaaaaggttacaattgttcctcacatgaattctaccactaagaaagaggatgcaccatgctgcgaggccgaagaaaacagttcaacttctcttgaggatggtgttggtaagaaaatgagtaaaggggagatcttaaacacagcaacatccacaaggggagcatctgttgaagtaggaaaagatgcttgcacaccaaaaccagcattgcgaaaaagtgtcaatgccacttccactaattctaagaagcaacagaactctaagaaggtatccacaaataccaaaactcggttacaatcaggagcctcgaagagcgctgcagggactctccacttcacccaagagaaccaagccattaaaaggcaaaaattagaaggagggaaaactagacagattctgaatctcaaacctcaaactttgcctcatgataagtcaaaactgggttactcttcaagtactagcaaaactcaaaaagaggacagaaaggtttatgttcgtgacacaccaaaaacaccagcagcaccatttaaatcaatggcagaaatgatgaagaaatttgagtctagtacgagagacctgccactgcccaacactctttcccatacaaaaccgaaactaacattgaccaagcctaagtcacctgaatttgagacaaatcagcgggttcgccctgctagagtgaagagcgctgctgagcttgaggaagaaatgatggctaaaatgccaaaattcaaggctcgaacactaaataagaagattctgcaaacttcaaccttgcctcccatgccaagaagtacaccccaaccaccagagtttaaggaatttcatctagaaacactggctagggctcatcaaaatacagattcagcttcaaaagcctcatcagaggtgtctcataaggagaactcatcgaaacctcatctcactgaacctaaacctccactactccaaacatcactaagggcccgcccaccaacagtgaaaagctcattagaaattgagcaagaggaacttgaaaagattcctaaattcaaggcaagacctctaaataaaaagatctttgaaagtaaaggggatattggattattctgccatatgaagaaacatgttaccgaacctcaagaatttcactttgcaacaagtgagaggtttccacctcctaccgcagtggctgatttatttgacaagctttctttgaagtctgaacctgcacgtaatacaattccaagaaccactactccaaatccattccatctgcacactgaggaaagaggagctgagaaagaaaagaaactgtacatggaacttttgcaaaaagaattggaagaggaagcaacaagggttccaaaggctaacccatacccctataccaccgactatcccgtgatcccaccaaagccagaacccaaacaatgcacaaaaccagagccttttcaattggagagtctagtgagacatgaggaagaaatgcaaagggaacaagaagaaagacttagaatggaaagacaagaagcacagatgagaaaatttaaggcgcaaccagtattaaaagaggacccaatcccagttccagagaaggtccgcaaaccccttacacaggttcaagagtttgatttacatttgaatcatcgggccgtggatagagcacaatttgatcagaagattaaggagaaagaagtggtatacaaacgatacagagaggaaagtgaagcagcaagaatgatagaggaagagaaggcactgaaacagatgagaaggacaatggtcccacatgctagaccggttccaaactttaataatcctttttgcccacaaaagacttctaaaacaacaaaacccaagtcaccaaacttgcgtgtactccaaagaagacggttcaatggttccacaacttcgagtcctgctactagcatgagatgaagacggtatcagatctgatcaaagtttttggtgttcaagaactcttgaatccttgacacctccctctaggtgtcactgtaatagtgtaatagttaaatctgtattctttgatgtaaatttttcaaaattgcaggtaatgcatctgtataaactatttgtgataccaattcaacattaatattggtaaattaagattatgaactgtttgaggaataactgag

SEQ ID NO: 109 - DNA, 1360 bp, Arachis hypogaea
ccccactcttcttccatagcctgtggcctccattcccatcttatggtctctagtgatatctccaactccaactggtcccaataatcccaatttactctctaatccattcttttcattctaacatacactaaccccaattcatcaattttgcacaacaacaacaacatcatgggtgttaagggttttgtagaaggaggcatagcttcaatcgttgcaggctgttcaacccacccactcgacctcatcaaggtccgcatgcagctccaaggcgagtccaatccaacctccgtaccttccctccgacccgcactcgccttccaaaccggatcccgatccatccacgtctcaccacctccgcaaatcacccaacctcctcgcgtcggactcgtaaccgtcggcgtcaagctcgtccagcaagaaggcctcgccgctctcttttctggtgtctccgccaccgtcctccgccagacactatactccaccactcgtatgggcctctatgacctcctcaagcagaaatggtccgtcccttcccccgttcccggcggcgccaccaccatgcctctctcacgcaagatcgaggcagggctaatcgccggcggcgtcggagccgccgttggtaacccagctgacgtggccatggtgaggatgcaggctgacgggagactccctccagctcagcggcgcaactacaagtccgtcgtggacgccataacgaaaatggcgaagcaagaaggcgttgcttccctgtggcgcggttcatcgctcacggtgaaccgcgcgatgcttgttacggcgtcgcagctggcgtcgtacgaccagttcaaggaagcgattcttgaaaaaggtttgatgcgcgatggtttagggactcacgtgacggcgagttttgcggcggggttcgttgcagctgttgcttcgaaccctgttgacgtgattaagactagggtaatgaacatgagggtggagccaggggctgagccgccgtacactggggctcttgattgtgcgctgaagacggtgcgtgcggagggtcccatggcgctgtacaagggtttcattcctacgatatcgaggcagggtcctttcactgttgttctgttcgttacgcttgaacaggttcgcaagctcttcaaggatttctgagaagactaccaagatgatcatcttcattatgataatggcgaaaaaataaaatgttatgacttgcgttttttgtttactcgtgtcttgcgttttcaatattcctgatgttgtgcctctggtagagtcatttttattattatgatttaatccatcaaatccaatatttctggaatcaactggcctacactttttaatttttaataataaaattcat

SEQ ID NO: 110 - DNA, 1726 bp, Arachis hypogaea
aaacgtctctcttctctccaaaagcaatttaatcaacaaccaaacaaggcacacgtcatttacacgtaagaccctcttttgacgatgctcacccggatatctcacaggaagctttggacctccgcccgccgggttctccgcccatctctctgccgaacctcctctgctccgctgccctcacctctctctcactctcacaccttctcttcttctgcctttgctcttcgttctacaacttatgcttattttgatttcgattttctacattggaagaggcattgcttttctactcaacctgcactagaacttccggccggtaagatcgtggatgtgccgttggcacaaactggggaaggtattgcagaatgtgaacttctcaaatggcatgtccaagagggggactatattgaggactttcaaccactttgtgaagttcaaagtgataaagctactatagaaatcacaagtcgttacaaaggaaaagttgcacatgttctccatgttcctggagatattgtaaaggttggagaaactcttttgaagatattagttgatgagactgcattcccttcggcgactgtcggtgattcagaaattacaaagtcacttcattctgatcaagtattagtcaatgagtctgcatctgctatagcggctcttggtaattcaaataatgcagaattactagattctgatcttgaaaaaaggaaacgtgctgcagtattatcaacacctgctgtaaggagtctggcaaagcaacatggtatagacataaatgaagtatgtggaactggaaaagatggaagggtactgaaagaagatgtgctcaattttgctgctaagaagggaatcattgtaagtgtatctgctgttttggatgctgataatgtagagaagcctagaggagcagaaggatataccgtgacacctgagtataaatcaccatcagaggataggatacttcccctaaggggataccaaagagcaatggtaaaatcaatgtctctggctgccaaggtcccacatttccattatgtagacgagataaactgcaatgctctagtggagcttaaaacagcgtttcagaaaaacaatccttatccagatgtcaagcacacttttctgccaatattagtcaaatcactgtcaatggccctcaccaagtaccccgctttgaatagttgcttcaaagaggattcaatggaggtcatactcaaaggttcacacaacattggagttgccatggctactccaaatggtctagttgtaccaaacataaagaatgttcagtctctttcaatattggagataaccaaagaactggcaagactgcaacaattggcttcagagaacaagttaacttctgatgatatatctggtgggacgattactttaagcaacattggagcaattggtggaaagtttggttcccctcttctcaacctgcctgaagtctccattattgccattggtcgaattcagaaaattccacagtttgatggcaatggaaatgtgtatcctgtatcactcatgactgttaatgttggtgcagatcatagagtcttggatggagcaaccgtttcaagattttgcaatgagtggaaacaattaattgaaaatccagagctcctaatgttgcatttgaaatgaaatatttttactttagagtaacaaaagctggaattgttgtatacaatgttgatctttatattaatcataataataa

SEQ ID NO: 111 - DNA, 2410 bp, Physcomitrella patens
gaggctgtgctcacggcttgtgagcagcagctcagtcagggaggggccgtgcatcttctgcccccttgcttcgtggtcttgtggtaccacccttgtatgtgtgcgtgcctcctccctccccgcattgcctctctctccctctgttcttgggctttttgctgttgttattgttgttgggttgtggaactggctcgtatcatggtgcgaggcggtggagaatcggctatggtgtcgtctagccctaaccgggatggctttgtgaagcagatcaggggaggaggaggagccatggatctgaaggtgcgcgttggggttttgttagtttcatttcttgtaatgttattccctcccgtgcaggcgttctacttgcctgggacttacttgcatccgtacaagaaaggggataagctggaggtgaaggttaattctctcacttccatcgagacggagctgccgtactcgtattacagccttcctttctgcaagcctccggagggtattcagaaaatggcggagaatattggggagatgctgatgggtgaccagattgagaattccccgtataagttccagatgaaggtggaccagaaggatttgctggcgtgcgtggcgcctcccctaaccgagaatgacgtgaagcattttaatcagaggatcgatgacctctaccaggtgcacttgatcttggataacttgcctgtgacgaggctcacaacagcagccaaggagccgaacagtcagttgcggtggacttggtcaccaattgggttcaagtttgatgacaagccggagcatttcatttacaaccacttggagtttaaggtcttggtgcacccttacgacaaggactctgcatcgggggcagtcttagggacgggggagggtttggacaccatgcctgctgcgacgatgcagaacttgactggaacatacatggtggtcggatttgaggtcgctccttgcagcgtcgtccgcgatgcaaaggccgcgaaagagctgaaataccaagggctgctccctgcctcggattgcgatcccaataaacctcaccaggtcatcaaggtgggggaagagatcgtgtactcatatgacgtcgtgtttgaggaaagcaacattcgctggccgagcaggtgggatgcatacctgaagatggagggggcgcgtgtgcactggttctccattttgaactcgctgatggtcatttcgttccttgctggaatcgtatttgtgattttcctgagaactgtgaggagggatctgacgaaatacgaggatctggataaggaggctcaagcgcagatgaacgaggagctatcaggatggaagcttgtcgtgggtgacgtgttccgtgcacccgaaaacccacaattgctgtgcgtggtagttggggatggtgtccagatcctgggaatggccgtggtgacaattctgttcgctgcgatgggattcatgtcccctgcctcgcgaggaatgctgctgacaggcatggtgctgttgtacatgtttttgggcatcattgccgggtacgtagcttcgcgaatgtggtgcaccctgaagggcgtgagggacgggtggagaccgatagcgtggaagacggcgtgtttcttccccggaatcgcattcacaattatgacagtgctgaacttcctcttgtggtcacgtgacagcacgggtgccatccccatctctctatattttgtgctgctgttgttgtggttcaccatttcggtgccgttgactctgcttggaggctacctgggtgcgaaagcggagccgatctcgttcccagtgcgaacgaaccagatcccgcgagagatcccaccgcagcggtatccttcatggctgctggtgcttggcgcgggcacgttgccattcgggaccctgttcatcgagctgttcttcatcatgtcgagcatctggatgggacgcgtgtattacgtgttcggatttctatttgtggtattgatccttctggtgattgtgtgcgcggaagtgtcggtggtgctgacgtacatgcacctgtgcgtggaggaccacaagtggtggtggaagtcgttcttcgcatcggggtcggtttcgttgtacgtgttcctgtactccatcaactacctggtgttcgacttgcacagcctggctggaccagtgtctgcggctctgtacttggggtactcgctgctgatggtgatcacgatcatgtttgcgacgggtacagtgggattcctgacgtctttctacttcgtgcacttcctgttctcttcggtgaagatcgattagaggatgtagatgtctcttgcagtctaggctgtgattgcgatttgggagacttcgcatgtaggttaggattagttctttttttaatatatttttgtggagcttatcttcatcctagtgtaggatcaggcaggactcc

SEQ ID NO: 112 - DNA, 2513 bp, Pinus taeda
ggcaaatggagtggatttggaagcagtaggggtatgggtttgttaggatagaatagaatagggattcgaacctgggacgctgccatggagcgacagcagcagcagcgacaagaattgcgcgcagaggagataacgaagtacgcgcacagcccagtgcactgtgcagtagcggggcgggattatccggcgcttcggcggatcctctcaacactgccgagattgcccaaggctggagaagtgaccacggaggaggaatcgatattggcagagcaacgggcggacatcgtgtctggttgcatagatcggcgggacgtcccggggcgggagacggccctccatgtagccgttcggcttggggattgtacagccgtggagatgctgatggctgccggggccgattggagcctccagaacgagcaggggtggaacgccttgcaggaagcggtgtgcgcgcgcgaggacgccatcgcaatgacgataaccaggtattatcaacccctcgcctgggccaaatggtgccgacgcgtcccccgcatcatagccactgctgggagaatgagagatttctatatggaaataactttccattttgagagctccgttatccccttcatagggcgcattgcgccgtcagatacttacaggatctggaagcgcggttcgaacctcagggctgacatgacccttgcagggtttgacggttttcggatacaaaggtccgatcagagcttcttgttcttaggcgagggcaccgaggacccgagattgtctgctggatcacttatcgtccttactcacaaagaaaaagaaatcagcaatgcgctcgagggtgccgggagtccgccatccgatgctgaggtcgcgcaagaggttgccctgatggcgcagacgaatttatataggcctggcattgatgttactcaggctgagcttgttcctcatttgaattggaggcggcaggacaggactgaaatggttggtccctggaaggccaagatctatgatatgctgcatgtgatgctcagtgtcaagtcccggagggtccctggggcgatgactgacgaggaactctttgcggcagagaatgataagtttgcggatgagccggtgggttatgaggagatgctgacaaaggaggagaaagaacagctggaccaagctctgaacatggggaattcggaggccatcgaagatgagggggccatattctctggccctgtggatcgggatgaatgccatcagaatggtgggttgtcgggttctgcaggggatcctgatgcctctgagtcctccgaggcttctgaagccaactgtgataaagataagcgaggttggtttgggtggagcaagaagatgacaaaaactgatggactgaagcgaacatcactgagttcacaaattaataagcttgataaacagctagagaaaccccttcctgaatgcaatggcagtggcactttagttaatgaggattcgacaaggatactaaggaagttccctaagttagctccagagagcagtcagaaatcagtcgaccaccaaccatctgaatttcagaaggatgatgctgtaggtagtagaaagggaaaagagaaggctaataaaagcattaataagaaagattcaagtaaaaagaaaaggtccagtggaacaaatgacattaagcaagaaagtgaatacaagaaggggttaaggcctgtgctctggctgacacctgattttcctctcaaaatagaggagtttctgcctttgcttgacattttagccagtaaggtaaaagctgtccggaggttgagggagctgttgacaaccaagctgcctcctgggacttttcctgttaaggtggctattccacttgtccccacaataagggttgtgatcacatttacgaaatttgaggaactgcaacctgtagaagaattctcaactcctctttcaagtccaggtcattttcaggatgcaaaagggaaagagacacaggcttctaattcatcagtttcatggatgtcttgggtgagggggtctcatagtcgtacatcaagtgaaccaacaaatttggaagatcatttgagagatgatttagatcctttttacataccaagtaactatacctgggttgacatgaatgaaaagaagcgcagaatgaaagccagaaagtcgaaaaacagaaaaggaaaagcacattcttctcggcttgcagatgggtcgttgactgatattgatgagtaaacattgtaagaattatagccaaagaagttgtctgagattgctggaatggagcatttctcctctagtgcattgatccattattattgtatgtttttaccttttcaatttatgtagttttttctgctaaatatcttgtgaaatggtaaattgataagttggtttggataagcagatatttgcagagaatctgcacatttttctgtgttcaggttaacataaattcttgcgccatgttcctattgttgaggcatatgggataaataataaagaagtcgatgtaaagt

SEQ ID NO: 113 - DNA, 722 bp, Plantago ovata
ctcaaacaaacacaccacaactcttctttctttgctctttcaaacaactcaagaaagaaaaaatggcaattagaaaatcaaacaagatgatgtcacaaaaggcgatgatcaagcacataatgaagagatgctcgagcttaggcaaacgccaaggctacgacgacgaagagcaagggctgcccctagacgtgccgaagggtcatttcgtagtgtacgttggagcgagacgaacacgatatatcgttccgatttcgatccttaacttgccggagttccagaacctcttacggcgagccgaggaagagttcgggttcgatcatgacatgggacttacccttccgtgtgatgaggaggtttttgagtcgctaacgtcacaattgtgaggtggagttaatttgcggtcgagggtctcgactttggtggaatttttattaggccgctgtaattttcttttcttactgtcccttcaggggattattttcaactaggcagctggctgatcactactcagtatggaatgaattcaccataagatggtgtgagaggatcgggattaatggtattgttgtatagttctagtaatgttaggggttagtttttttatttttcctcacggtggtgtttagttgtaattagacactactggttaattgcgcctatgccctgtgagtgtagttatattactttttgggaccacttcatcccctgcattttcaacttcc

SEQ ID NO: 114 - DNA, 973 bp, Populus trichocarpa
accccgcagatctcacactgaataaaagcaaggcaaagcaaaacgcacactgaaagagagcaaagcaaaaaaaagagaaaactgaagcgtagccatggctcgatacgatcgtgcaatcacagtgttttcaccggatgggcatttatttcaagtggaatacgctcttgaagctgtccgtaaaggaaatgcggcggttggtgttcgtggtactgatattgtcgttcttggtgttgaaaagaaatccactgctaaacttcaagattctagatcagtgaagaagattgtatctttggatgatcatgtagcactagtatgtgctggattgaaggctgatgcgcgtgtcttgattaacaaggcacggattgagtgtcaaagctatagactcactgttgaggatcctgtaactgttgaatatataacacgctacattgctggtttgcaacagaagtatacacagagtggtggtgtgaggccatttggtctttcgaccttgattgttggttttgacccacacttgggtgtcccagctctttaccaaacagatccttcaggagcattttcagcatggaaagccaatgctaccgggagaaactcgaactcaatgcgggagtttttggagaaaaactttaaggaaacttctgggcaagaaactgtgaagttagcaatccgtgctttacttgaagttgtagagagtggggggaagaacatagaaattgctgtgatgacaaaagaccaagggctgcggcagctagaagaagctgagatcgatgcaattgttgctgagattgaagcggagaaagcagcagcagaagctgcaaagaaaggtccgccaaaagattcctagtcgtgctgtagttccaatacatcacctcgtactgtccatgtgatttagtttcgtcattgctttatcacatttgttattttcttttgtcgaacggcacctgatttcaagactccttccttttgcgtttct

SEQ ID NO: 115 - DNA, 1377 bp, Solanum tuberosum
acacttggttaactccgccattgcagctattagttttctctgttttcctccgccaccattaacagtaacaccgccgactgaatcgcctcgctcctccattaactcgttctctgtaactcaacaatgagctgttcatcttctttgattcttccttccatttcttcgaatggatttcgaagatttagtccattgaaattggataagtctagggttttcatgagtagcatttccgttggatcacgaattgccgccgtcgatgatgctctgttcactgattacaagcctaccaatgcttttctcttccctggacagggggcacaagctgttggaatgggtgcagaggctcagaaggtgcctgctgcagctgaattatacaagagagcaaatgaaatcatggggtttgaccttttggatatttgtattaatggtccaaaagagaagttagactccactgttctaagccagccagctatctatgtcactagcttagctgcggtagagatactccgtgctcgtgaggggggtcaacaaataattgattcggttgatgtcacatgtggtctgagcttgggcgaatacactgctctggcatttacaggagctttcagttttgaggatgggcttaagctggttaagcttagaggagaagctatgcaggatgctgctgatgctgcaaaaagtgcaatggttagtataattggactggattctgacaaggttcagaaactgtgtgatgcagctaatgaggaagttgatgaagccaacaaagttcagattgcaaatttcttatgccccggaaattatgcagtctctggaggtgttaaaggaattgaagcagtagaagcaaaagcaaaatcattcaaagcacgaatgacggtacgtctagctgttgctggagctttccacacaagttttatgaatccagctgtctcaagattagaagctgctttgggtgcaacggagatcagaactcccagaataccagtaatatcaaatgttgacgcgcaaccacatgcagatccagatacaattaagaaaatattagctagccaggtgacttcaccagttcaatgggagaccacaatgaaaactctcctatcaaaagggctaaagaagagctacgaattaggacctggaaaggttattgccggtattgtcaagaggatggacagaggtgctgaaattgagaacattggcgcctaagctttgtattgagagacatcatcggtggttattctttgagtgagttcaagcttaagtttttgaatgttaacgtcattatgatctttgttcaagtagcataatgaactcggattaaaatataactttctgaatctcagtagatattaatgtgatgaaaccacacacactatcagt

SEQ ID NO: 116 - DNA, 1777 bp, Solanum tuberosum
gcacggggatctcgcagttaatagtaaggcacacacttctcttcgtctccacagtccacccactgatcagctcccggagattaacgaaatcggaaaaccaatccaactattttttgattaccgatcaaaaaaatgtctcagagccttaatccgaatccaacttacgacgtgataatcttaggcgcttcaggttttactgggaagtacgtcattagagaagctctcaaattcctcaatgttccctcttcccccttgaagaatttagccattgctggccgtaacacttcaaagctttcccaggctcttcaatgggcttcccgtccaaacccacctcccgaaatccccattctcactgccaataccactgacccatcttccctccgtgaccttgcttcacagactaagatcattcttaactgtgtcggaccgtttcgtctgtacggggagcctgttgttgaggcctgtgctgattctggatgcgattacttggatatttctggggagcctgagtttatggagaggatggaggtgaagtaccatgataaggctgtggaaaatggatccttagttgtttcggcatgtgggtttgattctattcctgctgaattgggcttgatgttcaattcgagacagtggctgccgccggctgttcctaacagtgttgaggcctaccttagtctagaatcggacaagagaattgttggaaatttggggacgtatgagtcagcggtgcttggtgtggctaatgtggacaaattacaggagctgcggcggagcagaccaagaaaacctcgtcctgtgattcctggtcctcgtcctcctaaaggtccattgatgaaccacctaaaggaagttggtgtttgggccataaagttaccatcagcagatgcaattgtagtccgaagaacactttcatgtttggctgaaaatcctcatggtttacctggtgttaatgaaagcactgaacaagttgagaggagggaggcattttggtcaagcataaagccagctcactttggtgtgaagatagcttcaaaatctccgttaggagttgttcgtttcattatagtcgggctgttcattggtctctttggtaaaactggtttagggaggtggctgctattgaaattcccttcattgttcagtcttggatggttcaggaaaaaaggtccaactgaagatgaagtggcaagtgctacctttaagatgtggtttgtcggacacgggtttagcgatggcagtcttgcatcacaaggaaacaggaagcctgatacagagataattacaagagtaatgggacctgagattggttatttaacaactccaatcattcttgtccagtgtgctctcattttgctcaaggaacgaaacaatcttccaaaaggaggtgttttcccacctgggattgtgtttggcccaaccgacctccaaaacaggcttcaacacaatggaatatcttttgatgttatttcaaagaagacaatctaactaaatggtagtgttcccttctattcacatgggaaaatttgaacttcctctaaagggagaatgatactagttacttatgctttcattgtatgtttttcttccagacgtttttctgaatgtttatgtgcttgcttaataccttaaggtgcttcctcgacatttttctttccgtatttagattactggataagctctactttgtttaacaatttgttaactcctgtggatcttgatatcaggagcttccactttacacctgtaaacttgctttaatggactgcatttgatt

SEQ ID NO: 117 - DNA, 1515 bp, Solanum tuberosum
ttcttaaaccctttcatataataccctcttaccttattctttcttctcctcagcttcttcttcactctgcaaatatggtgctcaaagtttcagtttttcttcttttctcatttctcttcactgcctctgctgttcgcccagctcctcctcttgaaggattacttccaaatggtaattttgaagagctaccaaagccaaaagacctcaagaagaaaacagtgcttcaaggtaaatatgctttgcccaaatgggagattaatggcttagtggagtacatttctggcgggccacagcccggtgggatgtacttcgcagtcgcccacggtgtccacgctgtgaggcttgggaatgaggcttcaatttctcagacaattccagtcaagaaaggctctttgtatgcactcacatttggggcatcaagaacttgtgctcaagaagaggtgttgagggtgtcagtgcctcctcaaacaggagaccttcctttgcagaccctttatagcagcaatggtggtgatacttatgcttggggtttctatgccacctctaatgttgttaagattacctttcataatcctggagttcaagaggatcctgcttgtggtccactcttggatgctgttgctatcaaagaactttttccacctcgccctacaagagtgaacttggttaaaaatgctggttttgaagaaggacctcacctcttgataaactcttcacatggagttctcctccctcccaagcaggaagatttgacatccccacttccaggatggatcattgagtcactcaaagcagtgaaattcttggattcagctcatttcaatgtcccgtttggccaagctgcagtggaacttcttgcagggagagaaagtgctctcgcccaaatcattaggacggtccctaagaaggtctacgccttcacattcactgtcggtgatgcaaagaacggttgtcatggtgatatgatggtcgaagcatttgctgcaaaagaaacgttcaaagttcccttcaaatcacaaggcaaaggcagcttcaaaactgttagtttcaagttcacagctattgcagacaggaccagaattactttctacagctctttttaccacacaaagatcaatgactacggcgctctttgtggccctgttgttgatgaagttaaggtgacccctgttgcttagggtctctaaaagtactccaaaaaaagtgtttctcatagagtttttgcaatggtcatatcatactccccacttatcaataggaccattttgaggcaattcctgtattttacctatgtaattgcttaatgctgctgtaagagttgtgtactatttgtttacaaaggaagtctgaaactggtagagcttcctctccattactatgtgcactttgatcctcattcctaaattgattgagtagtagtgacatacaaagttgtattacatttcaaagatttcatgttatctgaaggatgaaatatagtagtatttagattaccaatcttgaaaaaaaaaaaaa

SEQ ID NO: 118 - DNA, 1464 bp, Oryza sativa
tccccctgattccgtttccgtttctcctcccctcaccgactcgtcgtcgtcgtcgccacggtcgccggcggagaggagagaggcctcgtcttcgccgccaatggccgcctccgtccccaacggccactccgtcgccggcgaaggagggacgcccgcgccgccgccgtcctcctcctcgctggtgttcctcgggacgggctgctccagcgccgtgcccaacgcgcggtgcctgatccagccccccgacccgccctgcgccgtctgctcccagtccctctccgtgccccccgagctaaaccctaactacaggtgcaatacttctcttctgattgattattgccaagatgaagtcacacacaaatatattctaattgatgttgggaagacattccgagaacaagttctacggtggtttatccatcataaaatcccttgtgttgattctattattctgactcatgagcatgccgatgcaatcttgggtcttgatgatgttcggattgtacagccatttagtcctacgaatgatattgagccaactccaatttatctatcccaatttgctatgaacagcattgcccaaaagtttccttacttggtcagaaagaaactaaaggaaggggaagaggttcggcgagttgctcagcttgattggagagtaatcgagagtgatcttcagaaaccatttgtgacctcagggctagagtttgttcccctgccggtgatccatggcgaggactatgtttgtctgggtttcctttttggaagaaaatcaaaagttgcttatatatcagacgtttcacggtttcctccaagcacagaacacgcaatttcaaagtctggagagggtcagctggatttgctcatcttggactgcctttataggactggttctcataatgtccatctttgttgggatcagacactggatgctgttaagaggatttgccccaaaagggcattgctcattgggatgactcatgagatggaccatcacaaggacaatgaaacgttggaagagtggtccagaagggaggggatagatgtgcagttagcccgtgatggattgcgcgtctacattgatctgtaaatttgacaaagggcatttgcttcttcagtaacctgcattaagcttccagttgccgttactattcagctcctcttgataagaaactgaaaggagaaacggcaaatgctgctgctttgacagcgtactggtcatagttcaaactcactaggtacagtagaataattcatcaaacctggttccaaatattagtatttagtagtagtaataaaaggcaaagcagctgcttcattgcagcaccccacagaatcccagttcctgtatgtttgtcttgtgcaaaccacttgaagatttcttgtcaatgccagtgtcgtagcccttgtcaattggagaaagcctgattcgaatgataatgaactccaacagaagcttttttg

SEQ ID NO: 119 - DNA, 2960 bp, Oryza sativa
ccaacgttcgtctcctcttcccccgatccaaccaccaccaccttcttctcctcctcttccgctcgacgccaccaccacgcacttgagagagagagagagagagagagggagagaaaccctaagcctcgcccgctatccagccaagcaccgatggcgccggacgcgaacccggaggcggcggcgccgccgccgcagttactggtggacgagggctacgagttctgcgcgcccaagttcttcgacttcgtctgcgacgagacggaggaggaaatccgcgccgccgagcgctggttcgaggcctccgccagccacgccccttccccgttcgctccgaggatcaaggagtcgagggcggaggtcaagatcgagagcctctgcgacttcaccgacgcggagccgattccgaaggaggtagcagtggaggaggcagcaggaagcgccgccaatccctcgcagaattctgatgggaatgtgcaacagaataaggacggctccatcaaacttgtccatgaagcaaatcccagtgaaaattgtgtcactgacggcgatcataagcaccaagaaagtgatgcaatgttggagtcgccaccagcagaggaggatgagaaggaatcgccaaaatccttcgagtttgtcccttccaatgcaaaatcagcagatgttgcttctagcacaccgaagattcagaggcctccacccgtcaaagctgtcactacggtgcctacctgtcccaagctgacagtgaagacagaagccttcactccgaaggtgcaggcaacgaactcctccagaggtcttgcacccttgactggctcaagggcacatccatctgctttgaagcagtcgatgagcgtcaagaggagtgtgatcaaatgccctcgtgagttgctggctgggaaggccgctactgctgcgaatgaaatcgcacaagaaaatcaagctgtcaagagacagaagcttgatgatgggaggacaagacagatactgaacgtgaagacaaggaccctgcctcacaaggggagaggaggtggtctagcaggaagcaccgagatgagcctgtcggccatgaggaagcaccgtgacgattcacgctctctcaaggaagtgactcactatatatcggcagcagagatggtaaagaagttcgagtctgggactagagagttggccatccctcacaacagatcgctttctcatgaggatgcagcaaccgcattacaaagaagaacaaagctgatgctaacaaggccaaaggaacctgagttccagacctcccacagggtccgtgctgtcagagtgaaaagctctgctgagctagaggaggagatgctagccaaaattccaaagttcagagcacggccgtttaacaaaaaaattgcggaggccccttcatttcctcctcttccaaggaaagctccacagcttcctgaatttaatgagtttcatcttaaaacgatggagagagctacacgacatgcagacacctgttccgaagcttcttccgtggggactatcaggagtcagagcagtaagccactgaccttgacagcgccaaaaccaccccaacttgagacagcattacgagctagaccaccaagggtgaaaagttctcaggaattggaactagaagaattagaaaaggctcccaagttcaaggcaaagccactgaacaaaaagattctcgagagcaagggtgatattggtgtgtttccacatctaaaggctcaaccaacagcccccaaggaattccatttctctaccgatgatcgcttgggtcctcctgcagttgtggatctatttgataagctgtctctttgctcagaatcttcatatcatagcaagaaagatgtgcccagattgacaataccaaaccccttcaatttacatacagatgaaagagggcatgagaaagagaggcagctagctgcacaactgctgcaaaagcaattacaggaagagaaagccaggattccgaaggctaatccttatccctacacaactgactatccagtgataccaccgaagcctgaaccaaaaccatgcacgaggccagaaggctttcagttagagagtttggtgaggcatgagatggagcaacagaggataatggaagaaagagagaggatggagagggaagaggcccagaggagagtagtgaaggcacaccccataatgaaagaggatcccattcctcttccagagaaagagaggaagcctctcactgaagttcaaccacttaagttacatgttgatgaaagggcggtccaaagatcagaatttgacaatatggtgaaggaaaaggaaataacttacaagagattgcgagaggaaaatgaattcgcacaaaagattgaggaagagaaagcgttgaagcagctcaggaggaccttggtgccacaagcacggcctctcccgaagtttgacagaccatttcgtccccagagatcaaccaagcaggtgacgaggccgaagtccccacagcttcaggtcgaccaaagaggggcaagaaggcacgccttcatcagatgatccaactctccggctcatcttgttgtcgtctatcggttacccactggctgctgctgttttctcttctgttcttgacgtcaagatcatccccaattctcgcagcgattctttctgaccaatacataaataggccgatccaatcctgttatatagtcagtcaacacagctgacggcgtgtgtatgctcctttagggttctgctgatgcttgactgcattattgtaaattcagtttgtgtgctgtgtgtgtgtgctgttcgatgaacgacaataggatgacaccctgtcagtgtcctcctcgtctgtttcgacgaatgcaagttgtattcattatttgtttatcatctctgaactatcctggagttctgtcgatgttgaataatctaattcatatctcggcacttgaaaaactctcgtgagaaacatatgtacc

SEQ ID NO: 120 - DNA, 1392 bp, Oryza sativa
gtgcgtcgcggcctccgctacccgacgacgccgccgcggcccgcgtcgtctccttggctcgccgcctgcgccgtcgtcgcgccggtctccgtcgccgggcgccctgctgcttccatcgcatactctcgcctctgaccccgagtccatctccccgtcccggcgtcgcctcggcctcgactcccgtctcctcgaggagttcgccccgtcgcctgcggccgatctccatccatcccgcgagcggcggtgcggtgttcctgctgcttccgcctccgggcgggagagggaggagcgggtgaccatggtgagcatggaggtcaccgatgagatgttcaagtgcatggaggttgggctggccttccgggactataatggaagaatcagttctatggatttccacagcaaggctacaaattacctcgtgacagcatgtgatgatgaatcaattcgcctatatgacattcaaaatgctgtgtgtttgaagacgattaatagcaaaaaatatggggttgagcttgtgtgcttcactgaaaacccaacttatgtcttgcattcttcaaaaaatggatgggatgattctctccgtctactctcactggtcaataactgttttttgagatatttcaaaggccatctagacagggttgtttctatctcattgtgctctgagaacgggaacattctctctggttcacttgatcgaacagttctcctatgggattcaagggttgaaaaagcacagggtttgctgcgtgttcaggggaggcctgcagtttcttatgatgatcagggtttggtttttgcaattgcatatggtggctacataaggatgtttgatgctcgaaattttgagaaggggccttttgatattttctctgtcggtaatgatgattcagaagccaatgtcataaagttcagcagtgatggcaggcggcttcttttaaccaccaaagctgggcgtgttcatgtgctagattcatttcatggcaataatatagcaacatacaatgtgaagccagtggtaagcaattcgacgctggaagcatcattcagccctgatggaaaccatataatatctggctctggtgatggcagtgtatatgcttggaatgttaggagtggaaaggttgctcgctggggaagcacagatagtgagccaccgctaattagatgggctccaggatctttgatgttcttgactgcatcttcggaactgtcttgttgggtccctgatctatctaagctgggatcctttactgttagtaagtaattcgaatggtacgagttgttgtttgtgtatgctcaggcctttgttctagctgtttgcaaaatgacaatgttaggtaaaaatctgagctgcagtgggtcaagcctcgggtcaacctagtccgggcc

SEQ ID NO: 121 - DNA, 2038 bp, Oryza sativa
ctctcgctccggtggtttgttgttaccttcgctttgcgcggcgtgtaaactgtgaaaaaaaagggaggaggagtagagggcgtcgtctccgccgctcgccggagaatggcccccgccggctccggagaaccaccggagtacgggtgctagtaggctgtggttggttggactggtggtggtgtggtgtggtgcggttggttacttgggggggtgggggtttggcggagatggtgtggttgtagtggttaggattcatgcgatcgatgccgttccagctcaagaacggtcaccaccaccacggcgccatggaggggaagccgccggtgacgccgatgcagcagcagcagcagcatgcgccgccgccgagggtgtcgaggtttcggaggttgctggtgagggtgtctgcgtcggagaggctcgccggggatgggaaggagaggggggagaaggaggcggagaaggtctccgcctccgccgccggcggtgaggtggaggccgggtcggtggggctcgaccgcatggtgctcagcttcatggaggattccgcggccgtcgagcggccgcagcgcgggcgctgcaactgcttcaacggcagcaactacgaggagagtgacgacgaggagggcttcttcctcccctccgaccactcctccgcctccgcccccgccgccgccggcgacgccttggagtctctcaagggtttggtgcagagcgcgagcgtcgcggagcggaatcttctcgcggacgcgtcgaggatcgcggagaggtgctgcaagggatccaagggcaaggcggagtgccgccgcgcggtggccgacggcctccgcgcactcggctacgacgccgccgtctgccgctcgcgatgggagaagacctcctcgtaccccgcaggtgagcatgagtacatcgacgcggtggtcggcgaggaggtgaggctcattgtggaggtggacttccggtcggagttcgaggtggcgcggtcgaccaaggcgtaccgggcggcgctgcaggcgctgccgccgctgttcgtggggacgccggaccgcctcgggcagatcgtggccgtcgtggcggaggcggcgcggcagagcctgaagaagaagggcctgcacttccctccatggcgcaagccggagtacatgcgcgccaagtggctgtccccgcacgtccgctccggcgacaaggccgccgccgccgctaaaaccgtgacgtccactacgtcggcgacggcgacgccggtctcggcggcgagcttctccggcgcgttcgagctcctgttcgataggaaacagagcggggagatccccgccgcggagaagatcacggtagtggtgtcgccgtcgccgtggcgcccgacggaggaggcgagcaagaagaagccgccgccgtcgccatcgccgccgcagctgtggcagcagcatcagcagcctcccaaagcgaaggtcgtcacggggctcgccgccgtcctctgagcgtggcgtggtgaataataactaccactctcctagaactactaccaccactaccatcactagttcatcgattcttttctttgttttcctctcctctttttcgtttctttttccaccgcgcgcttcgatccgtttggggatctagtttttggtgttttggggttttccggggtttttttcggaaaagagaaaaaacactttgcgttccaatttttttccctctcatcttccctttcccccctcttctttttttgacccttgtaatttttggttttagcattaggggctttttgtgaagctgctgttcttcaccccttctgccgaatagaactagtaatctgttacagattgtaagcagagtgatcaagtgatgctacttgcttgcttgctgcaaagcctcgtgatcttctgctgcttctccacttgtagttggataaatcctaaaaaaaaagtttccctcttgttttaccagtttttagtattaccgcccatccttgttaagttgtagcacttgtaatctccatggaagagatgaacaatgagtaattagctcagattcttctgct

SEQ ID NO: 122 - DNA, 1189 bp, Oryza sativa
gtcatcgtcgtccacctccgaccgacggctatgaaggccgccgcctccccgctccgcgccgccctcctcctcttcctctcctcctcgccgtccccgcgtctcgcgctccccatgaacccctcctcctcctcctcctcccgcggcgccgcctcctaccactccaaggccgccgccttcgcctccccgcagcctcgcggcggcggcggcggccgaggggggcgacgcggcggcggaagaggccgcggcggcgatgggagcgaccgcatcgacgccctcggccgcctcctgacgcggatcttgcggcacatggcgtcggagctgaacctggagatgaggaccgacggctacgtgcgggtccgcgacctgctcaagctcaacctgcagaccttcgccaagatccctctcaagtcccacaccgtcgacgaaatcaaggaggcggttagacgggataacaagcagaggtttggtctgttggaggaagatggtgagctgctgattcgagctaaccagggccacacagtaacgactgttacttcagagagcttgttgaaacccattctatcagcagatgaagtctctgtttgtgtgcatggaacatacaggaagaacctcgattcaatcttgcatcaggggctaaaacgaatggcaaggttacatgtacatttctcaagtggcttaccgacagatgggggagttattagcggtatgcggcagagtgttaacatcttgatatatttggatgtcagtatggcactgcaagatggaatgaagctgtacatttcagacaacaaggtgattctgacagagggtttcgatggcgttgttcctgtgaagtacttcgagaaaattgaaacatggccagggagagcaccgataccatttgaaaaatagagaacactgttgtaattttgctcatgcgtatagcgatctacttcttcagttcatgggaattgtgccctgaaaggccgaaagaaatgtaattttgcaaacaagtttaggttatgctcgtttgagaaatggagaggtagacattgttgtgaagcttcagtaagctgttcttaatgttgattgggtcaatggctcctccagtttatccaattccatctttgcagttactactaatcttgtaactgagtatattgcaatacacaattggctacgactgacgatttatgttgttgtatggtcc

SEQ ID NO: 123 - DNA, 927 bp, Oryza sativa
atcacgcttcccaaatcaaaacacaataaaaaaagaacataatttgaggaatactccaagtccaaatataaaagcagcagcagatcagagcagagcagctatcaaaatccaagatcgccaagtccaacaaaaagaagagaaagaggcgtcatcaactttagtagaatctccagttccaattttccatggcgaccttggcgcgcgtctccctcccctctgtcctcctcacgctgcggcatggcgcaaccacccagggcttcgcggcggcgaggccggcggcggtagtggcaaagaggttgctcggatccgtcagatgcggcggcgccgccgaggccttgggcgcggacatggcggtgccgcggtcggtgccggtgcgcgtcgcccacgagctgcagcaggccggacaccgctatctcgacgtcagaaccgagggtgagtttgcaggtgggcatccagttggagctgtaaacatcccatatatgtacaaaaccggctcaggactgacaaaaaacacacattttcttgagaaagtgtcgactacctttgggaaggaggatgagatcatcgttggatgccaaagtggcaagagatccctcatggcagcatctgaactctgctctgctggttttactgctgtcaccgacatcgccggtggattttctgcctggaaggagaatgaactcccaaccaacaagtgacgttggcctgaaagattttctgcgtttctgaaacctaataatctgcagatgacttcacgctccacggctgtacgcctgtacactatgtggtcttctcaaatgtgaggcatcagaagaatactgaataaatggattttgaagggatgaatggtgctagtttagagactagggttttattatgtttaatttgctgtcctgtcaccccttccatgttacctttcatgttaat

SEQ ID NO: 124 - DNA, 2152 bp, Oryza sativa
cacgcggtctcctctccttaaccccgtcttctcttctcctccacacgggagctcgccgccgcggcgagccaccgcgacctcccctccccctccccttccccttccccttcccggcgcgcgcatcgcatgttcccgcgacagcttcgtgcgccgagctgaggcgatgtcggtggcgctgtacgcgcgtgggggtggctgcggcgcgaaggcggccgcagcgcggcgctcggggcgcggcggtggtgggcggaggcgcgccgcggtcgtgctgctgctcgcgctggcgtacgtggcggggctgctcgtgttcgtgcttgcgggaggcggtggtgttggagttggagggcgcgtggaggtggggcgagaggtgggggtgatgacggtggcctcgctccggaggcggcgcgccgcggcggcggcggcgccgcagcccgggtcggtgtaccgcagccacctcgtgttcgagcggctctggccggacatccgcgacgacgccagctccgcctccgccgccgcctcgtcgctctcctccacttcttggcgtcgcagcatgttgatgacatcgcactatcagaatcctggggagctatggatgccttgtgtcaacaggaagctgattcgaccagagttgccaccttcaaatggttatctcatgatcgaagcgaatggtggtctgaatcaacagcgtctttcgatctgtgatgcagttgctgtggcaagtttgcttaatgcaactcttgtgatcccagcatttcattttaatagtgtttggcgtgatcatagcaaatttggtgacatctttgacgaagaccattttattgagacactcaaacaacatgttagagttgtgaaggaattacctgtagatgttttgacgcgcttcgatcataatatcagcagcataccaaatatgagaactaaggcctattcatctccaaatcactatatgcagaaggtgcttccggaattgctggagttaggggctgtgcgaattgccccattctcaaatagactggcacaatcagttccatcaaatctccaggccttgagatgttttgttaactaccaagcgttgagatttgctgggccaataagagttcttgcagaggatatggttgaaaggatggtaaaaaggagtactttgactggtgggaagtttgtatcagtacatcttcgcttcgaagaggatatggtagctttttcatgctgtacatatgatggtggcttgaaggagaaaactgaaatggaaaatgctcgtgaaagaagctggagaggaaagtttcatcggcatggtcgagtgatcaatcctgaggcaaacagaagagatggaaaatgtcctcttactcctctagaggttggtatgatgctacggggcatgggatttgacaataccacctccctctatgttgcttctggtaaaatatacaatgctgaaaaatacatggcaccgcttcgacagatgttccctcttttggcaacaaaggatactcttgctttgcctgaagagcttgctgagtttgaggggcactcatctcgattagcggcattagattactcggtctgtcttccgagtgaagtctttgtgacaactcaaggtgggaacttccctcactttctgatggggcacaggcgctacctgtttggcgggaatgcaaagacaataaagccagacaaacggaagctggtcttatctttcgatgatccgaatatcagatggaatcggttcaagcgccacatgcaggatatactacaccatagtgacatgaggggtactgcattgaggaaacccaatgattccatatacaccttcccaatgcctgaatgtatgtgccagcaagatgggatgatgtaggccttgtatgattcacacacatacgacgacgaggaaacatgcaattttgtacactctgtaatgatctgtaggtagccaccaccaccgtacagaagcaatctttggccaggaatttgttgatttctgtctgtagattgtagagagaggagaggtgaaaattggttctggttgtagatatgatgaaacacatgctgttgacaagggacagccttccctgtaaatgtatatgcagtaaagaaagaaacagaaaaggctaacaactacagtattataaagaaagagaatttcaagacattgtca

SEQ ID NO: 125 - DNA, 2662 bp, Oryza sativa
ctctctcttctctttctaccaccttctccttctcctcaacctaaaccccccaaacctctctcctcccaccaagacgaactcgaagccgcgtggaggagagagagagaaaggggaggaccggaggaggactcctcgtctacattgcggtctccggcggcggcggcggggttgccgccatctcgctctttagcctgtagcggcggcggcgcgggggagatggagagcgtggcggcggcggcgcggtcgctgcgtgccggggtggagaagtcgcgggcgctggggcaggcgctggcgcgggcggggccgcgggtggaggagatccagctcgcgctgccggcgctggaggccgccgtgcgcccgatccgtgcgccgcgggccgagctggccgcggcggggccccacatcgaccgcgccgtcggccccgccgcggccgtgctcaaggtgttcgacgccgtgcacggcctcgagccgccgctcctcgccgcgggcgccgtcgccggggacctcgcgggttacctcgccgtgctcggccgcctcgaggaggccctcaggttcctctccgataactccggcctcgccgcgcagtggcttgcggacatcgtcgagtacctcggcgaccatgacctcgctgacccaaggttcctcgccgacctcgccgtcaccctcgaggggctcaagaaaccttccggtgacctcgacggtggcctcctggcggccgctctggacatgctcgaggcagagttccgccgccttctcgccgaccactctgcaccgctcccgctcgcgatgcagcagctgaacacaacctctgcatctactgccgcgccgtctctcatcccggccgcgaccgttcacaagctcagcctgattcttgaccgcctcattgccaatggcaggcaggaccgttgtttgtccgtgtatgctgatgcccgcggaggcgtggtgagtgccagcctccgtgcccttggcctcgattacttgcgaaacccggtcgacgtcgcgcaggcgttgggccctggagttgagttgtgggggcggcatttggagtttgtggtgcgctgccttcttgagtccgagcgacagctctgcaacaaggtgtttgggcagcgcaaggatgacgcatcagcgtgcttcgctgatgttgcagcgcacgccggcattcttgatttcttgagctttggtcgtgcggctgctgatgcgaagaaggaccccattaagctcctgcgtttgctggaggtgtttgattctttgaataagctaaggttggacttcaaccggttgtttggtggaaagaaggcgtgtgtagagattcagaaccaaacaagggaccttgtgaagttgttagtggatggtgctgttgagatctttgaggagttgcttgtgcaggtggagctgcagcggcacatgcctcccccacctgatgggggtgtgccgcgactagttagctttgtggttgagtactgcaatcgcctccttagtgagaagtacaggcctgtgcttgcgcaagttctcaccatccatcgcagttggcgcaaagagacattcagtgacaagatgcttgttaacgctgtgcttaacatcgtcaaggcccttgaagctaattttgatgtctggtcaaaggcatatgacaatgtgacactgtcatatctcttcatgatgaacacacactggcatttctttaagaacttgaaggctactaggttaggcgagcttttgggtgatgcgtggctgcaagagcatgaacagtttaaggactactatctgacggtgtttatgagggatagttggggggtggtttcaccgctgctcaaccgggaggggctaatcttgttctccaagggccgggccacggcaaaggacctggtgaagcagcgccttaaaacattcaatgcgagctttgatgagatgttccgtaaacaatctgcatgggttataccagagaaggacttgagggagaagacatgtggtcttgtggttcaggcaattgttcctgcttaccggagttatatgcagaactatgggccactggtggagcaggatgttagtgctagcaagtatgtaaagtacacagttgatggtttggagaagatgctcagtgcgctcttcattccccggcccaggagggctgggagcttccaaatcaggcacacaaatgacaagattaccagtgcgatgacaggcttttatcggagtgcttctacagtgaaatagctttggttgaagaaccaaatggttggttctactatttatgcaataatgggatatgtaacaatgattcattttcggccagtcagcaaattgctccacactggacgtgaggcccaatagtgaacctgtgatgagaatattggtggcatatgaacataggctcttctatagttctcatggtgaaggtgaacagaagatggtgggggacaatgtgcgtaattgggacatttcctacttatcaaatgtcttcccttctgttattatgttattgtccctatcaccataaccatacatatagaaacttctgtggggacatgttgatatttaatcagctgtgtagtgtatgtaaaaattggtttcattttaggtgggctgtagacatttattttatatgttcaatgtgctacaaactgagcttcgatatgcaatgtattatatgaaaagctagagtttg

SEQ ID NO: 126 - DNA, 2773 bp, Oryza sativa
tagtaggctgtagctggcctgcactgcacgcctggagtcgtgcagccagaaaggcaaggctgcacacttgctgccgctctcgcctccccatactcagtacagtagctaggaagaaggcaagggaagggcatggcgacgctgccggacctgggtgtgtccgccttcatcaacatcttgggcgccttcgtcttcctcctcatcttcgccgccctccgcctccagcccatcaacgaccgcgtctacttccccaagctctacctcactggccagcgacgccaccaccctcaccctcatggcttcgtcaacctcgacctctgctcctacctccgcttcctcgcctgggtccccggcgccctccgcatgtcccagcccgacctcatccaccacgccggcctcgactccgccgtctacctccgaatctacacgctcggcctcaagatatttttgcccatcatgactgtcgccttgctggttcttattccagttaatgtctctggtggcacgttacttaatttacgaaaagaaattgtctttagtgatattgataagctttccatatcaaatgtcaaccctggatccaacaggttctttatccatctattaatggcatatgtgttcactttttggacttgctttatgctatacaaagagtatagcaatgtggcatttatgagattgcacttcctggcttctcagaagcgttgtgctgatcagttcactgtgattgttagaaacatacctcatgtttcaagccattcaacatctgaaacagtggatgaattcttccgtaggaatcatccagaccactatcttggtcagcaggctgtttataacgcaaacaggtatgctaaacttgtgaagaaaaaagagaggcttcaaaactggttggattactaccagctgaagtttgaaaggcatcctggaaaaagaccaattggaaggacagggtgccttggtttctgcggtagagaagtggatcaaatcgactattaccgtgctagaatcagcgagcttgataagaagcttgcatctgagcgtcaaagagttctcaatgacccaaaagctgttatgccagttgcttttgtgacatttgactcgagatggggagctgctgtatgtgcacagacacaacagtcaaagaatcctacccaatggctaactgattgggctcctgaaccgcgggatgtatattggcagaatcttgccattccatttttctctctcagtatccgcaaattcctgatatccattgcagtttttgctctggtgttcttctacatgatacctatagcttttgtgcaatcacttgccaatcttgagggtattgaaaaagttgcacctttcctaaggcctgtgatagacacaccagtggtgaaatccttcctgcagggtttccttccgggtttggctttgaagattttcctgtatatcctcccaacggttttgatgattatgtcaaaggttgaaggttatgtgtctttatcatctctggaaaggagggctgcttcaaaatattactacttcatgctggtgaatgtatttcttggaagcataatcgctggcacagcttttgaacagctaaatgcatttttccatcagccaccttcacaaataccaaggaccattggagtagctataccaatgaaagctacattttttatgacatacataatggttgacgggtgggctggcatcgcgaacgagattcttcgagtgaagccgctggtgatataccacctgaagaacatgtttattgtgaagacggagcgggacagggagagggcaatggatccgggcagcattgggcttgcagagaacctcccatcactgcagctgtattttcttcttgggcttgtgtatgctgtggtcacccccattctcctccctttcattatcatcttctttgccttcgctttcctcgtgtacagacaccagatcatcaacgtgtacaaccaagaatacgagagtgctgctgcgttttggcctcaggtgcactctcgcataatagcgagcttgctgatctcgcatgtaactctgtttgggctgatgagcaccatgaaggctgcctactccaccccgctgcttatctttctgccactcctcaccatttggttccacaagtactgcaagagccgtttcgagcctgctttccgcaagtaccctctagaggaagcgatggagaaggacaatctggagcgcacgtcggagccaaacctgaacctcaaatcgtacctgcagaacgcttacctgcaccccattttccacatgtttgagcagcagcagcaggagcaggagcagcaacgggaggagaaggtagaggtgcgaatcgacaaggcgcagcaacatcatcatcggcaggtagaggaggaagaggaggagagcaagagcagccaggctacaacacactactaccaccatcaccatgagcagaccacaacgacgacacaccaccattaccatcagcatgagcatatgagccactaccacatgggcccctccgacacagctgactcaccctcgccgccgcactttgtctaccattatggcgtcgacccttgataatcgcccagatagtctcttagcttctgaatcactagattgtttgttcttttgttttttccttttgtcaattgggggtgatatttttattcctctaattaacgaccgactggctgctgataattatttaatgatctgttgtaaatgcgaatatgtgagttgattgagtgtgtatatgcacgtaaatcggaaaaattccaatttgactccctcg

SEQ ID NO: 127 - DNA, 2680 bp, Oryza sativa
gcattttcgccatcctctcgcttcgtctccttctcggacaagcctcctccactcccggcctcccgatcgatcgcgactagttccaagcagagatcatcagcagcaggtgggggccgaccgccttagctccccctccccgccgcctggttctcatctggcgtgcaacttgtagcagcggcatggtggtcgtccatggacagcgggctgaagactcgtttggtgggtttttctccttcgatgaggacgctgccagtgaggatatgtcattggatggtttggatgaggaacttgaagagcacaaggattatgatgtattgataagtattctagcgaatggtgaaaaacagagagatatggcaaccttggttgaaggcaacctaggccatgctgaacaggatctgattcaagattatgttgaagatagtgacaacctggtattattgcatgatcagattcatgactgtgacattattttgtcacagataggatcacttcttactggattccaggttcacattggttccattaactcagaactaagaagtctccaggagagatccttggatataagtgtcagactgaagaaccgcaagttggttgagacaaagcttgcaaaatttgtcgaagagattgttgctcctcctagtttggtgactgttattatcgatggagagataaatgatggttatgctaaaagtttggaaattttgagcaaaaagttgagattttctcaagttgatcctatgattaatgcatcaaattctctgaaggatattaaaccagaactggaaaggcttctacaaaaggcattatgcaaggtgtccgactatctcactgaattattcttttccatgagaaagcctggaactaatatccagatactgcaacaaaatatggttcaaaaatataggtatctcatcctctttcttagagagcatggatccaaggtctacactgatgttcgtgcaacatatgctgatacaatgaacaaggtgctgagtgcacattttcaagtgtacatagaagcattggagaagctcaagcttgacattggcgtatcaagtgatttgactggatatgacactaatatcattgaccttatatcaaggggaagagagcatttaagaaatcaccgtttcatgttttctttaggtgaacgggcaagcattttgaaggagattgatcgacctggcttggttcctcatatatctgaagtcaatcctgtaaaatacccatatgaagttatttttaggagtatacagaagcttctgatggacactgctagctctgagtatctttttatcaaggcattctttggtgaagaatcattgttttatcaggtttttcaaggaccttttaaagttattaatggacatttggatcatactcttcgaaattatcatgacgcggtatgcctaatgctcatgatctgcataactaggaaacaccagttggttatgttgaacaggcgacttccttgtctagacgcatatttggataaggttctcatctatctctggccacgcttcaagactgtttttgacatgtatcttcaaagcttgtaccggtgtgatacaaaattgttatgggtagatggctcccatccacaccatattgtaaggtgctatgttgagttcacagcatcccttattcaacttaatgctgaatgcggagatggtcagcttgatatgaacttggaacgcttacggctagctgttgataatctacttggtagacttgctgaaaattttgcaaaccccaagacgcaacacttgtttcttctgaataattatgacatgaccatttctgttctgaaggaagccggtgatgaagcaaataaactgcaaagctattttgaagagaagctagaaagtaacatgatatcatttgcggatgaattgcttatggagcatttcaaggatttgataaaatttgtgagaagccgtgtctctgaagaccttattctttatactgaatgcccaagcattgccgatgttgagccaattgtgaagaacttcgccgtgacatggaaaactgctctagagctcatgcacaatgaagttgtaacttcttgcagtaaccttttagctgggatggagattctaaaagcagcaatggttcagctactcaatgactacaacagactctcagaatgtgtgaagataatcccaggaggatcaactctgaacaggaatctggtttctattacatccatttcatatgagatgaggaaatattcaataacactctagtaattgttatgatgtccaagcaatttttggaacagatgaaaaacaaacagcgctggtagtttcgatccctatcttcacaagcaagagaaaagcgcaacacaaaattatataattttgaacattctgtgctttgttttatggattgtaccttcacggcttcactgaaattttctgatcaaataatacttgacaacaatgatctgcttgcagtttacttctgattattactttatggttttgtcttgtctcaattgaagccatattatggggtccatcaagtgcatttctgtgttagcttgtatcatccagataccattcagacgatttttttggtacccttggacttggcatttcaatcaagtaatgatggttcacctatcgttgtcaatcagttccggtaagtatgttttaccttatcttctctcttt

SEQ ID NO: 128 - DNA, 1591 bp, Sorghum bicolor
gaagtagctgctattgctttggttgaaagaaatttaaaaactgatttgaaattcacctcatgaactgacttggctgacgtaccccgtcactgcaatcgtggacccacatgacagcgaaataggacccgatatgtgcgacgtagcaacgaacccaatcccaatcgagatatatatatctgcgttcctgcgacgcgcatggcgccacgactccccgagggccgtggccttggccggcgctcggacatgagtacatggcactcggtggcctcgcgtcgcgctactccctcaccgacccaccgggcaccggcaccggcaccggcaccgcgccacggccgcgttcgtctcgacaggagccgatggccaccatcgcgccacggtcgcatctcctcctcctcggcctgacaaggccgcagcagccgacagcgcttcgtgcctgcgccgccttctcccgctcgcgcggcgcgccagtcccaccgcgggccgcgcagccgcggcgcgtcttcctcggcctcggcgccaccttcatcgaccaggtcacccgcatggcctccggcggcacctcgtcccgctctttcgttgccggagcgcggccgaggcagggggtttccccagtcgagcagattctgaagaatgtggagtggcccgacgagttccctttcaagcctgaggacttcagccgtttcgacgaatcatcagatactctgttctactcagttccacgttttgtcactcacattgatgaccaagcaatccgagctctcacagagtactactctgaagttcttcctccaattaatactcctggggcgaccattctcgacatgtgcagcagctgggtgagccattatcctcccggttacaaacaggagaagatcgtggggatgggtatgaatgaagatgaactgaaaaagaactcggtattaactgagtatgttgtgcaagacctcaatgtgaacccaaagcttcctttcgaagataacactttcgatgttatcaccaatgtggttagtgtagattacctgacaaaaccaatagatgtttttaaggagatgcgacgaatactcaagccaagcggccttgctataatgagcttttcaaatcggtgcttttggacaaaagctatatctatatggacatcaactggtgatgtcgatcatgcctggatagttggcgcttacttccattatgctggaggttttgaacctcctcaggcagttgatatatctcctaatccaggacgaactgacccaatgtatgctgtatgctcaagaaagaaaatagggtaaattaaatagtgtattttgcaagtgctatcaagaaacaaataaaggggaaaacaagaagaagcaagttgcttggcccagatcgcctggacttgatgattggtgagctgaggcaggcagcgcacgtgcatgtttccgtgagcaatgcaaccataggaaaaggaagcaacactgctgcacagactatttatagaggcggtcagattcatgttttttttttggataaacagattcatgtaggttgtagcgaccgtctttactaaagctctctagaattgatatttttttaaaaaaaataatagtatttt

SEQ ID NO: 129 - DNA, 3561 bp, Sorghum bicolor
tcccgcctccatctcacctaatattactgcaaacgcatattttttgacaatttttttcccaaaataattcatcgtattcttttcgttccatttccaacttcatcatttctttctttctttctttggtttcttcctctctatctctcgtctccctcctaccgaattaaaactctcgacctgccaagccgcaccgaaccctaggtcccgatccggcgtctcgcccgtgctgcttggatcggacgggtgtgttggatcggatcggcggcgggatgacgatcccgagcgcggaggggttcctccaggcgtcgagctgcctcccttgcacggcggcggaggagcgggaggtcgttgacgcgctcaccagggaggccgagaagaatgtcaagcacggggatctccgctatctcgtctcgcagagctggtggatggagtggcaaggttatgtgggcatattcagtcatggagagaatggcaccgagcagtttcctcaggctatgaatagacctggagagattgataactcgaagcttgtttcggcagaaaggatcaatggtagtgaagagccagagcttcaaaggaccttgagagaaggggagcactatactttggtgccgcaagaagtttggcaaaggctatatgaatggtataaaggtggaccagaaatccctagaaaagttatttttgacaatccaattgacaagacttacatagtggatgtctaccctctctgtctaaaactaattgatggaagggacagttgtcaaaaagttttcagaataagtagaaaggccaaagttcatgagctttactcaatggtttgctcactcatgtcagtagagcagtccgagattgtcatctgggattattaccaaaggtcaaagggcaaaaagttgcttaatcaaaatgagacactagaagaagctcaacttactatggaccaggagatcctcttggagatgaagctgggcgagagcagttcaggtttcagtacaagatccacaaatgatgaattagcattaattccattagaaccctccacatcatcattttctattgctggagggcctacattttcaaagggtttttcatctgggattggttctagtttttcacaagataatagcttcagtcctttattaagggatagtgaagatggttacaatagtctcagcaatggaactaaagatggcactcatggattgagtggattacataacttgggtaatacatgcttcatgaatagtgccatacaatccttggttcatacacctccactggtacagtactttttggaggactatacttgtgaaataaacacagaaaatccactaggccttcagggtgaacttgcgatagcatttggagagctacttagaaaactctggtcatctggtcgaacttctgttgctccacgtgcatttaaatcaaaactttctcgttttgctccacagttcagtggatataatcagcatgattctcaggagctacttgcgttcttgttggatggtctgcatgaagatctgaaccgtgtaaaaaagaaaccatatattgaggcaaaggatgctgatggccgtccagatgatgaatttgctgaagaatgctggaattaccataaagctcgaaatgactccataattgtagataggtttcaaggtcaatacaagtccacattggtgtgcccagtttgtaacaaaatctcagttacctttgacccatttatgtatttgtcgctgccattaccgtcaacagttactcggatgattactgtaactgtattcagtggtactggagatgttcttccaatgccttacactgtgactgtacaaaaaaatggaaactgccgagatcttactaaagcccttgctgatgtttgctgcttaaaagattctgagacattgttgcttgcagaggtatatgagcgtcggatctaccgttacctaacaaatccaattgagggacttcatagtataaaagatgaagatatacttgttgcatataggctccctgttggttatgaaaaacttttgaggttggagatcctgcatcggagggcagacagatttcttgtggagcctcagtttaatatcaacaggaagctcattgggtgccccattgtgacttgtattccaaatggttctactggaaaatctgatatttatgcggctgtatctgctgttttggttccatttgtacgagcaaaagcacatagccctgatgtgtctgctgtcaagttaaatggcaatgggccaagcctggatggtattgtactgacggataatggcaccaccagtgaggagggtctctctatatcaagatcaagtgaggatgataatgcagctgtcgatgagcttttaccgttccagctttcattgactgatgaaaaaggaagtataagaaatgctatagacacggattctaatcgtggtttaggactagttattagggttttgatggattggtctgagaaagagcatgggatgtacaatattgattacatggatggacttcctgaagtcttcaagcctggttttatgtcaaagaagacccggcaagaagcagtcaatttattttcatgcttggatgcttttctgaaggaggaacccctagggcctgacgacatgtggtactgtcctgggtgcaaggaacacaggcaagctagcaagaaactggacttgtggaggttacctgagatattagtagttcatttgaaaaggttctcatacagccggtatatgaagaacaagcttgatacatttgtgaattttccaatccatgacctcaatatgagcaagtatgtgaagctgacatcaagaggtgaccagcaccccatgtatgaactctatgcagtaataaatcattacggtggtcttggtggtggacactattctgcatatgcaaagctagtagaagagaacaactggtatcattttgatgatagtcatgtttcctctgttaatgaggatgagatcaggacgtctgcagcatatgtgcttttctaccgacgagttggaggttcaagtacggtggcaaatggtggtgcagtcgacattgaaatggttgattcgatagagatgtagttaagcctatgagtatatcatgtggaccgagatatggagctcagaagagttcttctggaatttgcatgtctgctctgggacggaatattcgtgtatcgagccactgatattttgatgcatggcagagaagtgtggtcgaattagcaatgttagcatatggatatgcatttcatatgactcagagttccagatattctgtgaccaacccttttgagtagaactgatcccgataggtaattgagaaaatgacctgatttgaaaattttgctgataggcagatgcagctcttggggtctacaattttaattggtgtggaaggtctgtgctgtagccaagggattgcaactggaaaaaatgatgtaacaatgctgcatattctttttgcctaagctacagctgtgctacagcagttttgattactgttgccttttgttataaaattctcttatcatcattacttgctgagccttagtgtgattatgcg

SEQ ID NO: 130 - DNA, 1090 bp, Sorghum bicolor
ctcctccctccctccctccttaaatgcactatctcccctcccattcccatccctagacgagagagctggaccgcgcgcctgtctgcactcgtcttcttcctagcagagaaaaagcagaagacatacaaagatgtccaagatggcggagcagaaggcggcggccgtagacggactcggaggagccggggcggcggacgctgcgccggcgggggaggccgcggcggcgcgtgtgcggcccgttgagacgctcctgcgcgcggcgccgctggggctgtgcgtggccgccatgaccgtcatgctccgtgaccagcagagcaacgagtacggcaccgtcgcctactccgaccttgggggctttaagtacctcgtctacgccaacggcctctgcgccgcctactcgctggtgtccgcgttctacacggccgtgccgaggcccgccaccgtatcgcgctcctgggtcgtcttcctcctcgaccaggtgttcacgtacctgatcctggcggccggtgccgcggcggcggagctgctgtacctcgcctacaacggcgacaaggaggtgacgtggagcgaggcgtgcggcgttttcggcagcttctgccgtcaggcgcgcacatccgtagccatcaccttcggcaccgtgctctgtttcatcctcctctccctcatctcctcgtaccgcctcttcagcgcctacgaggcgcccccgtcgtcggcgctcggcagcaagggcgtcgagattgccgcatacccacgctgaagccgcgcgccggccttccatcgggggctctggagggagacgtggttgcagatctctattatatgtgtaggcgatcaagtaataagggcttatatttatatatataatacttcgttcatatagtagttgtttgctgctacatatgattagtacagtgctgctgctgctgctgctgctaaattgtgcttgactcggtaattatatggtttgaaacgttcttgtgtgtactggatggatcgatcctaaaattcttacttgtttctgtgcatgcattggttatggcaacatctttctgtttgtaacaaacaaacgagaagttgtttgggtacgacg

SEQ ID NO: 131 - DNA, 1280 bp, Sorghum bicolor
gccctctgccttgtgccttgtttatctatacacccaatccaatccaatccaatcctcgagttggtccaagtccaacccaaccaccgtcgtctcgtctgtcctcgtcgcgtaattcagggagctggcggcgtctactgcttctaagctggagagagctgcaccagtgcgcggcgccaccgccggagagggcgacgagataggcatcgatccggggaacgagactccggagcagcgcaacaagttcctcgtcctccgcctctacgaggcgctcaacgcccgggaccacgccgccgtgcagtcgctcctcgcccccgacctcgagtggtggttccatggcccgcccaagcaccagcacatgatgcgcctcctcaccggcggcggcggcagctctggaggcttccgcttcgtcccgcgctccgtcgacgcgctcgtcgcccccacccccaccacctccaccaccgtcatcgccgagggccacgaggggcggtgctactgggtgcacgcctggaccgtgggcgccgatggggtgatcacccagctccgcgagtacttcaacaccgacctcaccgtcacacgcctcgccgccgtcgccgtcgccgcctccgccaagtgcgtgtggcagagccgccgccccgacagcgccaccaactcgctgccgggcctcctcctcgccctctgatctccaatccatatcagatcagatcagatcagatccatcacccaaagtcgtcgtcgtcgtcgtatattattggagtattttggtttgcgcctttttctttttctttcactttaatttcgtcctactatatactagtgagtcgtgagtatccatccacctacgtattgtacgccgccgtcgatctatggccacgtcgacgcgttgcttctcgtgtcctcctgctttgttctactgcaacctactactagtattgttctactccaataaaacattatcatcactattgtgttctgtatattattgtctgcttaactattcatcgtacgtatatcttgaatcttgtacgatccgtttattctacatatcttattgttataaaatacataataatattgctattgtatattaatctattattgcttactactgcaaaagtatattaggccttgtttagttggcaaaattttaggtttttggctaccgtagcactttcgtttttatttggagtaactaggctccaaaaatttatctcacaaattacaggtaaactgtgcaattaatttttattttcgtctatatttaaagcttcatgcatgcgacc

SEQ ID NO: 132 - DNA, 1995 bp, Sorghum bicolor
atttaattgtttgtatacattttcagctcccctctccgctccccattgccgcattgccctccctcgccccttctccctcgcggcctcgcccaccgcgccttcgaggagcttcgaatcccgatcgcctcggtccccgcgagctcacatggtgggggcgcgcaccagagactagggttcccagttcccaccattttcctgctgattggaaccgcggggtttcggcgagcctgaggcggtggcggcggcaggaatgaacggggaggtggaatgtagcgtgtgccatgcgaaggtgcaggtgccgccggcggtgtcgaaggcgtacgatagccaccggagcaccgtgtcgtcgcggcagcgcgcgctaaacgtgctcctcgtctccggcgattgcgtcctcgccggcctccagcctatattagtgtacatgtcaaaagtggatgggaaattcaaatttagcccaatcagtgtgaatttcttgacagagattacaaaaattatctttgccattgtcatgctattcatccaggctagacgtctaaacgtgggagacaagccactcctcacagtatcaatatttatgcaggctgctcgcaataatgttcttcttgcagtacctgcttttctatatgctatcaacaactatttgaagttcataatgcagttatattttaatcctgctagcgtgaaaatgctgagtaatctcaaggttctagtaattgctgtgcttctaaagatgataatgaggaggcgattttccataatccagtgggaggcccttgcacttctgttaattggaatatctgttaatcagctcaaatcgttgccagaaggttctagtgcactaggtcttcctgttgcagctggagcctacctatatacactattttttgtgacagttcccgcattggcttcagtttacaatgagaaggctcttaaaagccagtttgataccagtatttaccttcagaacttgtttctgtatggttatggtgcaatatttaactttcttgggcttgtgatcactgccatcatccaagggcctagtagctttaacattctggaaggacactcaaaagccacaatgtttcttatctgcaacaatgctgcacagggcatactgtcgtcatttttcttcaagtatgcagatacaattttaaagaagtactcatcaacaattgcaactatcttcaccggagtagcctctgctgtattgtttggccacacactgacgataaattttgttcttggaatttcaatagtaatcatatctatgcatcagtatctttctaatcaaattaaggacgaagtgcctagcagcaaagttgaaatggctgaagcccatgatcacagcagaaaggagcctagttatgtcaatgtgcctgattcagtggcaagtgaggctaaacaccgccatggatctgacgagaggcagccacttcttcctgtatgattttgtagaagagcaggcacactgtttcctcaacagagcagcatgtaccttaactgtcttacaacatggattctccatgacacggaggaaaagagagtatttttagcgggtatttgacctaattgtctctaaagccacattgctgccatgcgagtaaaggatatgcatattcggcggcagagtgacgagcttcgtgaagtagattaagtagtacattataatagagtaatggtctttggatggatgaggcgatacctctaaccagtgggtggtaaaactaatgtgataagattagtgaggaataaagtcaccgccattttttttcccttttgatagagccacatcagccgtggttctatgagtgtctttttttttttttttttttgcggcaccaatgtaaatatcagttcgtttcagatggcgcgtgccgaccagagatttcattcctgtatttgcgtgttgcatgagatactgcgacgtgtttactgattactaagctttgcatgtcttccgaattacagcgaaacgactaattgatactctct

SEQ ID NO: 133 - DNA, 2514 bp, Sorghum bicolor
actggccactgcctcgtgaggtgggtgactgactggtgaggtgaggcctttgagctgccactgccagcccgtccccacctccaacctcattaaatacccactttgacctcaccgtcggcttcttcggccggttgggttgcttccccttccatcctctctgctctgctgcccgctggcctggtctggcgttgcggcggccttgctgccggcgctggcggtggtttgagttggagcaaccgcatcatcagctgctggcgtctggcgaggccggatcgaaatcaatggcggcgaggtgacctcgtctttcccccgcttcagtagtccggcggccgcgtcctcctcctcgcctccgatcctccgtcccccctgtgcggtgcgcgtgccagcgaccaccgcccggattagggggagaagagaaggcgtccccgaggaagagtccgctctttccggcagccgtttctccagcaggagggctgttcaactccagtgattgattgaattccttcgcgaggccacgaaattggggggatttcttcatttcctcactggcttaaccggcaggaaagcagcttttttcgcgaggttctcggcttgatttcctcgtgcggagggccggccggtgcttgtacctctacctcggagcatgcgtcgcgtccgggtgtcctcccagcaggcccccgtccacaagctcggcgacgcccagatgaagctcacgcccaggttccgcctcgccgccacctccacctccacctcggatccagagcaccagcagcagcagccaccgtcgtcgtgggaggaggagcaggcgccgctgatcccgggcctgcccgacgacgcggcgctcaactgcctgctccgcctgcccgtctccgcccacgacgcgtgcaggctggtgtgccgccgctggcgcgtgctcctcgccgacaaggcccggttcttcgcgcagcggaggcagctgggcctccggacgccctggctcttcacgctcgcgttccaccgctgcacgggcaagatccagtggaaggtgctggacctgggccacctcacgtggcacgccatcccggccatgccgtgccgcgaccgggcatgcccgcgcgggttcggttgcgtcgctacccccggcggcgacggcgccgacggcgcgctcctcgtctgcggcggcctcgtctccgacatggactgcccgctgcacctcgtgctcaagtatgacatctataagaacaggtggaccgtcatgacacggatgctcactgctcggtctttctttgctggtggcgtgattgatggccgggtttatgttgctggtgggtatagcgcggatcagttcgagctcaattcagccgaggttcttgatcctgagaagggtgtttggcagcccattgctagtatggggatgaacatggcgtcgtctgactctgcggtgatcggcggcaggctctatgtcactgaaggatgcgcttggccgttcttctcatcgccgagaggccaagtgtatgaccccaagatcgaccggtgggaggtgatgccggttggaatgcgtgaagggtggacggggctaagtgtcgtcattgagggacgcctgtttgtcatttcagagtatgagaggatgaaggttaaagtgtatgatgcagaggcggattcatgggactcagtcagcggccctccgatgcctgaaaggattatgaagcccttctcggtcagttgtctcgacagcaagatcgtcgtcgtcggacgaggtctccatgtcgcgattggccatgttcagaaggaacctgctggtgatcctgatagcaggagttcaggctactccatttgctggcaagatgtggatgctcctaaggaattcagcgacctgacaccttcaagcagccagattctgcatgcttagctgctcgttgagtgagcgagaaccattggtaatccgcagaatgaccgcagctgccaagtcttccttgccaagttcagaactgttgttgaatgcacaagtgttccttgctttgttgacaagctgatagcttaagtttgtatttgtaacttttcttcctttgtgcattgcatgactcttattgatatgtgatataagaagtaagctgttctgtcattctgcaagtgcaacgcttcgcatttcctcacacagagtggcaacagtttcctgaaaactttgagcttgcaaaatttctttttgtatgtactgtagtatctattcagatgccttttagccagataaaggttggattgtgttactttgtaaaagggccagagagaggagataggtgcagagatttgatcatcatcattctttttactattttttttccatgcgaaacaaaatgattatcatgttattatccatagtgacatgacctcagatggagttggagacgtggagtgtagccatccaataaccagagatggccctcttgtggtccgtgaggactggactggagacacaacagaacaggatattcctcaacttgcacggcaatgatttaccaatcgctaggttaccacatc

SEQ ID NO: 134 - DNA, 1942 bp, Sorghum bicolor
gtctctggtccctccttggtgcttcgtctctcgcatcgccacgacgcgccacggcatcagattggatcagaatataaccgccgccttgcgacaccgcctacccctctccctctccctgccccgagacccccaccacccccgtgcagcgccgcgcggccttcgacgccgcgcccgtgacccaaccagccgcctctccctctccctctctccacccgggtctccacgccgccgccgccgcgcatccgctcctccctgcccctctcggcggccggcagggcgggtgaggtcgcactcacgagatggaaagcaataatccatcacattctcagattgctgaagtgaagatggacatctcagcatcagcttctggagcagcagggtacaaattctgcaaaggtgctgcctgtgatttctctgattccagcaactcctcgaaagatgccaaggagagatccgcatccatgaggaagcttataattgcagtgatcctttgcatcatattcatgacggtggaagtggttgggggcatcaaagcaaacagtcttgccatcttaactgatgcagcacatcttctttctgatgtggcagcatttgccatatcattattctctctctgggctgctggatgggaagcaacaccgcagcagtcttatgggttctttcgaattgagatccttggtgccttggtctccattcagctcatatggctacttgctggcatcctcgtatatgaggctattgtaaggctcattaatgagagtggcgaagtgcagggctccctgatgtttgctgtgtcggcgtttggattgttagtcaacattgtaatggctgtattgctaggccatgaccatgggcatggccatggacacagccatggacattcacatgaccatggtcatggtgattcagatgatgaccattcccaccatgaagaacaagaacagggccatgttcatcaccacgagcacggacatggaagttctattactgttacaacacatcaccaccaccaccaccactcaggaactggacaacatcatgatgttgaggagccactgattaagcatgaggctgactgtgagggtacccaatctgctgccaaagctgctaagaagcctcgacgtaatataaatgtacacagtgcttatcttcatgtgcttggggactccatccaaagcatcggggtgatgatcggtggggctatcatctggtacaagcctgagtggaagatcattgatctcatctgcaccctcatcttctcggtgattgtgctgttcaccacaatcaggatgttgcgcaacatccttgaagtcctgatggagagcacaccccgcgagatcgacgccaccaggctgcagagggggctctgcgagatggaaggggtggttgccgtccatgagctgcatatctgggccatcacagtggggaaggtgctcctggcttgccatgtgacaatcgcccgggaagcagatgctgatcagatcctcgacaaggtaattgggtacatcaagacggaatacaacatcagccatgtgaccattcaggtcgagcgtgaataggggattgtcttttggctgtcaggaggcataaatggcgtcacgtcttcactggttatcttatttgtgtcggttaaaactagttttttgcacctgggaagttcatcagggattcgagctttgatgctgggtagtgtcatctattactagtctattagtcggaggaattatttgggtggtggtaggcgtcagtcggtgcataaacatggatgaaattttcagtcatgctgttgacagcattgtggttcatcgaactgcatctgtagtttagtacgctgtgtcatcaccttttgtgtaaggtaacgtttctgtggtatggaagatgtgaagttcgtgattggcctgttaccctttgttctgtttgttctgaccatgtttggtcgctg

SEQ ID NO: 135 - DNA, 2795 bp, Sorghum bicolor
tccaggatcatcaaaagttcaaaaactgcagagagaccgaaaatcgccatccatccaccaggaaagaaaaaaaagcttcccaaccaattaaaaccccgctcgccgcaactcgccgccgtctcctcgccttccgcctccgcgcaccgactccaacgcctctcctcgtcggctgcccacctccgcccggcggccggagcagagaggcttaggttaccggcggcccccggcgcccccacttcgcggtcgagctggaggacacgcgtagcaacgccgggttcttctgcggcgagctgtggtgtggcctcatggagcccaagggcgagttggcccagaagcctatcgaagaagcaatcgacggcttgaagattgatgctagcaccaaggcaagcaatgtcaacttgcctgctaagaaagatgcaagttcttctgatgcagtatcttgcatttcctccggagatgcagctagtactgtgaaggaaactgaaatgaaccaagaaacttattttggggaccaagggatgtattactatggatattattatcctggttcatatggaggactggatgagaatggcaactttgttggatataatggcctagaggtgcacccagcagtggttcaagctgacaatgggtcatatctgtgtcatcttccggggtatgaaaatggatatgcttcttatagtccggttgttcctggaggcattgctagtgtggatggtcaatatgtcagcaaagaacaatattactccactgcaattccattacaggatctaagcacacctggcatttttgctcaaccaattgcttacggaactgaactagtacctgcatactcatgggacccttcttttgttcttctggatggagttcagggacatccagttggtgtgcatcaaacaaattatgctgcaagaccaaaatattcttctaataagcatgctattccttcttcgaaagctgcccgcagtgcaaaacccgcagcagatactgtcaaaggatcatcatcaggtctagaaactgtagcaaatgctgctaatagcagcccatcatcgaagggtgcaaataaggcatctggtgcttccataacaaaaggatatcttccatctagcaagtttgtgatgcatagtaataaccaaggaaaaatcagtgtttatcaaagcaaaggtatcaatgtgaaagaaagtggtagaagctggaacaacggtgagaagcttaagatgagaagtaagttaaatggacatggtgattctgaatctaatgagagcaaccacactgataactcaaaacacagtttgagccctcaatctgatgttggattgccaagttcagggggtgctaacgctagcataccttcacatgttgcaataagcaaaaatgcatataatctttcagattttgttacaaagtatgaacaagctctattctttgtaattaagtcttatagtgaagatgatattcacaagagtatcaagtacaatgtctgggcaagtactcctaatggaaataaaaggcttgacagtgcctatagacttgcacaagaaaggatggcagaaaaaggaaccaaatgtcctgttttccttttcttttcagttaatgctagtggtcagttttgtggtgtggctgagatggttggcccagtagatttcaaccggaacatgaacttctggcaacaggacaagtggaacggtttcttctcggtaaaatggcacattatcaaggatgttcccaatccacaatttcgccatataattttggagaataatgagaataaacctgtgacaaacagcagggacacgcaagaggtcaaattttcacaaggtacagagatgttgaacattttcaagaactttgcatgtaaaacatcaatactggatgactttgacttctacgaaaatcggcagaaagtaatgcaggacagaagaggcaagccgcttactacattgtttgatcacccattgccaaaagctgaaaaaactgcagaaatcaaaaggcaaacacatgccacagaattcggtagagccaagagtaatgaggggcagggcaacaatgttggggtggtgcatgatacaaccaagaaaaatgaggagcagagcaacaacgtttcagaagtagttgatgcagcctgtagcaacaaggagcaacccaacaaagttgcaacacaatgttgatgccatgagctagttgaactggggaatgagatagcctctggaatggacttcaacctgaatgataaatttgatgtgtacaatgtcaagaaaccatcatttgtcatcggttctcttccattttctcatgcaagcagaaaaggaaaaagaaagtgaagctatgggactgtcttcccacgagaaatgttcaatgactgggaaaaaggttctaagacacatttatgttgaggcccctggtgctaaggcattagagacccctccttgtctatttttttttatctcggagggtattttcttttcttgtgttgtgtctttttttttcttctcttgttcttcctattacactgctgagattttgcgaagcagtatgcgctgtggtccaaagaagccagtttgctttatggctgggtgtgcttaacggagtgtttgttgctttgtgggttgtcctctaggatgtgttatgtgttgactgtttccttttagaatatgtgcaattgttctagaaactgacatagaagaaaaaaggaaaaaaaaagattgtgagggattaggaattaattacaataacttaatcttatgttgctgtttcttccattatcaagaaaatgaacaaaaaggatttgaaaa

SEQ ID NO: 136 - DNA, 1375 bp, Sorghum bicolor
attcgaggcaaccacctatccgattcccggagcccctccccggactcatctcgacgcggtagcgccacgccggcgtcgccgcgatgctcctcctcccggggcgtccagtcctcccctctccggcgctgccatactgcccctcgccgtctccatcccgtttccgtcccctcccctgcaccagcaacgcccccacctctgcttccaccgccgcgtccgccgacgccaccgcctcctcgtccttctccgtcgaagaatacctcgtgaacaggtgcaacctctaccccaacgtggccgcgcgcgtggctccggagctctccgccatcaggtctccctcgaagcccgacgccgtgcttgccttcctcgccgacgcgctcgagctctccccgccgctcattgccgtcgcagtggcccgcgacccgacgatactcacctgcagcgtgccaaggacgctcgcgccgcgcgcggacgagctccgcgcgctcgggttcaccacgtaccagatgggccttatcgtcgtgcgctgcggcgcggccgcgttccgctcacgcgcgctcgtctccagtgtccagttctggctcccgtacctgcgtggtcgcgtcgacaagctcgtcgccgcgctcaagggcaacccgggcctcctcaccgccgatctccggacggtcaagtctaccatcgcgctgctccaagaggaaggcaccctcaccgatggcgacgtcggctggttcgccctctcctactgctccaagctgcttgtcgcgagcccggacgaggtcgacaccgtcctggcccgcgccgacgagttcggcgtgccgcgtaagacgcgggcgttcaaggacgccatcatcgcggcgttcagcgccactccggagcggctcgcctggaaggccgcgttcttcagggacaagctcgggtggacggaggcgcaggtgaagacggcggctgcgaagatgccgacgctgatgacggtctccgcggagcggatccggaggaactgggagttcctgaccacggaggtcgggatggacgcggagcgcgtcgccagcttcccggcgctgctgaggtacgacctggaggggcggctcgtgccgcggttccaggtgatgagggtgctgcaggcgcggcggctgtggcgcggcagggacttcaacaacattgctgccatcacggaggaggatttcgtggccaagttcatcaggccgtttctggtccaagtcccagacctggccaagatctacgaggccgccgtcgtggagaaggaagaacagtagcggatagtgtataattagggatgaaaacggtacggatattttccgaccgtattagatctgtccgtgtccgagtccgaatattcaacatccgataccgtatccgtatc

SEQ ID NO: 137 - DNA, 1710 bp, Sorghum bicolor
accatcaccctgcatccccagccgtcgccactcgctgccagtgacccagccaccacaacccctctcatcgccatgggaaccaagaatcttacacggaaccgccccgcttccatggcgacggcgtccaccacgctgctcctctccctcgccctcctcgccttcgcctgggcggcatcgccgtcgccggatgcggaggcgatctcccggttccaggagtacctccgcatcgacacggcgcagccggcgcccgactacgccgcggccgtggccttcctccggaaccaggcctccgaggccgggctcgaggcgcgcacgctcgagctcgtcgccgggaagcccctgcttctgctgcggtggcccgggcggcggccgtcgctcccctccgtactcctcaactcccacactgacgtcgtgccgtcggagccgagcaagtgggaccacccgcccttttccgccgccctcgatgaggcgtccggtcgcatctatgcgcgaggctcccaggacatgaagtgcgtggggatgcagtaccttgaagccatccgccgactccgttcttcaggatttattccagatcgaactattcatgtaatatttgttcctgatgaggagattggtgggcatgatggtgttgagctgtttgtttcatctaaggagttcaaagatatgaatgtggggttagtgcttgacgaagggcttccatctcctggggaggagtatcgggtgttctatgcagagcgtagcccctggtggcttaccataaaagcaaagggtgcaccagggcatggtgcaaagttgtatgatggcagtgcaatggagaatttaatgaaaagcgtggaggctatcaggagattcagaacatcgcagtttgatttagtgaagtctgggcagaaggctgaaggggatgttgtgtcagtgaattttgcatacctgaaggctggcacaccgacaccaacgggttttgtcatgaatctccaaccatctgaagcacaggtaggtcttgacatccggatgcctcctgatgttcatactgaagcactggagaggcgccttattgaagaatgggcaccttcctcacgcaacatgaccttcgagtttaaacagaggggttctgtcctggacaactttgggaagccagccttcacacctgctgacagctcgaacccatggtggccagtgcttggagaagctgttaagaaagctggcggtaaactcggtaaaccggaggtatttcctgcctctacagatgctcgctacttccggaagattggtttaccagcattcggtttctctcctatggcaaacacaccagtattgctccacgatcacaacgagttcctaagcaaagacgagtatatcaaaggaattggggtatacgagtcgatcatcagggagctggccactcacaacgatgaagccagagacgaagaatcgagggcagagctatgagatgaccttaccctcgatgcaattcttgaagctcaaatggagcactgaaatcatgtttgggcaaagctgctgattacgtgtctgctccaacggcaaaactgaaacagtgaacacgattacatgaaccttgtacattttcagtaaaattaaacactctgaataatccatactgcagctgcggtttcgccgttgcataaacctagcactatgcactgaactttttctgctaatatcctgttctgttttatgcttgtggtcccctgc

SEQ ID NO: 138 - DNA, 1263 bp, Sorghum bicolor
cggcccccgctcatccccacccatccatcgcaaatccacaaacaagaagaacgagctgaaatcactcgtccaagaacaccacaccaccagtccaccaccacaagtagagatttcgtcttggagagccaccaccaatggcttgttccactgcatctttagcggcgacgctgctggcgttggcgctgatgttccaggcctccctcgcggggaggaggctcaccgcgctcgtgcaggagccggccatcaccatgaagtaccacaagggcgcgctcctgacgggccccatcgccgtcaacttcatctggtacggcgacttctcggcgccgcagcgcgcggtgatcaccgacttcgtctcgtctctgtccgcgccgccggcggcggtgcagccggagccgtccgtggccacgtggttcaagacggcgcgcaagtactacgccagctccaaggtgcggttcccggcgcttcgcctcggctcccacgtcgtcgaccagaactgctccctcggcaagcgcctcacggagagggacctcctcaggctcgccgccaagggtggcccgagccgcgccatcaacctggtcctcacggccgccgacgtggccgtggacgggttctgcatgtcccggtgcggcacgcacggcgcgtccccgcggtcccgctccggccggttcgcgtacgtgtgggtgggcaacccggcgtcgcagtgccccgggcagtgcgcgtggccgttccaccagcccgtgtacggcccgcaggcggcgccgctcaccccgcccaacggcgacgtcggggtcgacggcatggtcatctcgctggcgtccatgatcgtcggcacggtcaccaacccgttcggcaacgggttctaccaggagggctcggctgacgcgccgctggaggccgcaacggcgtgcgccggcgtgtacggcaagggcgcgtaccccggctacgcgggctcgctgctggtggaccaggctagcggggccagcttcaatgccaacggggcccatgggaggaagtacctggtcccggcgctcgtggacccggacacgtcgtcgtgcgccacattggggtagatttcgctggtcgtaattaacggttgtgattgtgatgaggcggtggtgatggggtgtggagagtgttccacgcggctaaaatttgtactttgtagtagtgtccatggtggattctttcattggttcaatgaaaatgaaatattttcacgcacgtcctgttcgtatggttgtcgattttgcccacaaatatact

SEQ ID NO: 139 - DNA, 1554 bp, Sorghum bicolor
gcctcacataaacacatcaacacacaaagcacagctctctgagaagccactcgtttcctgctcgaatcaagcacagctctctgcgtttcgatcgatacatcagaaacggccacacgaaactgatcaagctaggcattagcattatcggcaatgggcgagttgatccctgggttgccggaggaggtggcgagggagtgcctcgtccgagtgggcttcgaccagctgccggtggtccgccgcatctcgcgccagtggaaggccgaggtggagtcgcctgactaccaccgccagcgccgggcggaggggctggcgcgcccggtgctcgcgctggtccaggcgcagccaacagcgccaccggctgacgacgctggtccggtggcggacaagcactcgacggcagcagcaggctcgggaggaggcccagcgaactcgtaccggatggtgttgctggacccggtggaaggacggtgggcgccgctgccgcccctgccagggccaagcgagagcctgcccctcttctgccaggtggccgccgtggacggcgggcaggggaggaggaagcggctggtggtggtcggcggctggcacccggagacgtgggcgccgacagacgcggtgttcgtgtacgacttcctgacgggcgcgtggcggcgcggcgcgcccatgccgggcccacgccggtccttcttcgcgtgcgcggccgtcggcggcgccgtgtacgtggccggcggccacgacgacgagaagaacgcgctccggtcggcgctggcctacgacccggaggccgacgcgtgggcgcagctcccggacatggcggaggagcgcgacgagccccgcgggctctgcgtcgccggaaggttcttcctcgtcgtcggcgggtacccgacgcaggcgcagggccggttcgttggctccgcggagtgcttcgacccggcgacgtccacctgggcgcccgtcgacgacctagtcgaggacggcgtgtgcccgaggacctgctgcgccgcgccgccagggtctggctctgagcgcctgtacatgctaagtcgcgatgggcacctcgtggcgcgcgacggcggcgcggcgtggcgaccggtggcgcaggtgcccgaggacgcgcgcaccgcggcgaccgtctccgtcatcccggacggccgcgtcgtggtcattgggtccgggtgccacggcggggatcagaccgtgtacgtgctccgcgaggaggccgggaaaggcgcgtcctggacgcgcgccgccgcaccgccggagttttccgggcacgtgcaggcctcctgcttccttgaaatctgaggtggaatgtacatgtacgtacatagtagacactacgtacttctgccactactactcatggctgtacatagcaaatcaagcagaggagcagtagtaggatctgtactgcaccgcactgtactagtgaagcatcaatggcagctctggatgccttcgttcgatcgcattttgttcggtccgatttgcaacttgggacgagctagaaactactactacctgataaggagataagtggtaccagtttcttgt

SEQ ID NO: 140 - DNA, 1425 bp, Sorghum bicolor
ggcctacaggcgtctcgccgcgagtcctcggcagcctcacgactcacgaggcgggctcggctttaccgggcggtgaacggcgcgcgtcgttcccgccactcgctgtccctgcctgactttcaaaaagggtggcgtgtcaccgcctggttactcacagttatagtagactcacagtcatagatccccgtggcggattccaagaacccaagtgaatcgcggctcgtcaagtccggcggtgccgtccagagagctagagcgctagagctagagcacagctatccccgccatggcggccgcggcgcgcgcgatcatctgcgagctggcgccgcagaaggtgtcgtcgtcgacggcgtcggggcccgtggcgccgaagaagcgcgacgccgggacgaaagtggtgctccagccccggctctgcacgctgcggtcgtacggcgccggcagcggcgtggtgacgcggaggattctggccggggaggaagacggaagcggagccgccgactcgggcggctccgcggcgtcaccgttcttcgcctcgctcgccgactacatcgagagctcccgcaagagccaggacttcgagaccatctccggccgcctcgccatgctggcgttcgcggcggcggtggccgtggagacgacgacgggcagctcgctgttcaagaagctggacacgatggagatcgaggaggcggcgggggtgtgcgtggcggtggtcgcctgcgccgcggcgttcgcgtgggcctccagcgcgcgcaacaggatcggtcagatgttcacgctgggctgcaacgccttcgtcgactccctcatcgacaacatcgtcgaggcgctcttctccgagggcgagctgcaggactggtccgacgacatataaacaagcacatatgcacacatatagagattagcagatagccagatactgtaatagacagtacgtatatacatatagtcaagtatttatagtaattaagtaggtgaagctgttaagtgagatccacgcatttctcgcaagcttcgttgatcgttgcaaaacggcaaggaagttgttctgaatctttcagagatggatcctgctcctgcaagggtgttctgtgatgagagagttctgcagtctgcgtaggaacacaggcaggatatctcgcagtagtcagggggttcttcatggttgtgaaatatgcaggtctcttgggagaaatagtgtgctggggaggattagccccttgaattaactgtacctactactagtactagacatataccaagtgtaattagagaatgaagcatgtaatcaaaactatgtactatgcataaagagtgtagttaggagtcaattaaatctggagtgttgactcttgacattatgccacatggagtggagatgaaaccctatacaccgtgcttctttttgtgtcccttgctcca

SEQ ID NO: 141 - DNA, 1523 bp, Sorghum bicolor
ggaacactccctggaggcctcgacgacaccccgcgtcgcggcgccgccgccgccgcctacgcctacgcctgcagcagcctgctgcgtccccggccagctccacggcgccatccgacctcgaatcgcctccctcgctcgccctcctgcttgatcccgccgtcgccacctcaaccgcccccacctccctctagggttgccctgccgctccctcgaatcgcgccatcggaggccttcccgaccgccctccacttttatcctgtgcagagcaaggtagcagacagatggcgccgcagtctcggttgctgccgccggcgttgcagatgcttcgccgctgccggtgccgtgcctcgcgctcccacttctctaccgcgcccactctcgtctcgccaccatccaaggccgtggtctacgacgagcacggcccacctgagcaggtgctgaggacggtggacgtgccaccggtggaggtcggcgaccgcgacgtctgcgtcaggatgctggctgcccccatcaacccctcggacatcaaccgcgtcgagggcgtctaccccgtcaggcccccgctccccgccgccatcggaggctacgagggcgtcggccaggtccacgccgtcggccccgccgtcaccgccccgctctcccccggcgactgggtcataccgtccccgccatcgttcgggacctggcagacgtacattgtcaaggatgagaacgtctggcacaaggtccgcagcgatgtacccatggagtatgctgccaccatcaccgtcaacccctcgaccgcgtttaggatgctccaagactttgtaaaactcaatcctggtgattccattgtccagaatggtgctaccagcatcgttggccagtgtgttattcagcttgctaaagtacatggaatccacactatcaacattataagggacaggcctgggtcagaggaagcaaaaaacaaactcaaacaacttggtgcagatgaggtgttcacagaatctcagctagacatgaagaatgtcaagagcttgctgggtgccatgccggagcctgcattaggatttaactgtgttggaggaaatgctgcttctctaatactcaagcttttgaagcaaggaggcaccatggtgacttatggtggaatgtccaagagacctgtcactgtccctacttcatatttcatttttaaggatctttcgctacgagggttctggctccagaagtggctgaactcagataaaacagaagactgcagaagaatgatagactacctcttgggccttgtgcatgaaggcaaactcaaatacgagatggagtcgatttctttcggtgagttcagcttggctctggagaaggccctgggcaaacatggaagccatccaaagcaagttatcaggttctgagacgagggtaggctagaggatcagagagcatgcaattgccattgattctgtatgaatgatgaatccaacagttggtatggcaattgtaagagtgacctggagttgtatataaaataaaataaagtaaag

SEQ ID NO: 142 - DNA, 3255 bp, Sorghum bicolor
ggggagtcgtcgtcgtcctcctgctccggccacggccaggcagccgagcagagaaaaaggagccgaaacagcaccaccgccgccgccgccgccgccgccgccacgcgcctctcttctcagcttgccatcctcccggcacccggccacaaataagagcaagatgccggcccctgtcgctgcctacccggccaagatggcatgctgtctccagctccaccttcttcgccgctcggcccctgctccactccctgctcgggtcctcctcctgctctccaccccgcgcctgcgcctgcgccccgtccgagcgtctcccggtcccggctcgtccccgcccaactccttcgctggctggtcctccgatagtgccgatgacggcgccgacaaatctactctagggttcggcccagcaggaggacttctaggacctggacttgctgcctttttcttcctcgccggccttacctttgctgccgtctccatcagaagcagtggcaaccacgcagctgcaaaaatgcaaaacttgcctgcagagactgctgccacggaatcttactctgattatcactcccacaaagaggatgatgctatcagtgtcagggaagaagatgcccaagcttccttaccaacggattgggaggaaaacaatgacagccttgatgaaacaaaaagtacagatgaattcctggcgcctcttctacagtcaaacgaggaggttcctggggtgcaagctgaacatgaagtggggcacccgttgcagaacactgaacctgttactaacggtaatcatcttgtcggtgaagaagtgcagcagtttgacaatctcattgcatccgatggtaatcaaaatccagcatcacctcctctgcccatctcatcagaatatgctcaggtttcttttgcaccatctagcacacttgatgctgcagacccctcggagggaattcctaacgtagaagaaacatcagatctcaaaatggctttgccagaaaacgagcatttggatgaaactttaacttcagatgcaatggtgctagattcagatggtgttgtgctcatccaagatatcgctgacagtgccgttgctgctgcatttcacccagaagacaaaggtgtcgagcagaacccacaaactcatgacaaagatgaattttctccatccggattgcctgattatatggaacatgtaagtgccgaagagatgcatccacttggatcaaatgagttatctatggctacagggactagtgagccaggagatggggaggaaactatagtagaagatctgtatgaaagagaaagtgaattagaaaaccaaaacaaaccattcaagtccacaccacctgaccaatatttttcttctcctggaattcctgccccatctatagtatccactgcttcacaggtgcccgtggggcagattgtggttccagcttctgttgacccaacccaggaaaatgctatagctgcactgcagattctaaaggtgatcgaacccagtgctcgagctggtgacttgtgtacccggcgcgagtatgctcgatggttggtagtcgcgagcaattgcctttcaaggaacactttctcgaaagtgtatccagcaatgtatattgataatgtcactgaacttgcatttgatgatgttacacctgaagatcctgatttccccttcatacaaggcctagcagaagctggattgatttctagcaagctttcaagatctgatatgaatatcccagaagatgttcatgacaatcatatcttgttttcccccgagagtcctttgtcacgtcaagaccttgtgagttggaaaatggttctggataggaggcaactgcctgaagttgacagaaattgtttgttcaaagtatctggctatatagacatcgataagataaacacagctgcctggccagctttggtcgctgacttaggtgctggagaccagagcattacagctctttccttcggtttcacaagacttttccaaccgaacaaacctgtgacgaagggacaagctgccctagcaatttcaactggtgattctggtgaagtggttctggaggaggttgctcgtattgaggcagagaaaatagctgaagcagctgtaaatgcacatggtgccttggttgctcaggttgagaaagatcttaatgcaaggtttgaaagggagcttaaggaggaaagagaaaaggtagagacccttgaaaaactagctgaagaagctaggatggagctggataggttgagggaagaaagagaggaagagaagaacattctgctcaggggcagagctgctgttgaatctgaaatggaagttctgttgaagttgaggagtgaagtagaggaacagctgcagaatgtactgagcaagaaggtggaggtctcctttgagaagagtaggattgaaaaactccaaaaggaaattgagaatgataacttggctgttgtgcaacttcaatatgagcttgaagtggagaggaaggcgctatctttggcaagggcttgggcagaggaggaagccaaaaaggcccgggagcatgcacgagcccttgaggatgcccggaaccaatgggagcgtcaaggaatcaaagttgttgttgaaggaggactccaggatgacgcttcagcaggagtcacatgggctaacgctggcaaagaacatccagttgatgaggttatcaaccgggcagaatctttgctggagaagctaaagtcaatgtcagctgagatgaaagtgcggtctcgtggtgcgctggagagggtgatgcaacacgtgaggtccttcattgcaagcctaaagcagcaagctgcagatgcaaggcagtggtgttccgagtttggggcttctgctgcttccaaggcactcatggtatcagcagaagtgcagggcagtgtatctgcgtttggtgcaacccttggagataagtcgaagagggtaatggaagagtgcaaggacggcctggaaaagttttcacacagattcaagacatcagactagagggaggctgtgtcgcctctgtaccaagaacaatagtaaattcccttggaataaatttttggggtggtgggtgttacagagtttactgaagtcatgctggaacgaacagtagttcccgtggaataagtccgtgctgtgtacagacaggattgatgaatcctcatacaggcaggatgagctgccgcttcttgttattagtattgttacgatgatgacttgaggtgaaggcttcaaaggcactgaagcattataggtcc

SEQ ID NO: 143 - DNA, 2129 bp, Sorghum bicolor
tgtttccgtccccctgctctgacttctctgcttcgccgatcccctcccccaactgccagactccccgccgtccgtccaccgctcgccgccatccagtcgtcggtgcagccgtagcacgcatcctcccggttggagccgtgtccagtccagttcctttgcgaaacgaaacgaggtactgggagctggagcgaggacgaggagacgagggaaaggatgcagcagctgcaaccgaagcagatgcactgggtgagggccgactcctccgacttcgggttcgggggcgaccgccccgccccccgcagcgggcacactgcggtgagcattggcaagtccaaggtggtcgtcttcggcggattcgccgacaagcgcttcctcgctgacgtatccgtctatgacgtcgagaataagctgtggtacactcctgagtgcactggtaatgggtcggatgggcaggccggcccaagcccaagggcatttcacatagctgttgtcattgactgcaacatgttcatctttggtggccgttctgggggcaagcgtttaggtgatttctggatgctagacactgacttatggcaatggtcggagatgactggctttggtgatttgccgtcaccacgagagtttgctgctgcttcagccataggaaacagaaagattgttatgtatggtggatgggatggcaaaaagtggctttcagatgtatacgtcatggacacaatgtcactagagtggaccgaattagctgttactggatctgtgccacctccaagatgtgggcattccgcaaccatgattgagaagagactgcttatatttggaggcagaggtggagcagggccaataatgggtgatttatgggctttaaagggtattactgaagaagacaatgagacgccaggttggacacagttgaaacttccagggcaatcaccctcaccacgatgcggtcattcagtaacatctggtggaccttatctcttgctgtttggaggacatggaactggcggttggctaagtagatatgacgtgtactacaatgaatgcattattttagacagggtgtctgttcaatggaagcgcctaccaacaagcaatgaacctcctccacctcgggcatatcattccatgacttccatagggtctcgatttcttttatttggtggctttgatggaaagaatacatttggtgatttgtggtggcttgttcctgaagatgatcctattgcgaaacggaacatagttcttaacatcgattcaaacagcaaacctagcactgtgaccggtgataaccagcaatccaacttaaaggagtcacaagctctggagaatccagtaacagaattggccaaacgaatgggaattccactttctgaggaagtttcggcaagttttattgacgaagtcaatgataaagaacttgcggaattgtcatccaggcttgctggtcaatcgcttccagctactgaccaggttgcatcaattcaggtacttcgtgatcattggaaaagttctccagcaagctcactacaactgcaggaactaggacctttgctgagggactatcaacgtctcatcctgcagcgctattcgggaaatccattgccagcttttcatgaaatggaagctctccgttttttccatttgaaaagtgcttcacagttgcgcatggatgacattcccgtcttgttgagcgagtatggaaggctgctttccacatgagatggcatcttgcaagttgtgcccttttgcttggttctaacagaacgtttgcttcatgtaaattgcggaggattttctggcctgccaaaagcacactcgtggagccattccttgccatcagttagtctgttagtgcaagtcattgtcgcatcagtgatagcgcaccgaactgaattcctttttctttcgaggactgggacgcgcacatatttcgtgcagcctggctgggcactgaatggccatcaacacgtggagctgaggcggcgtggcaagccgcccattccaagaaaacgggtttgtgtgaggttggagttggaggtcacgtcacatgttttcagttttcattctcctgcgcaacatcttaccaaaaggacgctgcattgcattttactattactacctttgtt

SEQ ID NO: 144 - DNA, 639 bp, Sorghum bicolor
gctcaatgccagcgctctattctatataaaccgtggctcttgttcccatctattccatcccatcctgtgagtagccgtacgtatagcaatctcagagcgagcgggcgtggttcagcttaattcgggtgaaggggatggcgctgtcgtctcgccgcatggccgccgctcccgtcctcgtccttgtgctcctcctcgtcgccacagagctggggacgactccggtggcggaggcgaggcactgcctgtcgcagagccaccggttcaaaggcctgtgcatgagcagcaccaactgcgccaacgtgtgccagaccgagaacttccccggcggcgagtgcaaggccgagggcgccacgcgcaagtgcttctgcaagaagatctgctagctagtgctagccttggcggacaggggcaggtccggtcgtcggcatgcaattcaaagctagccgacggcggcgaccactgttgtcagtcgttggtccgctcccagcgttgctgtttttgtttactaccgttgtttctcttcctgctgtgctgcgctgttacgttgtagcacgcgcgtcgctgtgttcggcctgttgcttcctttcgatctgttcccgcgaataaactccgggccatgcatgtcccgggatatgataa

SEQ ID NO: 145 - DNA, 2418 bp, Sorghum bicolor
gaaagctgtaagcgaaaggtttctgtcggctgctgaaaagttgattcatcagtcaatttccaaggtggttctgcatacgcagtatcttttgcagtaatcttgatctgcgagcggccagaactggatgatggctacttattactcgagccagggcagtgaaagggactcacagaacatgtattctagagaacccagcaatgcatcctatcctatgtcgtcggctctagggaacttgctttatctgaacaatcctgcttctggaccatacacagagttcagtggcattctacagtcccagcagaattgcatggagatgcctgaacctggccatccttcagtgatgtcccaagactcatctgcaagggagtccgacatgcttggttcccaccagggtcagcgctctttcggcctagtcaaagatatgaagaacgagatgttgatgcatatgatggatgggtcacagagcagtacagctgatctcatccatgatgatgcccaaaatggtatccagcttgattttggtgttctgaacaaccacggctcgtcgaacattccctcagtgcaaggccaaggtttatctctcagcctcaacacacaaatcctggcaccttccttgccatactggtctgtcaaaccagatatgttgtcgccacactcttaccatgacagtcttcgagtcgatgacatccgaatgaagagtatgcagtctgagtcctcacgagcaatccggaactcaaggtatctgaaagcagcacaagagctgcttgatgaagttgtgaacgtttggaagaacattaagcagaaagcccagaaagaacaggtagaagcaggaaagacggatggcaaagagaccgagggagggccgaaaagtgagggtgtgtcctctaatccgcaggaatctggtgccaatgcagcaccggagctttctactgctgagaagcaagagcttcagaacaagatggcaaagctgatggcaatgttggatgaggtggaccggaaatacaagcactactaccatcaaatgcagagtgttgtttcgtcttttgatatggtagctgggcctggagctgccaagccttacactgcagttgctctccagacaatctcacgacacttccggtgcctgaaggatgctatcaatgatcagatcaatgtcatcaggaagaagctcggggaggaggaaagttcatctggcaaggagggcaaactaactcgtctccggtacatcgatcaacagctcaggcaacaacgagctttccaacagtatggcatgatcccacaaaatgcttggaggccacagagagggcttcctgaaaactctgttaccattcttcgtgcttggctctttgagcatttccttcacccgtaccctaaagattctgaaaaattgatgctagcaaggcaaacaggcttgacaaggagccagatttcaaactggttcatcaacgcccgtgtccgtctctggaaaccgatgatcgaggacatgtacaaagaagagattggagatatcgagcaagactccaactcttcctccgacaacacgccaagaagcaagggcaagatggtatcttctgaagacaaggaagacccgaggagttgtacgcctcgggtctgcgagagcagtcagctgagcgagtcaagaggcagcatgaggaccatgaacgccgtcggcggtggagcagccatgggattccagaacgagcccaaccctgacgacaccttcatgaacctgatgctgaaggaccaacgatcaaacggagaagaagatggcggcctcctcctccacaatgccgtggcgcagcatcaagatgagaacgcccggttcatggcgtaccacctggcggaacttgggaggtacgggaacggcaatgtgtcgctcaccctggggctgcagcactccagcagcagcagcctctcggttcccaacgcccagcagagctttcctggtgtcggtgtcggtgtcggagacgatgacatctacaacgccgccgccgctcccctcggtgtcagcgtggcgtcgtcggactacgagacgatgaaccagatggatcaacggcaacggttcgagcagtcaccccttctgcatgattttgtggcctgaagaatgctcatttgctcatacatcagatgatttgtatttagcacctgccggccggccgcccgcccaggtgaataacatatatatgtgcctgaaaaggagcattgttgggttgtagcctgtagtttcaattggatacagatttggaggtatagcaggaaatgtaatatagtgtaggtggttggggtgatagggtaaaaaaaaaagggatcttgtaaagatgaaacacactatactatacgtgtaaaagcttgtgatttggggtcaccatactgtaaagtaatggcttcttagggtccaggaatatattggtatatatg

SEQ ID NO: 146 - DNA, 1632 bp, Sorghum bicolor
cccacttgcagccgcgcgcggcaccaccagtccaccactagctagcctagccacccagttgccgtagttttacgcgtgaacgcacgcgcgcatctgccaaaacccacgtccctcccggccaccgcgcgcgtgcctcgtcgtcggcacgccggcgcgtgcaatcgatctactcccagccgcccaagttcgtggactgggtagtagtagcagctaggggttgtcggcaggcatccttatgaggcgcttcctgccggccggaggcggcggcggcggcggcggggagccgtcgtcttcctcctcctcgggcgggcaacaccagcacggcggcgggctcgcgggcgagagggcggcggcgggcctgcggtaccgaggaggcgacatctcgctggggcacgggcacgacgacggacatcgtcgtcatcagtaccacctcggcgccggcgacgcggcggataggcagaacgacgggtccatggacatgctggcgcggcacagcagctcgccggtcggcttcttctccaacctcgtcatggacaacgggtacccacgctcaaataaagccggagtcagtggtggcggcgaaggtcagcgtgatccttcaacggccaacaacaatagtggaagtagcagcagcggccggaagatgaagccgtcgtcgtccgggttcaacttcgccggcgggacgcagcagcagggccagcagcagggcgccgccgggggccacctctcgcggatctccgaggacggctgcgccagcttcccggccggcggcctggtgggcgaccgcgctgcaggtggccgcggctctggcgagagcagcagcggtggtgctgccgcggcggcgcgctcgtactccggcgggttctccattgttgggccgtgggaagagtccagggacatcattaccaccctcggcgcatacgaccctcagtttagcggcgccatggcgggtacggcgctggagatggcgggcatggacaggtacatgcagctgcagcaggaccaggtgccgttcaaagtgcgcgccaagcgcgggtgcgccacgcaccccaggagcatcgccgagagggagaggaggacgaggatcagcgagaagctcaggaagctccaggacctcgtgcccaacatggacaagcaaacgagcaccgcggacatgttggaccttgcagtcgagcacatcaagggcctgcagagcgaactgcaggctctgaaacacgagcaggagaagtgcacctgctgccgaaagcgatagcgattcacaacagggagggcatagaacacagaaacgcgtccatctttaacggttactgctaccttcaatttccttgatgtgaggaattgtacatggatgaagccatctacatatcttgattgtcgagtccttgttgagagtcctaattttagtgattattagcacacaatgggagtgcactcggcgcggcccatggatggagcgtgcatatgcaattttgcgtgcatagctaccatttccaaagcagtgagatccacatatagtcatgcatggacatctagctaggcaggcagtgccaaaataggcaacccttctgttctgatactttggtttcttcggtttgttgatgttcaacttgaattttagatttccttttagga

SEQ ID NO: 147 - DNA, 1838 bp, Sorghum bicolor
gcacacaggcacactctgctccaagaagctactagcaaccatagccatggagatggtcctggactggcgctcgctgggctccctgctagcgaccgtcgtggtgttccgcacggcgctgcgcgacttcctgccgccggaggccgaggcgctgctgcgtcgcttcatcgcgtgggtcgccgccgcgttccgcccgccccgcgacaccatcctcatcgacgaggcggacgggccaacggggggcgccaacgacctctacgactcggcgcagctctacctgggcgcgcgctgcctcgccaccgcgccgacggtccgcctccacaagccgcgccagtcgccgcgccccgtcgcgtcgctcccggactcgcacaccacccacgacaccttccgcggggtccaagtcaagtggacctccaccgcgcgcgccgtcgaccgcggctccggcggcggaggcgggggtgggtacggtaacccgtacaacatgttcggccgcggcggccatggcggcgaccagcgcggcctcgagctccagttcccgcgccagcaccgggacctcatccaccaccactacatcccgcacctcatcgacgaggccacccggatgcggctcaagtcgcgggagcgacggctctacaccaaccgcgccacggggcccggcgacgaccaccaccgcctctggacgtcgcacgccttctcgcacccgtccacgttcgacacgctcgcgctcgacccgacgctccgcgaggagatccgcgccgacctgctgcgcttcgccgcgcgacgggaccactacgcgcgcgtcggccgagcatggaagcgcgggtacctgctccacggcccgccgggcacgggcaagaccagcctcgtcgccgccatcgccaacctgctcgagttcgacgtctatgacctggagctcaccacggtgcccaccaactcacacctccgccgcctgctcgtctccaccacgcccaagtccgtcgtcgtcgtcgaggacatcgactgctccctcgacctctccgaccgcaacaagaagaaaaagaagggcggtcttggcgccgggggcaacggcggtgccgacaacgacgaagacgccgcggcgcagctcgccgtcatgtcgatgtcgccggccgccgccgcggccatggccgtaatggggcgggaatccataagcctctccggggtgctcaacttcgtggacggcctctggtcgtcctgcgtcggcgagcgcctgatggtgttcacgaccaaccacccggagcgcctggaccgggcgctgctccgcccgggccgcatggacaaaaagattgagctcggctactgcacgccacccgcgctgcgcgtgctcgccaagaactacctcggcgtcggcgacgagggctgcgaggacgccgatgaggaccccgacaccgtgaacaccctcatggccgaggccgagggcctgctcgcccccgacgaggtacaaatcacgcccgccgacatcgccgaggtgttcatgggctgtgacggcgctggtgccgccgccgggctgaggaagcttgtgggcgagctgcaccggaggcgggatgctgccgcggccacggccgtagtagcaccgggtgaggagacgccggagtgaaagccagccagggatcctacgtggcgcgcaaccatgcatggctgcctagtcagcttccattactttgacgccttgacggtggtttgtttatgagtcgtgacggtgcccctctattgtagtacgcatggagtttgcctttttttttttcgtttctgtattgtaactttgtaagtacgtatggagcccggagttattattattaggaaataatggacgttgattaccc

SEQ ID NO: 148 - DNA, 1206 bp, Sorghum bicolor
ccacgatactgacgccgccacgccatcggcatgggcggagccgcacgagttctaccacgtcctattgcccaccaccacttccaccagtctgcctctcttccctatctccacgctgccgcacctgtcgccgcctcctccgctctctttgccccacgccccactccgagcccgagcgtccgcgtctcccgcccgcgccgccacgccgcgatgtccgccgccgcagccgactcctcctcctcttcctccatcggaataccgcgtgatgcggcggttagctcgctctcgcccgagagcgtcagcaacaacgatctgctcatcgttgggccgggcgtgctcggccggatcgtcgccgagatgtggaaacaggaatatccaggttgcaaggtttgtggccagactgcaaccacagatcatcacagtgaattaactgacattggtatcattccctccttgaagaggtccgtagcgggtcccaaatttccaaatgttattttctgtgctccaccatatcgttctgaggattatgctggagatctgagaatagcagcttcgaattggaatggagaaggttctttcctattcacctcgagtactgctgtgtatgactgcagtgacaatggattctgcggtgaggattctccttgtgtatcgattggtcagagccctcgtactgatgtgcttctaaaagctgaaaatgttgtccttgaggcagggggctgtgttcttaggctagcaggactttacaaatcagatcgaggtcctcatgtctattggttgtcaaaaggaaccttggatgtgcgtcctgatcatatactcaatctgatacattatgaagatgcagcctctcttgcaattgccatcatgaaaaagagattacggagccgcatctttgtgggctgtgacaatgagcctctgtccaggctagagattatggaccgtgtcaacagaagcgggaaatttgagacacagtttcagggcttcactgggactgatggtccgctggggaagaggatggagaactccaaaactcgggcagagctcggatggcagcccaagtatccgagctttacagagttccttggtctcagcaatctctaactttcatgcgttgtcgctaaatacttgtgattaaagatgaatatactggtacatgaaagaaacaatgacaaatttgaagtggaatgttggttcctcatactacagggt

SEQ ID NO: 149 - DNA, 1631 bp, Sorghum bicolor
aatttccagagctctcgcgcgcgcggcgtcatggcggagcgcctcgccgcctccctcctccccgccgcctcgccgtccccgtccgcccgccgcgcgacggtcgcagccgcggccgccgcctctttcccctccccatgctccgcgcgcgcggggctgcgcctacgctcccgccagcccctcctctcgcactcgcagaaggcggccgggcgcgggcgtggcgtgcgggtggtccggtgcatggcggcgtcggacgcggcgcagctcaaggccgcgcaggaggacatcaaggagctccttaagaccacatactgccaccccatcctggtccgtctggggtggcatgattctggtacctatgacaagaatattgaggagtggccacaacgaggtggagctgatggaagcttaaggttcgatgctgagttgagtcatggagccaatgctggtctgattaatgcattgaagcttatccaacctatcaaggacaaatacccaggtatcacttatgcagatttgttccagttagcgagtgctacggcaatagaggaagctggtggcccgaaaattccaatgaaatatgggcgggttgatgtcacagcagctgagcagtgtccacctgaagggaggcttcctgacgctggcccacgtgatccggctgaacaccttagggaggtattctatagaatgggccttgatgacaaggaaattgttgcactatctggagcacatacacttggaagatcaaggcctgaccggagtggctggggaaaaccagaaacaaaatataccaaggatgggcctggtgagcctggagggcaatcatggacagttgagtggttgaagtttgataacagttacttcaaggacatgaagtttttgagccaacttccctcggaagagcagaaggaacaggatcttctagttttgcccacagatgctgcattatttgaggacccatcattcaaggtatacgcggaaaagtacgcagaggaccaggaagcgtttttcaaagactatgctgaagctcatgctaagctgagcgatcttggttcaaagtttgatcctcctgagggattctcactggacgatgacatgagcactgcacctgcagacgaaaagacggaagaagatatctcttttgtagcagtggcaccgtcaccagtggctccagaacctgaaccagcagcagaacctacaccagaaccagtagcagcggcaataacaacagcgacagccgatgacaacaacggcgcagctccacagccggagcccttcgtcgctgccaaatactcgtatggaaagagggagctgtcagagtcgatgaagcaaaagatcagagcagagtacgaggggttcggaggcagcccggacaagcccatgcagtccaactacttcctcaacatcatgatcctgatcgcagggctggcgttcttgacgtctctggtcgggaactgagtgcgatatcatcgattcctgaagcctacgactgtccatattttgcaaactccgtaagcatatgaaacatatataaacggcatgcgaccaagtggctagcatcagagctacgtacactgtgtaaacagtttttcacatagcaagtgtttgagaaatagtgacctgactatcagcac

SEQ ID NO: 150 - DNA, 3421 bp, Sorghum bicolor
cgacgccttggccttatcctcctccctccgacgaggcggccagggctcagttaaacccgccttctccctccactcccgccccaccttcgccacgcaaatgctcctctcattctccccgcacccttcccctctcctcctctccttaccctcctcgactcccgcctgcaaaccccacgcccgcctccgccccgtccacgcctccgcctcggcgcccccctcgccggagctgctcggcaagtccgcgctccgccgcatctccgagaagctacgtagcctcggctacctcgagaccggctccgagacccccactccggcccccaacaagagcggggacgccccctcccccggcgagatattcgtgcccaccccggcccagctcccgcgccaccgcgtcggctccaccatcgacccgagctgggccacgggcgacggcgaggccggctccgcggcgcggcagcggaggaggggccgcgggcgggatgcgtcggggtcagcagcttcggcgccgccgtccgcggcggagctggcgctgccgcgggacgagctgcggcggctgcaggggatcgggatcagggtgaggaagcggcttaaggtggggaaggcgggtatcaccgaggggatcgtaaatgggatacacgagcggtggcggaacgcggaagtcgtgaagctcaggtgcgaggacgtctgggccatgaacatgaggcgcacacacgagattctcgagaggaaaactggaggcttagtcatttggagatctgggagtaccatcatattgtacagaggaaccaactataagtatccttacttccattacagtgaaagggtggatagttttcttgacaaagaatcatcagatctgagcagttctggggacgaggatgaggaggatgagactagttcacaacatgatagcagtcacgaggaaagtagtgagaatcctgttgtagcatgcacagaacagattaatgctggagaggggaagagtcagactgtaggatatttgaatcagagcttaagtagagagaaagatacaactcacccgatatcatctaccaaacggcttgtttttgatacaaatgagggaaatttagatattagaactggagctccaaacgaacagcatgcgagattgcaggaaaacactcgtgctgatcgtcctagtaaatttggtcctagagaacgctcatccttagtggctggtgttggatctccaaataagtttcgattacagttgcctggggaggtcaaacttgcagaggaagcagataaattactggatgggttgggcccaaggttttctggctggtgggggtatgatccccttccggtggatgctgatttgttgccagctattgtgccaggataccgtaggccttttcgcctacttccttcaggtgttccgcctaagctaacagacagggaaatgactattcttaggagactagctcatcccttacccttccactacgcactcggaagaagcagcaaccttcaaggattggctgcatccatgatcaagctatgggaaagatgcgaggtagcaaagattgcactcaagagagatgcacacaacactgacagtgagctcataactgaagaaataaaggacttgacaggtggaaccctattatcaagggataaggagtcaattgtattctacagagggaaagatttcctccccccggctgtctctctggcaatagaaaaacgcagaaagctgggcagttctacaatctacaagccgaagcctgacattgaagaaaacatgcctactcaagatgactctgtactgaaggtatcaaatgatgtctcagtacacattcgtgaagagggaacttctgtcacagaggttagagcaaaatctcttaatactgttgcgaagaatgttgaggccagattatctcaggccatagcagagaaagagagagctgaaaaacttcttgaagaactagaaaaggcatctccgctttcaaaggctgaagttagagagactatatcagaagatgagaggtacatgttaaggaaagttggattgaagatgaaacaatttctgctgctagggaggaggggagtttttgatggaactattgaaaatatgcatcttcattggaagtatcgagaacttgtcaagattatatgtaaagaacaccgccttgaggatgtggaatatgctgctcgaactctagaggcagagagtggtggtattttggtggcagtggaaaaagtgagcaaagggcatgctataatagtatatagaggaaagaactaccagaggccatcaaaactcaggccaaaaactttgttgagtaaaagagatgctttgaagcgttctgtggaaaaccaacgttgtaagtcccttaaggttcatgtgcttaagctgtcaaagaacattgactacttgaaggatcagatgaattccagctactatcacaaggacatgcatgatcctagtgtcaactctggaacactacagcagcatgacgaagaagtgcctgaagttgctcccatgagttcagagcctgaggttgagtgtgcttcagttgagatggatagagccttaaatttaacaaagtctggagtccctgtggaagatatgcagagcaaagtctgtttcgacaagctagaagatgattcttctgcggctgcaggtccatgtctgactgggagttcaagtgcttcactcagcaatctgatcagacatcaaaaccaacatagctctactgtgacattcagtcctgatagtcactgtgaaaatgattcaaaagatgtggatgggataaaattggatgtggaatcttcttctgtattgcctttgagaggtacaccactctcaaatcaagaaagacttgtgctaaggaagcaggcccttaaaatgaagaaacgaccggtactttccatagggaggaataatgtcatcactggagttgcaaaaacaataaaaacacacttcaagaagcatccccttgctattgtgaacattaagaacagagcggatggaactccaattcagcagctgatatcagaactagaggaggcgacaggatcggttctagtgtcacgagaaacaaacaaagtgattttgtacagaggttggggtgcagaagtggcccaggaaagctcaaaggagagcagcgcagatgaaggcgaaaaggaggtcatatcacctcagctccttgaagctatcaggttagagtgtggattgctccctggcgactcagagtagctgatccggatagcctcccagcgcatcctgtgttttaaaaggatcgtacaatcattgcccgcggataaatggaccatactcataattctgggcatgtatatgcagtgaggcactgaagctgcatagacgcaaggtgtggaaccctgctcactggaatagttgtaacttgtaagaaagcagaaatgagcttgctttagc

SEQ ID NO: 151 - DNA, 2260 bp, Sorghum bicolor
agaaaaaaaaaatcccacccgcttgccgtctccccgcgtccccaagccgagctctcgctttcggcgttgctctctctcctcggtcctcgcccccgcccgcgtcttccagggcgcccatgagctgaggccgccgccgatggggccgccccacgccgcgcaggaccccgtgccgtcgccgtcgccgtcggacggcagcggctccggctcctccaggcgccgcctccgccggctcgaccgccgcaacgcgtccaagcacatcggctacacagcccccaactactgccagtacccgccgtccccgcagcccgccgcctccgcgccggggtccgggccggcctcgctcgccgcctccgtcgcctgctccctcgacctcgtcaacagcttccgcatcggcggcagcggcgacgggggcggggacctccgcttcctgtgcgagagcctcggcctctccgggcccgacgacttcgccatcccgctggccgactgggaggcgcacaaggccgttcgctcctccgcctccgcttcgagctccccctcctccgcacgccccaaccacgactcccctcagcgggactcaccgctctgtcaggtgggtgccgaggagcccgcccaggctgcggacgccgacccggagctaccggccgcaacggggagggacggcccaatcgaagctccggagcggccggcacgcctggatccgccgcccgagtccacctgtccggatgcgaggagggcagctggggagggaggaatcaagggcgtgcgcccgccgccggtgctcaagccgccgccttcgatggcgctgccagctgtctgcggggtgggatccacgtgggatatcttgcggtcgttcgcgccggatgagaaagaggacgcccccgcgagcagatctgaccgtcgttttggacaccgggatgcagtggagaaggatgacgacgagaatgcggcggtattgttaaatttggacgatcttgggctggaggagtcgtctgagggcttcactggcacttcttcactatcaacgaccaacgatgacgagacctcaagcaccaccacagaatccatgttctatatctcgccgaatgggaggtttaggaggaggatccggtcatggagccgaggggtgctcctgggtagtggctcgtttgggacagtctacgagggcatcagtgatgagggtgtcttctttgctgtcaaagaagtaaacttatttgatcaagggagcaatgcgaagcagtgtatcattcagcttgagcaggaaattgcacttctgagccagtttgagcatgagaatatagtgcagtactatggaacagacaaagaagattcgaagctttacatctttcttgaattagtgacccaaggatcccttgcatcattgtatcagaaatatcgcctgcgtgatactcatgtctctgcatatacaagacagatccttaatgggttgatttacctccatgaaaggaacattgttcatagagacattaaatgcgcaaatattctggtgcatgccaatggatctgtgaaacttgcagattttggactcgctaaggagattaccaaattcaatgcagttaaatcatgcaaaggaactgtttattggatggcacctgaggttgtcaatccaaagaagacgtatggacctgcagctgacatatggagtcttggttgcaccgtcctagagatgttgacacgccgaataccctatcctgacctcgaatggacacaagctctatacaggattggtaagggggaatcaccagcaattccaaatgctctttcaaaggatgctcgtgattttataagccagtgcgtaaaatccaatccagaagacagaccatcagcatccaaactgttggagcatccatttgtaaacaagtcaataagatcagtacggtctatgaggacgatatcttcacgatcaaattcatctacacgtggcatcaattaatgggtcgttgattatctattggacagtggcagaatgatattggtccgcgcaaatcatgcggagctagccgaaagggagtgttgttttgcctggagctagtattgtcaacgctcaacagcattgtcgtgtcgtcaacctcttagtgtttcattagttgattctttggcatacgttcgcgaggaagatgtcctcgtttgagccgccggctaatattcttctgcctggatagagaatagtgaatgtgcatttgagcgcatgagttgtagagtgagaacggggtgtgtaaatagattgtcttgatgccaatga

SEQ ID NO: 152 - DNA, 1631 bp, Sorghum bicolor
tttcgcctcctccggtccgctccgctcctccctcccctccccttccctacaaaagccgcgagaagcggcggggacgaggaggagaccggccgaccgctcgagtgcccgacccccccttacccctattgcgcttgccgcttggggccccccctcccgttcggcgcattcgcgttccgcacccgcaaggaggccggagcagcagccatgggcgtggaggaggcggggcgcgccgccaccggcaagaagctggcgctggcgagcatcggcttcgcggacgtccgcgtgggcgccgccgtgcccgggggtgccggcgtgtacaaggacggcttgctcgtcgtgggcctgcccgtgcccaaggacgacggcctcgacgccgccgcccgcgtcgtcggggacctcgccgccaggctgcccgacgttggcgccgccgctaggacttttctgaggaatagagaagtcgcagaattcgtgagtggagcattggctggtgcaatgactaaggctgttcttgctcccttagaaactatcaggacaagaatggttgtaggtgtaggatcaaaacatatttttggtagctttgtggagattgttgaacataatggctggcaaggactctgggcaggtaatacaataaatatgctccggattatcccaactcaagcaattgagctcgggacatttgaatgtgtcaaaaggactatggcatcagcacaagagaaatggaaagaggatggatgcccaaagatacaacttggcaatttgaaaattgagctgccatttcacttactatcgccaattgcaattggaggtgcggcagctggaatagctagcactttagtgtgccatcctcttgaggttcttaaggatcgcatgactgttaatcgtcaggcttatcctagtattgccattgccatcaacaagatctaccggactgatggacttggtggtctttatgctggcctctgcccaacgttggttggcatgcttccatatagcacatgctactatttcatgtacgagaccatcaagacttcctactgccgtgcacataaaaagaaatctttgaaccgtcctgagctgctgatcattggggctctttcaggtctaactgcaagcacaatcagcttccctctagaagtggcaagaaagcggctaatggtgggatccctacaagggaagtgcccaccccacatgattgcagcattagctgaggtggtccaagaggagggcgtcaagggtcttttccgaggatgggcggcgagctccctgaaggtcatgccgacgtctggtgtcacctggatgttttatgaggcatggaaggagcttcttttgggttcacggctccatgcctaagcaggaacctgacgaagtcaggctcttgcattgttacagaataaatttgttgtgctgtgtgggattttcaacatttttttctccttaaaaaatcccacacatgccaaccatttaggagagaagaaggccatcttgtgctggttgcactcatgattagcagtattagtcaattggcctttgctaacctggattatctaactactagcaactctgagcagagtcaacccggactgggtatgcattggccccaggcattgttattgtgaaatttgtctact

SEQ ID NO: 153 - DNA, 947 bp, Sorghum bicolor
cctccactaaacaagacctcactgtgttggccgcaacggcaacagtagtaccccgcccgctctataaatacccccgacgacagggaatacggagctagcaacaatcactgcagtacacagcacatttccaaagttgtagttcatcaaacgtagcggctaggtgtagcgctatatatagctccatctgctgcgacgacatggcgggcaccaccaggaggagcaggaagtcgtcgtcgtcgagctcatcggcgcagcagcagctggctgccggcgcgctgcttgtggccgttgtcgtgttggtggcggcgtcgtcgtcgggcgtgctggtggcggtggaggcggtgtgcgacatgagcaacgagcagttcatgtcgtgccagccggcggcggcgaagacgacggacccgccggcggcgccgtcgcaggcgtgctgcgaggcgctggcgggcgcggacctcaagtgcctgtgcggctacaaggactcgccgtggatgagcgtgtacaacatcgaccccaagcgcgccatggagctccccgccaagtgcggcctcgccacgccacccaactgctagccatgctaataataagctaagcaagggcgctggcctggctagcattgccctacgttgtactacgtgtgttgttgcattatatatatttattattactgtgtgtacatctgcagcaggaggggcccggccgtacgtacgtgccacatcgatcttgtcacgtactaacatgcatatgttcttgtgtgctccgtgctggcgtgtgtgtgtgtgtgtgtgtgtcgtcgttggtacatcttgtcacgtactaacatgcccgtggttggtttgttggactgtttgtgcgtacgcgcgcatgtgtgtgatgtgtacttcggtagtgtgggtgactgcctggcaaaagttgcatcttgtgccctctcgctcgctcgatctctc

SEQ ID NO: 154 - DNA, 1110 bp, Sorghum bicolor
cacggccggccagccaaaagcccaaaacacaccccagtccccagaggcccagaccacgagccaggacagccgcgtgcgtcgaggcgagccgacgcccccgcccccccccccccccccccccccccgcctcggttcctccgatccacgcgcccgcccgcccgcctgcctgcctcccggatccgccgcgatgggcagcctcggcgccgacgcggagccgcagggcgcgaggcggcggccgcggttcctgtgcctgcacgggttccgcaccagcgccgagatcatgcgcaagcaggtgctcggcaagtggcccgccgacgtcacggcgcgcctcgacctcgtcttcgccgacgcgccgttccccgccgagggcaagtccgacgtcgacggcatcttcgacccgccctactacgagtggttccagttcgacaagagttttatggagtacaggaatttcgacaagtgcctggcctacatcgaagagctgatgataagagatggccccttcgatggattgatgggtttctcccagggttcctacctatctgcggcgcttcccgggctccaagaacaggggcttgccctgactagagttcccaagatcaagtacctcatcatcatcggtggcggcaagttccagtccccgacggttgcagagaaggcgtacgccaacaaggtggcatgcccctcgcttcacttcattggtgacaacgacttcttgaaagtccatggtgaaaagctcatagaatcattcgtggacccattcctcattcgtcacccaaagggccacacagttccaaggctcgatgacgagagcctagcggtcatgctccgtttccttgagaagattgagggggaagtacttgagtattcatccaaagataagattgagggggaggtacttgagtattcatccaaagatgtcaacgaaaatgaggaagtgtgcttgtgataaagactttatagaccattagtatctgatgttggcgaaaaagctatacttgtatttatttatttatagaataaacatacgataccttgatataaacatacgatacctcgattttcatgaggcatggattatgagaatgtagattaatcattgtgtactta

SEQ ID NO: 155 - DNA, 2422 bp, Sorghum bicolor
tagctctggtggggaatcaatcagaagaactgaagactttacactagcacagtctgctcatcaagagccttggcagaatgaggtggcttggtctttccgttgatgtgttccgcagggggatctccttgaacctttactgccgtgtgattctgtaaatcgtctccccggctaccggagaccttccttccttcgcacgcctcctgatttataggcttgtgaaggcaccccccacccggttgttggcgttgctgttaggccgttgtggttgtttggccaaagcttttgaggagaacggagtggagtactaatggtgtggaaagcagctgctcagccgagattccgcgtgtttaagcatgagaacggaatcacagtgagagtaattgcttgcttccagctgctgcaaaattgccaggccgagtacttccgtcatctcctcaagcctgtgacgtagcttctctctctgctctccatctgctgctgaataagcttgctgctttaggttcttctccattacaattgaagtgggagaacttcccattcatctgaaatttctgctggtagttctgtccggtagttgtttcatttgttcatgggggacaaggttaatccctggtgccattggcataatcctccatggaaattcaacactgaaggttctggcggcaatctccgcccacctgatgttgggcttgttaacaccaattcggtggcattgcctgcatatctgaacacagttgctgcacctgtgccatttttcacagcatcaattgctgagagacctctttcaatagctccaagatatgccacaacattggcaccaagtttggagttgcctgcactgtatccctcacgtaagagacctctagttttctaccagaaggaaaaccatgctcctagtgcagctcctttgctgagcaaagggccactggatcctgtgccagagctccaaggtagcaacgagactaatgtaactgatgttggagcagaagaaactgagggtattcatgagaactcagatgagatcaatgcactcctggactctgactcagatgaagggtatgaaaaactgcaagaactcgacagagtcagaaggcaatctgctgcagagaatgacaccctgagcgttgagtcagtgggcagtgctggtgctgccgcaggttctgcaccaccagccaagaagagaagactcagctcctgtactgacaagtctgttgttgacactgccagttcagcaaggcctgatcattccatcgagcagaagcttcttgtgaacgactgtgatgcgcagtcatgctgcgtcggtgaagtggaaagtgaccacaagttttctctgggggaggtagaagcagcagaaggtgacagccccgatgatcagaagcgaagaagagagaggatccaagagactgttgctgcgctcaggaatattgtccctgggggcattgccaaagacgccactgctgttcttgatgaagcaatctgttacttgcagtatctgaagctgaaggtcaagacgctgggagccgtctccctctagctcctggacaattgtgatttagttctcaaagccgcttgcttctgctgttctacatatacgaagtatcacattggtaataaggtgaagatgccaaagatagctcaggttggtgcttcaggacgcgccagaggtgaataacggaagaagaaaaggttcaatgctgctttcttggcttcccttgtacccacatggctctaatgatatttgtgggcaaatgactggcacgcagcattgcagtagtacttcatctgaagcaaaggcgtgcgagttttccttccattgtggttgtggcggagcaccacggagcgacgctgcgctcctggccacctatgctgctctccagtaagctagcctaccaccatctttgtgtctgagagctccagatcttctcataccagcagctaacaagtatgtcactgtcggtgccccagtagtacctgcctgtatcactcactcactcaccttcctcaaaaggccctcgtgggtcggagcaacatctgtatgttatgcaaagctagaaacatctttttgctgagcgtgatccaaagcagagtgggggaaaggaaaggaaaggaggcccattgcatgcaaagcgccctgccgtggtgtttcgccgtccatggcttttgacccagctaccaaaggcgatgacacatgagatggctggaggttgggttcgtgtggtatagagttccttcctgcgggtccagccggtccaacaaagtgttgtgtgcctgatgtggagctcaacttcagcacacacacacacaccggttgcgctgcgcctttcatcatctgctgccgctgccgctgctttactttctgtcatcaaacccgctgatgcatatgccaccactaccattatagagtacgtatgtatgtatgtat

SEQ ID NO: 156 - DNA, 1321 bp, Sorghum bicolor
atacctgcatagtagaattcattcatttccagcccactccacctgtcgacggtcgagcagacttttcgtcttccagatctcggcaatctcgatccctcgccgcgccatggctgctgcctcctccccaacctccccgcccccgccgccggcgaccgacgtcgccgctccaggcctccccgatctctcgatcccctacgacctggccactcgcgggcagtggcaggcgctcttctcccacctctcccacccggcccacacgccgcatccgcaccaccgcctcctcctctccgctctctccgccctctccctggccaagctccgacgcttccccgacgccgccgcgctgctcgcctccctccacccggacccggcctgcccgccgccgcccttcctcatccgcctcctccatgccctcctcccactcttcctccccgaccgccccctcgcgctcgaccgcctctacacgctcctctcctccgtccgcgcccgccccgacgccgggcaccccgagtggcgccgccgcgacgcgctcgtcgcgtccgtcctcgccgccgaccacctctcccaccgcgagttcgacgtcgcgctcgcgctcctcgccgacatcgccgcccgcgagccgggcaacccggtgctcctctcgcgcctcgcctacgcgcacctccagatcggcaacctcggcgcggcctcagccgcgttccgccacgtggagtccgtggccgccgcgtccgaggaccccacgcggcatgccaacctcctagcccgcaaccgcgcgctggagtgcatcgtggccaaggactacgcggcggcggtgcgggagtacgagcgctgcatcgaggcggaccccgcggatgccgtggcgctcaacaacaaggcgctgtgcctcatgtactcgcgggacctcggcgacgccatcaaggtgctggagggcgcgctcgagagggttcccacggcggcgctgaacgagacggtggtggtcaacctgtgcagcatgtacgagctcgccttcgtcaaccacggcgaggtcaagaggagccttgctgagtggatcgccagggttgcgcccgacgacttcgacacctcctgcacgcgcatgtaggagggatagtagcgaactatatggacctgccagaatgccagattagcgagaggcaggtaaggttcccatgccatggcaatagtcgagaggttgacatctttggcaggcctggctaaatgtttactaggagcacaagcatactcgagtgggacgaggtccgagatcaggaagtgaaagaagcatactcgagtgagacgaggtcggagatcacgaaccgaaaga

SEQ ID NO: 157 - DNA, 1254 bp, Sorghum bicolor
ttacccttggcctgctccctcagtctcctgctccgtcggaacggacagccgcggccattccccagcccacctcttgctgcaccctcgcgctgctagggtttgctcgcaatccagccgcctccgccatggccaagacgaagcaagggaagcgggacgtcgacgcctacaccatcaagggcaccaacaaggtggtccgagtcggggactgcgtgctgatgcggccggcggacacggacaagccgccgtacgtggcgcgggtggagcggatggagtcggacgggcgcggcggcgtccgggtgcgggtgcgctggtactaccgccccgaggaggccaagggcggccgccgcccattccacggcgccaaggagctcttcctctccgaccacttcgacacgcagagcgcgcacaccattgagggcaagtgcatcgttcactccttcaagagctacaccaagctcgacaacgtcggcccggaggacttctactgccgatttgactacaaggccagcaccggcgcattcacccccgaccgtgtcgccgtgtattgcaagtgtgagatgccttacaacccggatgacctcatggtgcagtgcgaaggatgcaaggactggttccatccgtcttgtatgggaatgaccattgagcaagccaaaaagatagatcattacatgtgctcggattgtgctaaagaaaatggtgcaaagagaccctcaaattcatatccagtttcacccaactctgattctaagattgaatcaaagaggcgcaagagataaaatgctgtggcagaagcatccctggcaaaggagatgcgatatttatggtgtcagctcctcattactggtgcatattgagatgttgagatgtacactgcgagagaagagccaagccaattgtaggacaaaacttgtttttatcattcttctgtgtattctggggacgtttcctgcagcttagacattagtgtgatgagtaggtcagttcccgtcgctgcgcgtgcatgatcagctgctcgaggcgggataagaagtcgagaagtgctagaatgctgctgactctgtcgatgtaactttatcggtgtgtgtgttaacatatgcactggctggaaacgttcccatgtgtgaatggacgatgctgatgatagctttgactgttgtttcataattcagttagatgttgcgaagagttgaaataatattgagtttgatcttgaaacttgaagttgaaatgtgcagaacggcatggtctttggcg

SEQ ID NO: 158 - DNA, 2395 bp, Sorghum bicolor
caaatccaagctctcggccgcttataaaaccaccgccccctgcttgcctcttgcttacatccctcggctcctaaacccccaacgccgacgagacgtgccaaagccgacgccccccccggcacgcaccggaaagcgacgcgcctccaccgcccccgcttgccgcctcccttccataccggttaccacctcctcctcgggacgcggagcgcccaaccgcgggcatctggcggtggcggcgtccgcgccaccttgaacttgaatcaagcaagcgccagtgcgactgggcgggcatttggaaaggcggaagcgatggtggcggcggcgctggacgcaatggcggggacgcgttgggggcggtggctggggctggtgacggcggtgtgggtgcagtgcatctccggcaacaactacaccttctccaactactcgcacgcgctcaagacgctcatgggcctgacgcagctgcagctcaacggcctctccgtcgccaaggacgtgggcaaggcgttcggcctcctcgcggggctcgcctccgaccgcgtcccgacctggctcctcctcgccatcggctccctcgagggcctcctcggctacggcgcgcagtggatggtcgtgtcccggaccgtcgcgccgctcccctactggcagatgtgcgtcttcctctgcctcggcgggaacagcaccacgtggatgaacaccgccgtgctcgtcacctgcatccgcaacttccgccggagcaggggccccgtctccggcctgctcaagggctacgtcggcctcagcaccgccatcttcaccgacacctgctccgcgctcttcgccgacgaccccgcctcgttcctcgtcatgctcgccgtcgtgccggccgcggtctgcgcgctcgccatggtgttcctccgcgagggcccggccgcaggcgccgccgcgggcgcggacgaggaggacgacgggcgctgcttcgccgcgatcaactcgctcgccgtggccatcgcgctgtacctcctcgccgcggacctcacggggctcggcggcgacggcggagttgtctcggccgtcttcgtcgccgtactcctggtgcttctcgcgtcccccgccaccgtgccggcgctcctggcgtggaaatcctgggtgaagacccgcaaggccgcgaacgccgacctcgaggaggcggactccttggcggcggcggcggccgcgccgctccttctcgcagcgaaggcggcggggaggactgaggaggagcaggaggcgcggatccccggcgagcggccgcggctcggggaggagcacacgatcgcgcaggcgctgacgtcgctggacttctggctgatgttcgcgtcgttcctgatgggcgtcggcacggggctggccgtgatgaacaacctggggcagatgggcgtggccatgggctacgtcgacgtctccctcttcgtctccatgaccagcatctggggattcttcggtcgcatcgcctccggcaccatctccgagcacttcatcaagacacgagctattccccgcccgctgtggaacgcggcctcgcaggtcctgatggccgtcggctacatcgtgatggcgctggcgatgccaggctccctcttcatcggctcggtggtcgtcggcatctgctacggcgtccggctggcggtcaccgtgcctacggcgtcagagctcttcggcctcaagtactacggtctcatctacaacatcctcatcctcaacctgccgctcggctccttcctcttctcgggcctgctggcgggcctcctctacgacgcggaagccaccgcggtgcccggcggcggcaacacctgcgtcggcgcacactgctaccgcctcgtgttcctgatcatggcgctcgcctgcgtcgtcgggttcggcctcgacgtcctgctctgcgtccggacgaagcgggtgtacgccaagatccacgagagcaagcggttgagtaggtccgccgtggcgcagagggttggttagctagttgctacgcacgcagctctgtggaagctcaagaaaatagctcgcatcaacaacgttggaactctgaagaagcacctccgcaattttgtgtgcgaatatctttgaaaagaatttttgtgtgtgaattaaggggccattcatgtctcttattctttggaaaaagatggatgcatatcaatttgatttgtttccactgagtattgattgagagggttgcaggcttaattggtagaaccccttgagttcagtgtggtgtttattctgtagtgtacatagcgtttccgtaagattgtacggtgtaagtgtaatggcctatacgtgtaccagctgttaccaatttctcttacgtcaccatagtctgattccctcaagctttaaaaccaatcattttacccgtcgaactctagaaccg

SEQ ID NO: 159 - DNA, 5054 bp, Sorghum bicolor
gcagttcgacggtgcccagttaggtctcgtactctcgcggtcgcagctcacctcgcactcgcgcgactcgcccgctcgccgcacgccgcacgtcgctgacccgctctgccgctcgtcgccgcttggcgcttccagaagaaccccaaaagacgtcatcgtgtcgtctccactaggcacgtcctgaaaaccttgcgggcctgtactggaagcaggcaggagcgatcccacaggccacagcgcggctcctcgtcgccgtcgcaaccgatttaggtggagatggaggcggcgtcggcctccgacgaaaccctagccgccgtcttcgcccagctcaagccccacaccgtcgctctcctcgacctcctccgcagtcgccgccccgcctccagctccgcctcctccctccgcgaaatggccgccttcctccgcgccgccccggccccggcgctgcagctctgcttcgattatacagtgtttccacttctcctgctcctggatgcggcggtgcagtgcaggaagcaaagcaatgcgccggggcagggttcagggggcattgatatcagtgatgccgtcgccgaagttgggttgacctgccttgaggtcctcctcaccaagtgccgcctcacctctgtcaatcagatggtagcaatgctgaaaaagttgacttccggagctatgctttcaccttcagaggcttcagaggaattccgtggtgcaattataagatgcttcaaggccttggttttgcagctacagccatgcttggacaatttttgttcttgcaaacaaggaacattgttacctacgaccccaaccagtacaggcttggaggttgtaagtgtatcccgctcaaattactctgcacagccagaggagtgcttgcttgcattcctgcagtcacaaaatgcttcagctgctgtaggacattggctctcacttcttctactagcatcagaacttgaggcatcaagagggcaccgtggaagtgcagatgttaggaaggaatcattgcacactctgcgcatccttattggcaaggtaggctctgctgacgcacttgcctttttccttcctggaattgtcagtcgccttgggaaggttctctacacagctaaggctatgattagtggtgctgctgggaattctttgagcactgaacaagccattcttggattgactgaagctttgatgatagtcctaaatgacaaggaaaatcttagtgcacttggtaagcacatgaatgagaatcattctcattctcctggtggcagcggttcaactgagcatgtattgcagatgcttcgccagttaccaaccaaaagtttatctgacgagataggccatgatgagactacagatgactctatctccaatgtcaataattcctttgctgatagaaaggcactacatgtgaagcggaacaaaaaatggcttgaggaaacaactagtaatgttgataaattgctttgtgccacattcccacatcttgctcttcattcatctgagaaggtgaggaagtcggtggttagcggtgtaaaagggcttttgtctagttgcagttctacattaaaaagaaccaagatgctacttttggaatgcttatgtgttctggcatgtgatgatgctgcagctgtgtctgaggctgcacaagatgctcttgattatcttttcaaccagggccacaatcttgtaacagaaaatgagatttctgatacctttactaggctggttgaaaggctaccacaggtggtacttggaagcgaggagacaaccgcactttcacatgctaggatgttgttggctctgaccttttatgctggccctcagtttctgataaatcatcttcactgttctcctgttattgctgctcgtttctttgattgtttgggtttatgcataggtcatagctcacagttttctggttccatggacaagctaattgtttcgaagccactatctattgggtatctttattcagttgctgagttgaagagtggtgcctatgctaaagatacaactaacaaatctctgcatgccatgtcgacatctgcagcctccaaaatatctgttatccatgataatgctttgccaaatgcattacttggtacagttgaatatgagttgccccatgtgcctccatggttttctcatgctggtagtcagaagctttacggggttcttgctggaataattagacttgttggcctatcaacagtttcagggaaaggaactgctgcatccttatctctctttgttgatattctgctcgatcaatttaggaggttgagcactgagctgagagaaaaaagtatttacaaagatggtctgcagcggtggtacatgaaaagtgaagctggacaaacattacgccaagcaagttcagctgtctgcatgctcaatgaactcatgtatggtttgtcaggtcgatcccttggtatgtttttacaacttttcaacaatagatcagcacagatgtcaaggacagtttgtcagaaaaatcaactgcttgcttgtgttgaacataatggagttactaatgaaagagaagtgtggggctttaatgaacaaaagggcactaaagacaacattcttcattgcattggcagtattctgcatgaatatgtatcaccagaagtgtgggatcttccaacagagaaggacactgagctacgcctaatagagttgaacctgccattgcacttctaccgtgatacaactgcgctgcacacggttgtgcttgaaggaattggagtcttgggtgttcttcttggtcaagattttgcacttagtgggtttatgcactcttccctttatcttctgctccgtgaacttatcagttcaagtgctcagataagaactgcgtctgatgctgtcctaagagcccttgctactgctggcggttattgttcggttggccagtttgttgttgcgaatgcagactacattattgattctctttgcaggcaattgcgtcacctggacctgaacccccatgtccctgatgttcttgcttccatgctgtgttacattggtgcttctcgtgatatcttgccattcttggaagaaccgatgcaagcagtttcttctgagctagaggttcttggcaggcatgatcacccacatttaactgttccatttctgaaggcagtttctgagatttccatggcatgtagacatgaatctacttgtttgccagatgaggctcaatcattttatgtgaaggtcagttctgagggtcaagaagtaaaaaatacgattgagaagagaatggaatccagtgcaatatctgaaagaatgaatgttgatgctcgaccttattttatgagcttggaatactgggaggatttactttgtaagctaaatgagatgagaagatataggagaatagttgggtctcttgcaggctcttgtttgtcagctgccatcccgcttctctcttcgattaaggaagcagcatgtcttgtggcccttgacattgtggagaataccactatatctattgccaaggttgaggaggcttataagtgtgaatgtcaaagcaaaggagttattgaggaggccatccagtttctttcatttgacgagcttcttgatggtacagatgccactgaagatgtcgatgaaaataggctactcccagcaatgaataaactatggccttacttggttatctgtctaaggaacaagatctcagtgccagttgttaggaagtgcaccgaagtgttgagtagagcaattatcatatctggtggcgatttttatgtacgccggtttcataaggatggatccattgtttggaggttgctggctttatctccattccgacgaacatcaaagatggatgaaaaagcaatcattttaccatatagggatacctcgcttacctcagaggaaccaatggctgagatctccagccaaaagattcagattgcagtcctggacatgattgctgcaatatcttcgaacaagagaagtgctgttgcactagaaagtgtactaaagaaggtatgtggccttgtggtaggcattgcctacagtagtttgacaagtttgcaggaagctgctataagggcactggcaggccttgcctgtatggatgctgaccttgtctggcttctcctggcggatgtgtactactcactaaaccaaagggaacctttactgcccaaccaagatctagcgctggtatcagatcttttgccccctccaatgtcttcaagagaatacctctttgtacagtatggaggtgagggtgttaggtatgatgtagatccctcatctgttcatgaagtgtttagaaggatgcaggatgtgtgatcttgtgtgacatgaaagtcaggttcctgatcctttgtctatctgtaaccttggtgaggtttttttgtcatgctagcatcctttgtcacacattgaacataatattgcctgctacagagaatgcaaacatcaggccagatgatgacgatgaaggatgctgtctgtttgtatcaagaaacccaataggcatcagtaaatgccaaggacattgttctctgcaattttctgagcaaggagcagtgatgcattggaggtgtcattgtacaattacaacagcaggcaatgattcggatggttttctgatggggatagttctgtagttacatctagcaatcatgtatcttttaaggggtttagacgtttagtcatgtgaagaaaagtgaaggtgtactaatcacgacctgagttgatagttcctcagagttgatagttcctttttaagtgcttttttctgtctaatttacctgtcaatgccgtctaaatttctttcagaagtaagactcctttatgaactcaagttgttactgtcgaagcatctccttcgttgttgctactgttatgaacatatcggctgaaaagacgctcgacaaaatgttctggttgcagtcctagtaaggagctgttagggttttgtatttggactttgcatttttgtaatttgccaaaaatcttaaaaggaggtatccaatggttttgtatttggagtttgcattttgggcaacttgtcaaatgagagagca

SEQ ID NO: 160 - DNA, 1744 bp, Sorghum bicolor
tacactatgtctaatatataattaaagcgactatgtctaatatataattaaagcgatgtataagtgtattataatttggaatggagggagtactattccgtggtgaacagtgcttgaaaaaagaacactgagtggaacttcgccacatcggggtgggggacaacatttctatggtctcgaattagtggtttcgcatgatgcggttcaattgctgtgagaattctggtagtcccaagcaaacatgtattttcgatttttcgatttcgagagaggcgacaagctcgatgtggtcattgctgattgcaacattcagcagtcaggacaacgcactcatgttaatcgtgcataaaaaaaaaagcaaaagcagccctgttcgtagtaaaaaggagcagcagccgccgccggcggccatagcacaggagcccggagctgtttcttcgtcgcaggaatgggcaagaatggcacccagtacgcagtgctggacgccttcacggcggagccgttcaggggcaaccccgccgcggtgtgcctcctccaggacgccgccaaggccgctgacgagcggtggatgcagtccgtcgccgccgagttcaacctctccgagaccgccttcctcctccgggactcctccgcctctggcgccgccccgcggttccagctccgatggttcacccccgccgctgaggtggagctctgcggccacgcgacgctggcctccgcccacttcctcttcacatccgtcctcgcggagcacgagacgctcatcgagttctcgaccaagtcggggattcttaccgccaaaagggttcctgcgccggagagcacgggcgtgtcaggcgaggggaaactgttcattgagctggatttccccatgattgaccttgttgattgccatccttccgagctgccgtccatccccaagaccctgaacggagcctccattgtcagcgttcacaaggcaacgacggccggtgacctcattgtggagctttcatcaggaaaagaggttgctgatatcattcctaacattcatgaaatcaaaatatgttcaggcagaggaattattgttacagggccagcgcctgatggatctggttatgacttcttcagtcgtttcttctgcccaaaatttgggatacctgaggaccccgtttgcggcagtgcacattgtgtcttggcaccttattggggtgggaagctggggaaacacaaattgacggcatttcaagcatctccacggagtggaatcctatacctggagttagaagctgcaggcaggagagtgcgaattcagggagaagctgttactgtgatgactggtaccctcctagcgtagccgctcaataatgaacttcgcggtcttcagtttggttgtgcggcatgattactctgcagcaaggaataaactaattctcatttcacccgtcgaaagaacttaaatacactgcttccagtctttggaatcagagtgtaccagtccgtgtgtctggaataataacttagtcgatgttcaatgtgtgtgtataatattttctgtttgcattggcttcaattggagcaacgaactagacttacgtgctggataaagaacatatagatttgaacaaattgcctctggagtataatgattcgtggtgaacgcttataaagaacagaatgtaacgtcgggcttgggcaggtgaatttggttttatgcccgagggagtcaaagcctaggctctgaaacttggatctcgcacgacgc

SEQ ID NO: 161 - DNA, 1255 bp, Sorghum bicolor
cgcctccaatctccggaagaggtgaaagcggaagccggagaaaatatccccatggctatcctcgccgtcgcctctccgctcaaaaccctaaaccctagccaggcggaccacagccgcatccgcctctcctcttccctcctccgccttccgctcccggtgccacgatggcgccgcctccggtgctccgcgcagtacagtgaggcggcggcggcgccgcccacgtcgacaacgacgccgcggccggcggagataccctggagcaaggagctctgcaactcggtgcgcctcattgggactgtgggcaccgaagtcgagctgcggcagctgcccagcggctccgctgttgcgaggggccgcctcgccgtatggaagtcggccaccgaaactacatgggtaactctacaattctgggatgatctggctattgttgcctctgagcacgttaagaagggtgaccggatatttgtttctggacggcttgtgtcagatactgttgatgaggggcctgagaagcggcatgtttattacaagcttgcagttcaacagttgaatttcatcgagtcccagccagttcgattatatgaaccagaggcaagccaggatgccccaggtggaaggcgtgctgattattttaactctacctctaattcaactgaggataagaatagggataatatgagctcttctcgatcaactgaagagctgtggcaagcgttctttgctaaccctcttgactggtgggataacaggacaaataagaagaacccaaggtatccagacttcaagcataagcacactggtgaagcactatgggttgacgggaggaacaaccccaactgggtcatctctcagctggctgttttggactcaagaatgagttctctgcaagacaatgggagaaaaccagtctcttatatgtatgctgatgagttcatgacattggacggcaatcggtagtctttatgaaggaggaagcttcacagcccccactttttgtgcagcttggctggctgttatggcgagatcgtgctgtcggagtagctaactcatgcttgctgtccagagttgagtgttattgtacatatctgagcggctcttcagagttgagtgttatcgtagatctgttagtagtgttagcaggtttgtgacatggttttcaagtttcaactgtgctgttacgtctagtggtaatgtgtaaaccttgggttgccatgttcaaatttttatgtttttgcttggaaggatttgcagataa

SEQ ID NO: 162 - DNA, 1450 bp, Sorghum bicolor
gaagttaccaacggcgtaccacacctagagcttcattcttctgaacggaaaagccaagcaaggttgaagaggcagatcaagcgagctctaatagttttcatggatatggagcagggctgcaagacggctcacgggtgggctgccagggatgcctccggccacctctccccttacagcttctcagcaaggattcagggggacgccgacgtgacgatcaaggtgctcttctgtggcatctgccacacggacctccacgtcatcaagaacgagtggggcaacgcaatgtaccccgtcgtcccagggcacgaggtcgtcggcgtcgtcacggacgtcggccatggcgtcaccaagttcaaggctggggacacggtgggcgtgggctacttcgtcgactcctgccggacctgcgagagctgcagcacggggcacgagaactactgccctgacctcgtcctcacctccaacggcgtggaccaccaccaccacggcgccaccaccaagggaggcttctccgacgtgctcgtcgtcagccaggacttcgtcgtccgcgtcccggagagcctccctctcgacggcgccgcgccgctgctctgcgccggggtcaccgtgtacagccccatggcgcagtacgcgctcaacgagcccggcaagcacctcggcgtcgtcggtctcggtggcctaggccacatggccgtcaagttcgccaaggcgttcggcatgacggtcaccgtcatcagctcgtcgcccggcaagcgcgacgaggcgctcggacgccttggcgccgacgcgttcttggtcagccacgacgccgcgcaaatgaaggcagcagcggccacgttggacggcatcatcgacacggtgtcagcggggcaccagatcgtgccgctgctggcgctactgaagcccatggggcagatggtggtcgtcggcgcgccaagcacgccgctggagctgccggcgtacgccatcatcaccggcgggaagcgggtggccgggaacggcgtggggagtgtcgccgactgccaggcgatgctggacttcgcaggagagcatggcgtcaccgctgacattgaggtggtgcagatggactacgtcaacacagcgatcgagcggctcgagaagaacgatgtgaggtatcgcttcgtcattgacgtcgcgggcagcaagatggaggagaccgttgcttaattaggtgcccggatgcggcgcggttcgagtcattgtcgtgtgaaatcgtttgctcgtgtcgtgtcttttttggggggtccacgcaagtcaataaactaggcagaacactggggccacatgttctgcacttctgctattcaatgcttatgtacgtttaaattttgaaatgtgattgagatttgagaaagaggatgcttaaaaacaatttggctattttatggttgtttgtgaatcataatacggacacaaatcggctagatgt

SEQ ID NO: 163 - DNA, 1408 bp, Sorghum bicolor
agggcagagtgggttttagagccctcgtacgcggccgctaaaccaccggatctattggtcgttccccggcgccgacaaggccaaaccctagaaccctgccaagatgaggtcgctgcgagcggcgcagaccctagtctcccgttccctcctctccgcgcgccatctaaacggcgcagcctcccccgccacggccgccgccgccgcgggcgcgcggtggtgcgccacgccggcgccggtgccgccgccccgttcgccgcttccgtcttcgaaggtgatgcctgccggggttgccggcgcagtatccttctcccttaccttcgctactgtagcggtggcggaggccaaggccaaggagcggccgcagccggatctgttgccgcagaacgtggtgctgtaccagtaccaggcctgccccttttgcaacaaggtcagagcctttttagactatcatgatataccatacaaagtcgtggaggttaatccattgagtaaaaaggaaatcaagtggtctgattacaagaaagtcccaatattgacagtggatggtgaagagcttgttgattcatcagatataatcaatatactacagcgcaggatcaaccctgatgaacccactaatgatgaggaagcaaaatggcgaaggtgggttgatgaacaccttgtgcatgtcttgtctcctaacatataccggacaacttcagaagctctagaatcttttgactacattgcaaaacatggtaatttcagttctacagagaggtttgccgtgaagtatgctggtgctgcagccatgtacatggtatctaagaagctaaagaagaaatacaacataactgatgagcgtgcttccttgtatgatgctgccaatacatggatcgaagccctgaatggaagagatttcctgggtggctccaagcctaacttggcagatcttgccgtcttcggtgttctaagacctatacggtacttgagagcaggaaaagacatggttgagaatactgaaatcggtgattggtaccaacgcatggaagttgcagttggagaaccatcaagaatacaggatgcagaaggaaactagaattttgacaagacattcttttcaagaatttagtggaacctgtgcctatacatggaggctattcaaaattttgcccaaattaagcgtatgcaataatgctctgccagatttcaagtactagcaccgaggaacagtgttttgatttgggagttttggttgtgttactgtacaatgttttgctctcctagctgatcacgtctaaattgtactccagcatctcagcaatcctgctgtgcctaagtacggagaatgctggatctgccaaactgacagattcatgattgtttaattagttaatggcaatatcatgtggcatttattggctggaca

SEQ ID NO: 164 - DNA, 1270 bp, Sorghum bicolor
ggccatggcaggaagaggaggacaaaagagggcagcttccgcaagatcttgagatgtgtgaagaagactgccacaagacaccgcatcgggcaccagcaccaccaccacctttaattcctgcctccggccgtccagccaccctccccacgacgtccaccccgcaggtttgccagcagcccagccccatcgtcgagccgcgagctaccagtcgagcgcgcgcggcagcggcagccctgggttcgatccggccgatcgatcgcatacggcacctacggatgctccacgcatccgtctcctgagatctcgatcgattgctccatggggagcggcaaggcgtcatccccggccccgccaggcgccgccgccgccgccgctgccggcgggagcggctcgccgtcgccgccgggcggcgccgtctgctgcatgtgcggcgaccgcggcctcctgcccgagctcttccgctgctccgcctgctccgtccgctcccagcacacatactgcacggatcggtatccgaaggtggagtcgtacggcacctgcaactggtgcctcagggcggatggggccgtggcttctacttctaactcgccgagatccgccggcaaagcggctgcccggccgccggctcctcatcatcacggcggtgacacgacgaccggcggcagcggaagatcgccgaaggttgttgccgctcgtggcgactttgcgtcttccaacctgagcaagcctatcaagaagcagccgcagcagcagcatgcgcagcggctcttgctgcggcggtcggcgtcggaccttggcacccgtgtcgtccgcaacgaccacgacgcgccaccgccgccgtcgcccggcgtcgcgcgtggcaggccgagggtccggaggtacaagctcctagaagaggtgatcactagctagctatagccatataccccgtgtggtatatcgatgtcgatcgtggatgacacgatcgagtgcgtgtgcgtgtattaggtgtataatacgtgtgtgtgtgtgtatgtgtgtgtataggggtagacaactagacatggcatcttgcggtgctgccatgcatgcatggagatcgatcgagcagtgtatcgtacgtactacgtgctgatcgatctcaggtgtgctgatcgatctcaggtgttaatcagggtgctcgcttcgtgttgtggtacatgagaggaataatatacgcgcagctcgatcatgcggtgtgcagctatatatagctttgatcgatgatccttactctcggttagtcaaccaa

SEQ ID NO: 165 - DNA, 4185 bp, Sorghum bicolor
agtcgccacccttccctccctccctagtcccagcgccagcgccagcggcgtgggcgggcccgtctccctcgccggcttcctttctcgtctcgtctctctcccggcgcccgcgcccgccgaaacactcccgaaaggaaaccgatccgtcacccaaaaccttcgccccgccgcgacctccctcgagccgcgtttaaagcgcaggcgcagcagcaaaaaggaaaaggaggaagcgagcgagcgagggatccgggagcgtgaagcgcgaaaaaagcaggggaacgagcgaggaagcaacgcggaaacgagaaagcgagcgagacaagcgcccgattcggtcccccgccccgcttcgtttcctccgccgcacgccttctccgatcggggaggggtgcggtgtcatctctcctgaggaaccggcgcggcgatggccggggggcaggcgcccgaggcgtcgcccgggcggtaccagcgccgccgcgacgagatcgacgacgacgactgcgccgacgtgctcggcatcgacgtgcgtggtcccgacgctgacccgttcgacatccccgccaagcgcgcccccgtcgagcggctgcggcgctggaggcaagctgcgcttgtcctcaatgctaatcgacgattcagatacacacttgacctaaaaaaggaggaggagaaggaacaaataaggaggaagataagggcccatgcccaagttatacgggctgctttacttttcaaagaggctggggaaaagcagaatcctgacacagaattgccagaaattctcccacgtgggtttggaattggagagcagcagctgacagtgatgactagggatcataattattctgctctgcaagaatatggaggggtcaaagggctcgcaaatttactgaaaaccaacctagagaagggaattcatggcgatgaggcagatttgtcatgcagggcaaatgcttttgggcctaacagatatcctcgcaagaaaggaaggagcttttgggtttttctttgggaggcctgccaagacatgacgctagttatccttatcatagctgcagtaatttctctagtactgggcattgcaactgagggtatcaaagaaggctggtatgatggcactagtattgcatttgcagtctttcttgtgatagtcgttactgctgttagtgactacaagcagtcgctgcagttccaacacctcaatgaggagaaacaaaacatacaagtggaggttattaggggtggtagaaggattcaagtatcaatatttgatatcgtagttggtgatattgtggctttaaaaatcggtgatcaggtcccagccgatggcgttgtaatcagcggtcgttctcttgccatcgatgagtccagtatgactggggaaagcaaaattgttacgaaggatcagaagtcaccctttttaatggctggatgcaaagttgctgatggttatggtaccatgttggtaacggcagttggccttaacaccgaatggggtttattaatggccagtatttcagaagacaacaatgaagaaactcctctgcaggtgcggttgaatggagtagcgacattcataggtatcttagggctttctgttgctgctatggtcctcgtagtcctctttgcaagatattttacaggacatacaacaaattcagatggctctgttcagtttgttaagaggcacacgagtgtgaaatctgcaatatttggttcaataaagatactaactgttgcggtaactattgttgttgtcgccgtacctgagggcttaccgctggctgtcacactaactctggcttattccatgcgaaaaatgatggccgacaaagcactggtgcggaggctttctgcctgtgaaacaatgggttcagctacaactatttgtagtgacaagactggtacattaacattgaaccagatgactgttgtgcaatctattgtcggtgaagtaaagctgcaacctcctgctaatgttgataaactgtcacctactgtggtctcacttctacttgaaggaattgcacagaatacctcaggcagtgtgtttgaggcacaggatggcagcatcgaggtaactggttcaccaacagaaaaggctatcctatcttggggtcttgatcttcgtatgaaatttgcggaggagagatcacgatcttctataattcatgtctctcccttcaactccgaaaaaaagcgtgccggggttgcagtggttgcgagagattcggatgttcatgtacactggaaaggagctgctgaaattgttcttgccttatgcacaagttggctcgatgtggatggctcagcacatgtaatgacacctgataaggctgatcaactcaagaaacttatagaagatatggctgagcaaagtcttcgatgcattgcttttgcttatcgaaatcttgatctgaaggttgttccaagtgaggagcaaataatcaactggcaattgccagataatgagttgattcttattggaattatagggatgaaggatccttgtcgccctgaagtaagagatgctgtcgaactgtgcaaaaaagctggtgttaaggtacgaatggtaactggagataatctgaagacagctagagcaatagctcttgagtgtggaatactcgatgactcagaagcatctgcacaagctataatagaaggaagagttttccgtgcttacgatgatgctgaaagggagaatgttgccgacaagatttctgtgatggcacgatcttctcctaacgacaaacttctccttgtaaaagctcttaagaaaaaaggccatgttgtagctgttactggtgatggaacaaacgatgctcctgcattgcacgaggcagatattggtctttctatgggcatccaaggaacagaagtagctaaagagagctcggacataattattctggatgacaatttttcttctgttgtgaaggtggttcgctggggtcgctctgtttatgcgaatatccaaaagtttattcagttccagcttactgtaaatgttgcagctcttgtcatcaatgttgttgctgctgtttcctcaggaaatgttcctctaaatgctgttcagcttctctgggttaatctcatcatggacacacttggtgctcttgctttggctactgaaccaccaacggatcaacttatgaggcagccacctgttggaaggagagaacctcttgtgactaatatcatgtggagaaacttgtttattcaggctgtttttcaagttgctgttcttctgactctcaactttaggggtcgggatcttttgcatttaactcatgacacactagatcactccagtaaagtgaaaaatacacttatattcaacacatttgtcttgtgtcaggtgtttaatgaggtcaattctcgtaaaccagaggaactgaacatctttgctggagtttcaagaaatcatcttttcttgggagtagtaagcataactgttgtgatgcaggtgataattattgagttcctcgggaaatttacgtcgacagtgagactcaactggaagctttggcttgtttctgtagttattgcttttctaagttggcccttggcttttgttggaaagttcattccagttccgaggactcaattgaaggatatcatcttaagatgttggcctaaaagcggcgagagtgcagaacaacaggatcaggatgacagaacagcacatccgccggtgtgaagctgtgcttgggcaacttttcaaaattatcatatgctgaaatattgtagagagctggtgcacatagatggtgttggctaattttggatgctgatttcttctaaccatgcttaccttgttccctggctatgaattctatggctgtagtaagcaatctgggaggtacatcctcgctgactcgtgaatcgtgatctagaatttgaagtcactgtaagcaaaatatgttcattgtagcctaacgaagtttagggacctccagtggttcattgcacaagttgtgcagccggtctcagaatcatttggggatatcgatataaacagtttttcttgtcgtcaagagtggagtctagctcttttagatgcaatctagaacattttgccaaacactctgatttgtgttggctgtaaagtctgatatctgattgctactgggatgtggtcgaacgatttgattttcgtaatattaattggctgattttgtcaga

SEQ ID NO: 166 - DNA, 573 bp, Sorghum bicolor
acgttccccgcgcgcccaccagaaagcagagagacaggcagaggcgcgtcctgcttggctgcttgctttcgctgcagtataaaaggcccccgcgcgcctctcagcactccacgtcaatccacaactcaaaagtcgcaaggcgagcaatttgcaaggcgatgagcttgaggtacatgagccgtgtgggcgcgcgggcggcgcaggcggtgcgggagagcacggggaggtcggtcaaggacaaggcgcagtcgtcggcgtcggcgtcgatggcgaggagcggcggcggcagcaggccggcgccggccgccgggtcgtcggtggagtcgggaagggcgagcgccgcggcggtggccaggaggaaggcggaggaggagaagcggcgccgcgccgagcaggcgctgcgcaccgtcatgttcctctccatctgggggcccaacacctagtactagtaggagcatcttgtgtagcgtgtgttgtgttgtgcgcgtttgttttgtttgaggttggaaacaagatgtaaatttgttacaatgatctaatagatgaagacatccatacgctgattcttggaaa

SEQ ID NO: 167 - DNA, 1554 bp, Sorghum bicolor
cccatttcccaccacccccaccctactcccccgcttccgtttcctcggacccccaccaccgcggcgcgcccacatccctcagatgcagccgccgcccgccgagatgcaccccgccgtcgctgtcgaggcctccgcctccaccgcgcaggccgacaccaccgcaagcgccgccgccgccgccgtccccgcacccgatccctccccgcccccgccggcgccggcggctgagacggtcgatccgccgcccccgccgcccgcgccggcgcccaagacggtcacctggagcgagaagctcacgtccgactcgccgacgcacgtgcacgccgccgccgcggcggagtccagccagtacgtgtcccgcgggcccgcatcctcctcgtctaagggcgccgtggaggtgatgagggagacgctgtcgaggtgggggaagtcgtggggggagaccaccaagatggtcgagagcctcagccgcgacacgtggcaacacttcaagactggacccagttttactgaagctgctatgggacgcctagcacaaggaactaaagttttagcagaaggaggctatgaaaaaatatttaagcagacctttgaagttcttccagatgagcagctgaaaatatgctatgcgtgttatctctcaacatcggcaggtcctgtcatgggagtcttgtatatttctaccgcgaaaattgctttctgcagtgataatcctctgtcatacaaagctggaaataaaactgaatggagctactacaaggtggtcattcctcttcaccagctaagagcagctaatccttcagtaagcaaagtaaattctgctgagaagtacattcaggtcgtttctgttgaaggccatgagttctggttcatgggttttctaatgtacgacaaggctgcagccagtcttcaagaagccttggctactgctcgtgagttgcaaccgtaaaggcaccaagtggtgttttttccggttacatcagtttccacatctcgagtccaggctgggtcgctgggattccttagcttctgagtgtctcctgtttcagatccttttagctgaagcttttgacacggtacactcactagcttgcatacgcctcagaaatgtatgttattcctgtcaatgttgtagtcatgagatatatatggaaaaacactgccgctgtccattttgaatgcatgtcaaacatttaaatgtgacagaactatcaatattttctacatttgagatgagattatgagatacaagtttagaaagtagcatgatgacatcttaaaattactagaaaaaattctacttagcaccctaactattgactgttgtttgcttcatcccattatcttaaaatcagttatctactcccctaaattattaaaaattgtataaataactctttgaggtagttttgaagacaattcattttgttgttttgacaattgccctgagtatccatacttgtacgtaggcccatctgctgccctctttccttactctttctaggctacctcactgctcgatgagcagcatataactcttgattggtctttcag

SEQ ID NO: 168 - DNA, 1548 bp, Sorghum bicolor
agaggagaggagaggaggagctcattagtttttttttttttgggcgtcggtccgtcggaggggattggttgttgattgatcgtcatccgcttcgtccccggtggtagctcgcgctcgattccttgatcctctctcgccggccggcgcgcccgcccacatggtggagtcggaaggcgaggcggaggcggcgtgcgcggcggtgctgacgccgccgctgtcgctggaaggcggcctcgcggcggagctccgccctgccaacatcgtccagcgtgtgctcagcctcttccgcaacgtccgcccgggctcggacctctcccacttccagctgccggcgacgttcaacctgcccaagtcgcagctacagctatacggagagggggtgtactgcgtcggcgacgacctccttggccggtgcgcgcgtggcgccgacagcctcgaacgcctcgccgccgtggtggcatggagcatctccacgacgcggccgcccatcttcggcttcgcgccctacaacccggtgctcggcgagacccaccacgtctccacctcctccggcggctccaccctcaacgtcctgctggagcaggtctcgcaccgccctcccgtgacggcgctgcacgcggcggacgcgcgcggcgacgtccgcctcgtgtggtgccagagcccggcgccgcggttccacggggccagcgtggaggccgcggtgcgcggcgcgcgggagctccgcctgccccgccacggcgagacgtacgtcgtgggctgccctaacctggtgatccgcctcctcccgtcccccggcgtcgactgggccggcgacgtccgcgtcgtctgcgccgagtccggcctcgaggccaagctcagctactgccggacgcgacgctcgttcctcgggttcggcggcggcgacgcccgctgcgtcaggggcaggatcttccgctcgtccgcgcctgacgagacgctgtgcgaggtcgatgggttctgggaccggcaggtctccatcaaggacgtcgctactggtgaggtctccgtgctctacgacgcacagcgagccattggtgacctcgccacgcccgtcgtgcaagaccagaagggcgtgtcggcgtcggagtccgcggtggtctggggcgaggtgagcgacgcgatcttgaagaaggactgggagacggcccggcaggcgaagcggcgggtggaggacacggcgaggaggctcgccaaggagaggaacgagaggggggaggtgtggacgcccaaacacttctcgctgtcgcagaacaaagacggcgactgggagtgctggccgctggaggagacggtgccgccggcgcctattgttgtcccctcttcctcatcctcctcatgacactactagtagatcattagtacttctacagcactacatgttgattgacacttcactgatgatatacgacgaacgaacctgaatgaatctcattgaatctatgtatatatatttcttcttcgtcggcttgagaatcgtgtggtgtgatagatgcatggtagccacgatttcttcaggtacagctctctgat

SEQ ID NO: 169 - DNA, 1775 bp, Sorghum bicolor
ttattgattccaaaattactaaagctagcatcttctcttagtaggcttaaaggttgttcttttgacgtttgttccaagatgctagattctatgttttcccatataaaacgcacctcataaggcactccttatcaacctgagaaggtcgaaagggtatcaaaaggcttaaggtcggacaagagggcgtttgagtttgtcaacacgaaacactccaacacaaattcagcctttgggaacagagaaaagaggacactggaaaacacaggccacaaagatgtatcaccaacatcagggcccgagtgagctcttcaccacgagaacatcctttccaatggagcagcatctgtttttgcgtggaggaaatgcccaaggagattctgggctggttctctcaactgacgctaaaccaaggctgaaatggacacctgagttacatcagcgatttgtagatgcagtcaatcaattaggtggagcagagaaagctactccaaaaacagtcatgaggctcatgggaattccaggactcaccttgtaccatttgaaaagccatctccagaaatacaggcttagcaagaacctccaagctcaagcaaatgtcagtacatcaaagaatgccataggatgtacatccgttgctgataggattcctggaacaagcgcagctacaatgagcagtacaaatgtcgttccacaggcagagaagactattcaaattggtgaagcacttcagatgcaaattgaggttcagaggcagctaaatgaacaacttgaggtgcaaaggcatctacaactacgaattgaagcccaagggaaatacctgcaggcagttttggagcaggcacaagagacacttggaaaacagaatttgggtcctgcaaacctggaagatgcaaaaataaaaatatcagagttagtttcacaagtatcaactgaatgcttcagtaatgcgattacagatgtaaaaggaagttcaagtgtgcatagattagagcccagacaaatccagtttgttgaaagttcaacaaatagttatttgtctgtggctgaaggattcatcaaggagcacagactacagcaccatggagtactaaaagcatatgatgatagttcattattttgcagaaaaagatctcatgaacatgagacccagtttgcccttaacagaagcctaagtgagcgtaggatggctcatttgcagaatgaggaaggatacagtaaagcagagtttgggtatgaaagtgacacagaaatggcacatgagtatgctgaacctcaaaagaatggtggaggtagcaccaccagttcggcgtcaggaagcaaagtagatgcagagaagctatatctggaagaacaaaactgcgcaagacaggcagttgaataccccagagaaagcaagctagtagattttgagcatccgtgctctgggaagaaacttgatctgaacacccacaatgtcgatgacactgatcaagcttacagacattttgacttgaatggcttcagctggagctgataatatgtaacatgatataagtgaagaaatgaagttacaaataatttcttccaacattgaagtattgatacatgatcaaatgtaggtcaagaggaatcatttatgtttttaggtatttagtatagcgtacagaaatggtattcgctttgggccatcagcagtttactcaaaactaaggaaaataacaatgcgtaaacagtatacgtaagaacccagacaaatagcatcaacgaaattagagtccataagattcagaacacta

SEQ ID NO: 170 - DNA, 6290 bp, Sorghum bicolor
gccttccccagctcccttcccttgctcacctcgcttcctcgccacccccactttccccgccgctgccgcgctagtcagtcagcagcaccaacttcatcaccctgcgcttgcgcgcggcaacaccgtaccaaagcgcgccgtcgggatcggcgggaatggcgagcggcggcgccggcccgtcggggccggtgcggtccacctcccaaacccggcagcggacgatggggcggatacccacgcgcgcctacaccatgcgcccggacggattgtccggtgaggacggccccggttttgaggaggaggagctcgtgccctcgtcgctcgcgcccattgtacccatcctccgggccgccaatgagatcgaggaggagaacccgcgcgtcgcctacctatgtcgctttactgcattcgagaaggctcatcttatggacccaatctcaggtggacgtggagttcggcaattcaaaacatacctcttgcataggcttgaaaaggatgaacatgagacaaatcgcaggcttgctacaactgatgcaaaggagatacaaaggttctatgagcaatactgtaaaaaatatctagaggaaggtcatgacaagaggaaaccggaggagatggctagacactatcagattgcatctgtcctatatgatgttctgaaaactgttacacctggcaagaatgagtatgataagtatgctaaaggggttgaaaaggagaaagcatccttctcacagtacaatattctaccacttaatatttctactccaagacaaccaataatggaaattcctgagatcaaagcagcagtggcgctccttcgtcagatggatgaccttccaatgccaaggattgaattaacacaaagctctgatggaaaaacagtgcctgatgaaatggacaaacctttggtccaggatttgcttgattggctttggcaaacatttggatttcagaaaggcaatgtcgagaaccaaaaggagcatttgattttgctccttgcaaacattgacatgagacaacagggtacttcccaccatagtgggagacatgttcacgtgatacatagtagcacggtgatatatttgatggacaaaattttccagaattacaactcctggtgtcgatatttgcatctggattcaaacattataatcgcaagcgatgcctccacacaacggccagagcttctatacataggactgtatttactgatatggggtgaagcttccaacgttcgcttcatgcctgaatgtctttgctacatcttccaccatatggcaagagatttacatgacataatatctgatagaagagaaggaccatttgagccaccattccagcgagaggggagtgatgatgcatttctgcagctagtaattcagcccatctatagtgttatgcagaaggaagctgcaaggggcaaacatggtacagtgagccactcaatgtggagaaactacgatgacttgaatgaatacttttggtcaaaaaaatgcttcaaaaaacttggatggccaatgaatccaacagctgacttttttgcggacaccagagccacgaatgaaactgagcaacatgatcatgtgattagccgaagaaggcaacatgatcatgtgattagccgaagaagggcgtcaaaaacaaattttgttgaagttcgtacatttttgcatctattcagaagttttgatcgtatgtgggccttctttatattggctttccaggccatggtaattattgcctggagctcttctggggcactttcttctatatttgaaccagaagttttcagaaatgtattaacaatctttataacagcagcattcctcaacttccttcaagccacgctagagataattctcaactggaaggcttggaagagcctggagtgctcacaaaggatacgatatatcctgaaatttgctgtagctgttgcctggttgataattcttcctactacatactcaagctctattcaaaatcccacaggccttgtgaagttcgtcagcaattggataaatttgcagaatgaatcaatttataattatgctgttgccctttacatgttaccaaacatattcagtgccctgtttttcatgtttctaccaattcgacgggtcttagagcgctcaaattctcgcattataaggtttcttttatggtggacccagccaaagttatatgttgctcgaggcatgtatgaagacacttgctcacttcttaagtacactacgttctggattctactgcttatatgcaagctcgccttcagttattatgttgagattgcacctctagttgaaccaaccaggataatcatgtcactggaaaggccgccttacgagtggcatgaattcttcccaaacttgcggcataatttaggtgttgtggttactgtatgggctccaattgtcatggtatacttcatggacacacaaatatggtatgccattttctccacaatttgtggtggagtatatggtgcattcagccgcttgggtgagatacgaacccttgggatgttaagatccagatttgaggcaattccaagagcattcggcaaaaaacttgtacctaatcatggtagtcgcttgaaacgagatgaggaggacaaaaacccaccctttgataagtttgctgacatatggaatgcgtttattaactcattgcgagaagaggacttactaagcaatagggagaaaaatctattggttgttccatcatctggtggtgaaacaagtgtttttcagtggcctcctttccttcttgccagtaagattccaattgcacttgacatggcaaagagtgtcaagaaaaaagatgaagaactcatgaagaggataaagcaggatccttatactgagtatgctgtaatagagtgttacgagacattattagatatcctttacagcattatagttgaacaaagtgataagaaagttgttgatagaatatgtgaaagcatcaaagatagcatccaccggagatcactcgtgaaagaattccgattggatgagcttcctcagctaagtgttaagtttgataagttgctagatctactgaagaaatatgatgagaacgatcctgtaaacaataacacacagattgccaatctgttacaggatataatggaaattatcacacaggatattatgaaaaatggacaaggtatattgaaggacgagggccaaaaacaactgtttgcaaatttaaatctggactcattgaaggatgttgcttggaaggaaaagtgcattaggcttcaattgttgttgacaacaaaggaatctgccatatatgtaccaacaaacttggaagctcggcgtaggatcaccttttttgcaaactcactttttatgaaaatgccaagggcaccacctgtccgtagcatgatgtccttcagtgttttaactccatatttcaaagaggaggtgctcttttccccagaagatcttcgtaagaaaaatgaggatggtatatcaatactgttctacctacggaaaatatatccagatgaatttaggaacttccttgagaggatagattttaaaccaaaggatgaagaagaacttaaagataggatggatgagatctgtccttgggcgtcttataggggtcaaacactcaccagaacagtgagaggaatgatgtactacaggaaggcacttgaaatccaatgccttcaagatacgaaagatcctgctaaatttgaccaagacggattaatagaatcctatcgagagttgcaatctagtattgaaatggcacaagctattgctgatatcaaattcacctatgttgtctcatgtcaagtctatggcatgcaaaagacgtccaaggattcaaaagacaaaagccgctatcagaatatcctcaatctcatgataataaacccatcactacgagttgctttcattgatgaggtcgaagctccaaccggaaatggagcaactgagaagacgtattattccgttcttgtcaaaggtggtgaaaagtatgatgaggaaatttaccgcataaagcttcctggcaaaccaacagatattggagagggaaaacctgaaaaccagaatcatgctataatcttcaccaggggagaagcacttcaggccattgatatgaatcaggataattatatcgaggaagcatttaaaatgagaaatgtgctggaggagtttgagagtagaaagtatgggaagagcgaacccactatattaggcctacgtgagcacatttttactggaagtgtttcttcactggcttggtttatgtccaatcaagagaccagttttgttactatcgggcaaagagttctggcaaatcctctcaaggttcggttccattatggccacccagatatttttgatagactcttccatatcaccagaggaggcataagtaaagcttcaaagactataaatctgagtgaagatatcttttcaggttttaattcaaccatgagaggaggaaatgttacacatcacgaatacatgcaagttggtaaggggcgtgatgtggggatgaatcagatttctagcttcgaagctaaggtggccaacggcaacggtgaacaaacattaagccgtgacatttatcggcttggacgcagatttgacttctacagaatgttatctttctattttactacagttgggttctattttagcagcatggttactgtgcttactgtctatgtgtttttgtatgggaggctttatctggttatgagtggtctggaaagatctattatgctggatgcacggaatcagcagaatgtcaaggctctcgaaaatgcactggcttcacagtctattttccagctaggtttgctgcttgtcctccctatggtcatggaagttggcttagagaaagggttccgcacagcgttaggagagtttgtaatcatgcagcttcagttggcctctgtgttcttcacattccagcttggcaccaaaacccactactatgggagaacaatactccatggtggtgcaaaatacagacctacaggccgtggattcgttgtgtaccatgcaaagtttgctgaaaattatcgtatgtactcccggagccactttgttaaaggactggaactcttgatacttttggttgtatatctagtctacggaagatcctatcgcagctcaagcctatacctatttgtcacctgctccatgtggttccttgttgcttcatggctcttcgcgccatttatcttcaatccatcgtgctttgagtggcagaagactgttgatgactggacagattggaggaagtggatgggtaaccgagggggtattggcatgtctgtggaacagagctgggaagcttggtggttaagtgagcaagatcacctcaggaagactagcatccgagcccttctgttggaaatcatcctttcacttcgatttttgatctaccagtatggtattgtctaccatctgaacatagcagatcaccacaaaagcattatggtatatggagtgtcatgggtggttatgctccttgttctagtagtgctgaagatggtttcaatagggcgacagaaatttggaacagacctgcagcttatgttccgcattctcaagggccttctcttccttggctttgtctctgtgatggcagtcctatttgtcgtcttacaccttactatttctgatgtcttcgctagtatccttggatacttgcctactggatggtgtcttcttctgattggacaagcatgctcaccattgattaggaggaccatgctatgggactccatcatggagctcggaaggtcatacgagaatataatgggtctcatcctcttcctgcccatcggtttcctgtcatggttccccttcgtctctgaattccagacacggctgctgtttaaccaggcatttagccggggcctccagatctcaaggatccttgctggtcaaaagggtattggcgagttcgagtttgagtgaccactaagcttgggcagcgaaccaagttcactttcatatatttgattccgatgatcgatttttgatctgtactctgtagtgtactttcatcaggtttactactttagtccttggaggtactggtttataggtgtatgatctgttgtaatatatacgtatatcaatatcatattactttctatccacacggtctgaattgaccattacaatatgggtgcaaaatttatgattgtaaggtcgaacatatttagactggatgttgctattcaatatttggcattgttttaactgtaatcatagaaagaccagatccattgacccaaaagtcaa

SEQ ID NO: 171 - DNA, 1426 bp, Glycine max
agcagtggtggaagggttgttgagaaggggttttagaagtccacatttttcagatttgattcgcgttcctcttctctcttctcatcatcaatggcgacccccattcctccccctcctgccgccgccgccgccgccgccgccgacaccaaggtcgattacttgaaccttccatgtccgattcccttcgaagagctccatcgcgaagctatgatgtctttgaagccagatctttttgagggcatgcgttttgatttcaccaagatgctcaatcagaagttctccctcaatcacagcgtgttgatgggacctactgaggttccttctcagtccacggagacaattaagattccaactgctcactatgagtttggctcaaccttcattgatcaccctaggttgttgctctggggcagaattttgactgatgggaggctcaatgccagagtcaagtgtgatttgtccgaaaatctcacttttaaagccaatgctcagctcacaaatgagccgcatatgtctcatgcgatgatcaactttgattacaagggaaaagactataggacacaatttcaacttggtaatggagccttgctaggagcaagttatattcagagtgtgacacagcatttatcattgggtggggaggtattttgggctggtcagcatcggaagtctggtattggttatgctgctcgctacaacactgataagtcggttgctacagggcaagttgctagcactggaatggttcttctaagctatgttcagaaggtatctgagaaggtttctctagcatctgagtttatgtgcaactacttgtcaagagatgtcacagctagctttggttatgactacatccttagacagtgccgccttaggggaaagattgattccaatggctgtgtcgctgcttttttggaggagcggttaaatatgggtctgaattttattctttctgcagagcttgaccacaggaaaaaggactacaaatttgggtttggtttgactgtgggagaatgaataaaccgaactggagctgtgttttcattgctgtacccagcttagcaagctttcttgcatctttttccttgttggagatttttctttccaaaaaagaaaagaggaaatatcgtttgtgtcgggaaacactatttacaatccacaagtagctgcagaattttcaatagtcatcaatttatttggaacttgggcagaaaaaactcgatttatttggatctattgccctgttttcccttgagggggatgtagagtgatatcagtttaatccatattgtgagatcaatttccataatgtttctagtgctcgtgtatctatccctgtcctatacttaagtttaaatgacccatgcatgcatgggatggaatcgtcgcagcaagaatgacttggtccgtcatttttctggctgaa

SEQ ID NO: 172 - DNA, 910 bp, Glycine max
cttttttttttcctcggcctcgtagcggattccacaaactcaatcccaaacccgtgccgcgatccacagatttcgcgaaaaatatcacgtgctgacgacacggtatcgcaagtccacctttccccaaaccgtcaattccaattcccacaatcttaaaccttcaaattcttcacctttccttcacttcagagagcgagtgtgagacagacaacaaaacagaatgggtgtggtggtgatcgacggcagcaccgtgcgcgacttcgtgaacgacgaggcggccttcgcgaagagcgtggacgagcagttcggggtgctggacctcaacaacgacggcgtcctctcgcgctcggagctccgcacggccttcgagtccatgcgcctcatcgagacgcacttcggcatcgacgtcgccacgccgccggatcagctcgcgaagctctacgactccatcttcgacaagttcgacggcgaccggagcggcgccgtcgaccgccgcgagttccgggatgagatgaggaagatcatgctcgccatcgccgacggcctcggctccttccccatccgcatggtcctcgaggatgatcccaatagtcttcttcagaaagctgcagatctcgaagcttccaagacctgaatccaaaacggcgccgttttcggttcggtaaacttaatagtaattgatcgtgctttcgtgagttcactttgttttttttttttttccttaataaagggtttatgtagagagcgccctgactgtgtttcgaagctgaggatctgttctgtgtgtaatgtatgtgacactgttattattatggagactgttgatcggttatgtaattctaggaataaagattaaagactcataccggttgctgataaaagaaaaaaaagagtttaaaaagttacggtt

SEQ ID NO: 173 - DNA, 3482 bp, Glycine max
gcgggactcggaattaacaagaagagtgcccaaaagtcaacaatttcgattcttgcccctttcaccaccattacttcttcattcattcattcccccaacctttctcgtctctctctcagaggggatctatgaccagctgatgatggatggtggctgggtattcacctgaatttgttcattcgtgataccctttgattgagtatctgagcaggtttggtagaatttagttagtggattattattttgctgtgagtggaatatgaatcttgattaggttctgtttgttttcttggaagttttgatttttttcacttcaattgtggctttagtacattacattttgtgaagcttgcttcttgatattgggtttgtgagtgttttcttgttagtggcctccttgattttcaatggctaacccaacacaacctaatgttgggttcacccctgagagagagagttcaaaccctgagaagagtccaattccgccccctccaagttttgtagcctcaccacctggttttcctccaccaaaattgcatttacagcaagatcaagcttcttcccgttccgttaaaaccccaaacgttttatcaccagccaatggggttaccactggcagtcctgttcctcacttgagcacccctcctggacccccagtttttacgtcgccggtccgtccagctgctgttccgtttcgtacgtcgcctgcatcacctcagccacttgcattttcttccgcctcttctttgccaacatcatcatcgccgctgcaattttcaaatggatcgtttgagtcgcagcaccaagtttctgatagtatagaggaccatgttcccttgggagagtcatcctttgttctcttttcagctcataaggtattgaaacggaagaaacaagctaatgtacccagtttgggttttggggcattggtctctcctgggagggaggtttcaatgggccctcagataatacagcgtgaccctcatcgctgccaaagctgtggtgcttatgctaatatatattgcaacatattgcttggatcaggccagtggcagtgtgttatatgtcggaaactgaatggaagtgagggggagtacattgcgcacagcaaggaagatcttcacagatttccggaattatcttcacccatgtttgactatgttcaaactgggaacaagagacctggttttgttccagtttcagattccagaatgtctgccccaattgttcttgttatagatgaatgtttagatgaacctcatctacaccatctacagagttctttgcatgcttttgttgattctctcccgccaataactagattaggaattatactatatggtcgtactgtatcagtgtatgatctttcagaagaggctatggcatctgctgatgtgcttcctggggacaaatcaccaagtcaagaatctttgaaagcattgatttatggtactggtatatacttgtcaccaatgcatgcttcgctggctgttgcacattccatattttcatcattgagggcatataaattgaatgtaccagaagtttctcgtgatcggtgcctaggaactgctgttgaggttgctcttgctataattcagggcccatctgctgatctgtcccggggggtggtcaaaaggtcagggggaaatagtagaattattgtctgtgctggcggaccaaacacttatgggcctggatctgttcctcattcttttagtcaccctaattatccttacatggaaaagacagcaattaaatggatggagaatcttggttgtgaggctcatcgacacaatactataattgatattttatgtgctggaacatgccctgtaagagttcctatcttacatcctcttgcaaaaacatcaggtggagttttggttctccatgatgattttggggaagcctttggtgttaatttgcaaagggcatctgccagatcagcaggctctcatggtttgttagaattgcgcacgtcagatgatattctcattactcaagttgttggtcctggggaagagtcacatgtagatacccatgaaacatttaaaaatgacactgctctttatattcaaatgctaagtgttgaggaaacacaaagtttctctctctccatggaaactgaaggagatatcaaaagtgattttgtcttttttcaatttgcaattcagtattcaaatgtgtatcaagctgatgtgtcgagggtcattactgttagactgccaacggtagatagtatttctgcatatcttgagagtgttcaggatgaagtggccgctgtactcattgcaaaaagaaccctgttacgagccaaaaaccattctgatgcaattgatatgcgagcaacaatagacgaaagaatcaaggatattgctctaaaatttggctcccaattacctaaatctaaacttcatagcttccctaaggagctttctctcctaccggagctccttttccatctcaggagaggaccactattgggaagcattattggccatgaagatgagaggtctgtgctgagaaacttgtttctgaatgcatcctttgatctatcactcagaatggtagctcctcgttgtctaatgcacagggaggggggaacttttgaggagctaccggcgtatgatcttgctatgcagtctgatgctgctgttgtacttgaccatggcactgatgtcttcatttggttgggtgctgaactagcagctgatgaaggaagaagtgctgctgctctagctgcatgtaggacattggctgaagaactgactgaataccgttttccagcacctcgaatccttgcatttaaggagggtagctcccaggctcgatattttgtctctcgtctcattcctgctcacaaggatcctccttatgagcaggaggcaagattcccacaactgaggtcgttgacatcagaacagcgaacaaagctgaaagccagttttgttcacttcgacgatcctagtttctgtgaatggatgcgaagtttgaaagtggtgccaccacaaccaagttgatgttggagaccacctaaagggtcttgggtgcatgttccaactcgttcgttattctttgttaagttggtgaagccaagtttgtttgcatgatttggggaacacaatgagatcttgcagatgtcccccgagactctcgcctcagtgcctccctcccattcattttgttcacttaaaacgtccaaaaaattgcaaggtgcaaaaaaagcttttttttggggggtggggtggggtggggggagggatgactgtgacaaagaaatttttcacaattttcggttaagatgttaccatagagcaataaaaggatttctcgttatttatatttataccacttgttggctgccaagtgttttattcaatctctttctttagtctctcattcctagtgcctgcttgttttagattttgtaaattttaactactgaacatgattgagatgcgtttaaactattgaacatg

SEQ ID NO: 174 - DNA, 1433 bp, Picea glauca
atcaattgcattgggcttgtttctcattgcattattgtcttttgtgttgtatctgagaagaagaaatgggggcgtttgcatgtgtgggtttgcttttcttcattgtattgtcctcagttgaagcatggaggccatggcctcaatatttcaatcagactactactgctttgggactgaaacagcagcccaataaggcagatttgcagttcggggcttcgaagaagcatgaagggtcctcgccatatgtgaatatgaggtaccatatgggccctgtgctgacttctgctatcaatgtccatacaatttggtatggaaggtggagtaagaaggagaagagggttatcaatgagtttctgctatctatctctaataatacgaagagcccttctgtgggtcagtggtggcaaacggtccagctctatactgatcagactggtgccaatattagcagaaacatagttattgctaatgagcacgaggattactactcccatggtaagatactgagtaggctgactgttcaggaagtgataaagaatgccataaccaccaagagtagtccccttcccattgatcccaagaatggtctttaccttctcctcacttctagtgatgttgctgtccaggacttctgcagagctgtctgcggatttcattattttacattcccatccattgtaggatacacactgccttatgcgtgggttggacactctggaaaacagtgcccggaagtctgtgcttatccttttgcagtgccaagttacatgactggaatgaaggcattcaaggcccctaatggggatgttggtatcgatgggatgataagtgtgattgcccatgaattggctgagctttcgtcgaatcccctgatcaatgcctggtatgctggtgaagatcctactgcccctactgagattgcagatctctgtgaaggcctttatgggactggaggcggtggatcttacactggacaagtccttacagacaaatttggggccaattacaatgtcaatggcattaggaggaggtatttagtgcaatggatatggagtcctattatgagtgcctgttctggaccaaatgcattggatagctgaaggtgatctagtgctcttgttagtggaaaatgggtttgctagtgttacggtcagactctggggtttgtctcaagccttactatcacaaatgctgtttgtgggttggatctagccagcttattcattgcttctttattggtatagacctcaatatgccttaggaatattgtacccaataatgcagcaaagtgttctggaacactcgaggctctaatcccatttttatttcttgacagtatgtagtggctgtttttcttttaacggtcatcccactgtgtgtgcgtgtgtctatacagctttatctatttagattattcagagaaatcttgagca

SEQ ID NO: 175 - DNA, 3023 bp, Helianthus annuus
accctaacactatcacagaaatggcgggaggaaataccggtggagagaaccgtcccaacgagtcgccgtcatcgtcagatcacggcggaaacctaaattccagtcagtttaacggcaatccaccgtccacaccagattctcctacctctgctggattcaacacagatcagcttccgttcaacagccgtacgtcggaaaactactcagattacgacgacgatgaagccgctgtcgatccggatatcatccctgacgaaccagaagatatcggtgatgaagaaggtgaaggtgaaggcgaagatctgtacgacgataattacatcaatgattaccggaggatggaagagcacgatcagtatgaatcggttggattggatgaatcgcttgaggacgagagagatctggatcagattatggcggatcgtagggctgcagagatggaacttgatgctagagacggtgttgcttctcaacggaagcttcctcatctgcttcatgatcaagacacagacgatgaaagcattcgtccttcaaaaaggactagagctgattttagacctcctcctagtccagcatttagcagtggtggtggcggcggtggaggtggtgatgacccacccactactgatcagacagatgatgatatgtttgatgatgatgataatgatgaaggtgagttcgagatgtatcgtgttcagggaaccctaagggagtgggtcactagagatgaagtgcgtcgttttattgctaagaagttcaaggaattcttactcacttatgaaaacccaaagacccatgatcatgattatcttacacaaataagggaaatgattgcagtcaacaagtgcagtctggagatcgactataaacagtttatatacacccacccaaatattgccatctggctggcagatgcaccacagtctgttctcgaggttatggaggaagttgctaataaagttgtatttaatataaatccaaattacacaaagattcaacaaaaaatctatgtcagagttaccaacttacctgtttatgaccaaattcgcaacataaggcaaatccatttaaacactatgattcgcgtaggaggtgttgtgacgcgaagatctggagtttttcctcagttacagcaagtgaaatatgactgtaacaagtgtggggccgtcttgggaccctttttccaaaattcatattcggaggtgaaagttggctcctgcccggagtgccagtcaaagggaccgtttacagtcaacattgagcagactatatatcggaattatcaaaagcttacccttcaagaaagccctggcattgttccagctggcagattgccacgatacaaagaagtgatacttttgaatgatctgattgattgtgctcgccctggggaagagattgaggttacgggaatctacaccaacaactttgatttgtcactgaacaccaaaaatggattccctgttttcgccacagtgattgaagcaaaccatgttacgaagaaacaagacttattttcagcgtataaacttacccaagaggacaaagaagaaatagagaggttgtctaaagatccacgtattggagaaaggattgtcaagtcaattgctccatcaatctatggtcacgaagatataaagactgcaatcgcgcttgcgatgtttggaggtcaagagaaaaatgtgaacgggaaacataggttgcgaggagacataaacgtgctgctgttgggtgatcccggaactgcaaaatctcagtttttgaaatatgttgaaaagacgggtcaaagggcagtttacacaactggaaaaggagcttctgctgtaggtcttacagcagcagtgcacaaggatccagtcacacgtgagtggacccttgaaggtggggcccttgttttagctgataaagggatatgtctaatagacgaattcgacaaaatgaatgatcaagatagggtaagtatccatgaggctatggaacaacaaagtataagcatatctaaagctggaattgtaacttcacttcaagctcgatgctctgttattgctgcagctaatccaattggaggaagatacgattcctctaaaaacttctcacaaaatgttgaattaacagatccaattgtctctagattcgatgttctctgtgttgtgaaggacgtggtggaccccgtcatggacgagatgcttgcaacgtttgtggtggatagtcattttaaatcaaaaccgaaaggtgctaacttggatgacaagtcggtcaacaattctcaggaagatattcacgacactgccatgttagcagatcctgagatactttctcaagacatgttaaagaagtacatcacatacgccaagttaaacgtattcccaaggttgcatgatgctgatttagacaaactcacaacagtctatgccgaattaagaagagaatcatcgcatgggcaaggagtaccaatagctgtaaggcacatagaatcaatgatccgaatgtcagaagctcatgctcggatgcatctcaggcaacatgtcactcaagaagatgttgacatggccattcgtgttcttcttgactcgtttatttccactcaaaagtttggagtgcagaaggcccttcagaagagctttaaaaagtatatgacattcaagaaggatttcaatggaattgtgttgcatctacttaaccaactggtgaaagaggcgctacgtttggaagagatagtttccgggtctaggagagatgttacacatgtggatgtgaaggtggccgacttgcaaaacagggcgttggattacgaaataaccgatctgaaggagttttttacaagtacggatttcgagcgtggtaactttgagctggatgaagaaagaggtgtgataaggcatctgcttgtaagatgaaccaagtgttgtatggttgaaactttttaatttgccattgaaatttggaagaaacagttttacattatgagatgaagtacttggattaagctgtcagtaatttattatcaactatttgtagcttat

SEQ ID NO: 176 - DNA, 1452 bp, Helianthus annuus
ccctcttactaaccattcccaaccataaccatgaaagactcaccaaaaccatggaaaccacactgttgttcatctgaaagcaaggtttcattcagctttagccggtgcaggccctcgagatcagagttttccaagaatgtagcaccatgtccatcttttagacgcttgtctttctcggaccttagcaggtcttcttctatgtgcattaatgaagacatagcgcaggcttttgggcctgatttgattgactttaaattgagtgagttgcgagccatgactcagaatttctcgagcagtttcttgttgggtgaaggtgggtttggtaaggtgcataagggttatgtggatgagtgcatgaggactggtttgaaggcgcaacccgttgctgttaagcttcttgatattgaaggactgcaaggtcatcgcgagtggcttgcggaggtgatatttcttggtcaacttaagcacccgaatttagtgaaactgatcggctattgttgcgaagaagaagatagacttctcgtatatgaattcatggcgcgtggaagcttggaaaatcatttgttcaagagaatttctgtttgtctaccatgggggatcagaataaaaatcgcgataggcgcagcaaaaggtctcgcgttcttgcatggtgccgaaacccctgttatatatcgcgacttcaaaacatcaaacatcttacttgattctgagtttaatgccaaattgtctgattttgggctggcaacaatgggtccagaagggtcaaacactcatgtcactactagagtcatgggcacatatggatatgctgcccctgaatatgtcaacactggacacttaaccacgaagagtgacatctatagttttggagtggtgttgctagaactgttaacaggaagaagagcaatggataaaaacaggccaaaacgcgagcagaatcttgtggactgggccaaaccgtacctgactagcagcagaagaattcgtgcagtaattgaccctaggttgggaggtcaatattcagttagaggggccaaggagatggcccttttagcattgtattgtgtgagtccaaatcctaaagacaggccaaagatgccttcaataattgaagtccttgaaagtgttaagcatttcaaagacatggcaatcacttgtggacaatggccccctgcttcacaaaagacctcacgaaacgcggtttattcgccaaaagatgcgaaagagatcaacggggggcggatttactggaaacagactcctgttaagaccgtaaggtcaagagggtaattaaccgacatgaagattgagtagagcggaagaagaacatgtaaataacaagcacatatatgtatataaatatgatatgtatcgtatcctgtcgtgttacttatatgtaaaaacacagatgttatataatatatatacaagccttaatcttcattcgaactg

SEQ ID NO: 177 - DNA, 1058 bp, Helianthus annuus
gttgcggggtggccggcgagcatggtggttgccgtccaccaccccactctatctctttatctatacccaaccaccaccggcgccaccagcccccacctaccaccgccactgttaacaccaccttcgaactaatcttataaagaatttatcatcagcccacatattcttcacatttcaaaaccccataatttctgtgtgtggtcgttggagatttgactaaaaaaaggaagcgttccctccacgcgccgcccacgagcctataaatacaaccaccaacccacacaatcctccttgcaattgctaccgtcaatatgcagactctgcaacagaaagcttcagaatggagcggcgttaagcaggaagacgcctttgctattgaccaagttaatctttttgacaaattagggctccaacctttcatcaatctatctactgatttttacacaagggtttatgatgatcaagaagagtggtttaggtctatttttgccgattcgaagaaggaagatgcaattcagaatcaatatgagttttttgtgcaaagaatgggagggcctcctttgtactcccaaaggaaaggtcaccctgctttgataggccgccaccgcccttttccagtgactcataaggcggcagagaggtggctacaccacatgcaacaagcgttagataacgccactgacattgatcaagaatcaaaaaccagaatgctaaatttctttaggcatactgcatactttttggtggctggaaatgatctaaaaaatgaaagccaaggacctccaccttgtaagcatggaaataacaaaccagctgcagattaatttttttttttttttttgggttcagaaaagaagtgatttaaacagatttgttacccaaaagggacacaaatgcatgtaccttcaattatagatttgaatgataattggtcttttcttcatgtactcatgagccgagctagggcgaggtttgttgacccttcgactgatcaaattttctatattgtcaccggtgctttaagttaatgaatgtaaaaagattatgttgtgatcccc

SEQ ID NO: 178 - DNA, 988 bp, Helianthus annuus
cgatcatcaaattcttcatctttctcaagcatccgatcatggccaagattagggcttttttcatcctcgctcttcttcttctctcttcttctttcttccttcaagttgctaggtctcagtctgatccagacgcagaagcggatgccgaacttgtggcggaaactgtcgaggaaggaagtcatgttggtgacgatgttgaggatatcggtattgggaattataatccggctcctggtgtggaaaccgtgtcggttttccctaaaaactttgcgaaattggtagtagcaggacaagaaactgaacttttgattggattgaaaaacgaaggagaacaaaacgttaaggtttttgctgttcacgctagtattcatcttcctttcgatcatcggatgttggttcaaaacctctctacagtggctttcaacgatgcatcggtccctgcttcagttcaagctacatttccctatacatttgctgtcagcaaattcttgcagcctggaacatttgatcttgttgggacaatagtgtacgagatcaaccaactaccataccagaacgtattctataatggcaccattgaagttaccgaagccggtggtcttgttagcgttgagaccgtgttcttggtgtcacttggacttgctcttctcgtgctcttcggcttgtgggtccgcactcagctacagtctctttccaagaaaactaagaagataactaaggtggaagttggaacccgaactgttgatgcatcaatggacgagtggctgcagggaactgcttatactcaatcacagtcgaacaaactgaagaagaagaagtagagatgtagttttcgatgttgagcaaaggtagtcggttgtagagcgaccaacattctcgttttctgttgagttttaactagcaattacaggcatttgttttctttttagagtgttttatatacctgcaattttagttttggcaaattttcaacgactttccaatcgtt

SEQ ID NO: 179 - DNA, 774 bp, Helianthus annuus
tcccacccacacaaacaaaccaataactatatattaatacaatatccacattcaaatcaaaccaaaaatgtctcttgtgacaaaagcaattagggaaagtgcatcagaaatttatcatggtgatgcaatttgtcaagaaaaatcaaaggaattactaaccgaaatgggactacccaatggtcttttgcctttagaggacattgtggaatgtgggtatgtcaaagacaccggttttgtgtggcttatacaaaagaaagagaagaaacacaaatttgaaaagatcgggaagcttacaacgtatggaacggaggtaaccgcatatatagagaagtttaagatcaagaaactcacgggtgttaagtctaaggagcttttgatgtggatcacactgagtgagatcactcttgataacccgcccactggaaagatcaactttaaggccacttctggcctttacagatcttttccagtgtctgcttttcaacttgacgatgtgaagaaagatgttggaggcgcgagtgtgactaaggatgcccaagtgaaggaggtttgagcaagtgatgaagtttaatataatatataacaatatgaagtaatatttatgatcactttcattttatgatgttgtaccatcttatcaataattatagatctaatgcatcatgacttttgtttcaaacatgaagagtaaatgtttttgtgccaccacaaaatagttatcttgcaaaatacgcgtaattatcaagaatcagtcaagtttgggtcgttacatag

SEQ ID NO: 180 - DNA, 1795 bp, Helianthus annuus
aaccctaacttctattttcatcaattttcagtgaaattgattcttgttgcacatggcggaagagacgttgaacaccacggcggctgcggcggagtctacggcggtgacggctgaagttgccgtggctccagaggcggagaaggttgaagaagctccggtggtggtttgtgaaaaggatggatcgccggagacggagaagatctctgaatcgacgtcgtttaaggaggaatcgaatgttgccggtgagcttcctgatccggaaaagaaagcgttagatgaattgagacttatggttcaggaagcgcttaataagcatgagttttctgctccgccggcagcggcggcggaggagaagccggtgaaggaggaagttccggcaaaggaggagaaagctactgctgttgttgaagaagaagctaaggcttgtgctgaggccgccggaaaggatgaatcgactccgtctcaggcgacggcggtcacgccggaagttgtaccagtgacggaggttccggaaccggagaagaaggtgtctgaaacggagacagaagttaccgaaccggagaaaaaggtgaccgaaccggagaaagaggtgccggaaccggagaaggaggtgccagaaccggaggagacaactgaaccggagaagaaggtgactgaaccggaaacaaaagagaaaactaccgaaccggcgtctgaaccgggaagaagtttcaatttggggaatacgttactagcggacgagcgaagcgacgtcattctgttaaaattcctgcgagcacgagacttcaaagtaaaagaagctttcacaatgctcaaaaacgtcgtcgcatggagaaaacagttcggaatcgaatcactgttgtcagaagatttgggaacagaacaagaaaaagttgtttacatgcatggagttgacaaagaaggtcatccagtatgctacaatgcatatggtgagtaccaaaacaaagaattgtacaatgaaacgttctcaactgaagagaaaaggacaaggtttctgagatggaggatccagtttctcgaaaagagtatccggaagctcgattttagtccgaatggagtgtgtacgattgttcaagttatcgattttaagaactcgcctggaccgtttaagtgggagcttcgtcaagctactaatcaggcgcttcagttgtttcaggataattatcctgaattcgttgcgaaacaggtgtttatcaatgtgccttttctgtacttggctttctataagattatcaatccgttcttcacacaaaggaccaagagcaagtttgtgtttgctggaccttctaagactgctgaaaccctcttcaaatacatagcacctgagcttgttccagttcaatatggtggactcagcagggaaggcgaatttgtctctactgactcagtcacagaagagatcatcaaaccttcaaccaaacacaccatcgagatccctgctcctgagagttgcacattggtatgggaggcaagagtggtggggaatgaaatgacatatggagccgagtttgtgcctgtgtctgcagacagctacaccgtgatcgtgcagaaatcaagaaagcttgcagctgccaccaatgagccggtgatcagcggccagttcaaatgcgatgaaccaggcaaagtggttctgacctttgacaaccaaacctccaaaaaaaagaaggtcctgtacagaagcaagaccaaggtgactgaatccatcaagtgctaaagccagaaccaaggcaggggatgtttgttgaataatgaaaataggtttcatttttgtggg

SEQ ID NO: 181 - DNA, 2708 bp, Helianthus annuus
ataacaaactctaaaccctaagtccgccataaccgcttcttctcctccgcattttcctgaattccggcgactattgcggggggagagattcgtatccactcgtaacacaattgcttcttctgtatgtcagtagattgtacgcactgcaacttttacggtggatttggtgagcttgctaaccctctgcaatggccgcaacttcgcaaaaggcgtcgcattcttcttccgatgattccgtctccgttcaccgccatgtggtctccgatgactggcggaacgatgatcagaacatgccgatcaagagttcttccattgtttcgttgattaatccgactgattctaacgccaatgcttctgccaaaggaatccaaattctcacaagggctcaaactagccatcctttggatcccttatcagctgctgaaatcaaagttgctgtggcaactgtaagggcagccggagcaacccctgaggtgagagatggtatgcggtttgtggaagtagttctatcagaaccagataaaaccgttgtcgcactcgcagatgcatactttttcccacctttccagccttctttattaccccgaaaaggtggagctattatacctagcaagcttccgccaaggcgagccaggcttgttgtttacaataaaaagtcaaatgagacaagtatatggattgttgaactgtctgaggtacacgcaacaactcgaggtgggcatcatagagggaaagttatttcatcgaaaactattcgggatgttcagcctccaatggatgctgtggaatatgctgaatgtgaagaagttgtgaaagattaccctccctttcaagaggctatgaagaagaggggcattgaagatatggatctggtgatggttgatgcttggtgtgttggctatcatagtgaagctgatgctcctagccgcagattagcaaaaccccttatattctgtaggacagaaagtgacagtccgatggagaacggatatgcacgtccagttgaaggcatctatattctcgttgacatgcaaaatatggttgtactagaattcgaagaccgtaagcttgttcccctaccacctgctgatccgttgagaaattacactcctggtcatactcgaggtggagttgacagaagtgacgttaagactctacaaattatccagcctgatggaccaagtttccgtgttaatggacaatacgtcgagtggcaaaagtggaattttcgtattgggttcactccaagggagggtttagtaattcattctgttgcatatgttgatggtagtcgaggccgaagacccatagctcatagattgagctttgttgagatggttgtgccgtatggtgatccaaacgatcctcattatagaaagaatgcatttgatgcaggcgaagatggcctcgggaaaaatgcccactctcttaaaaagggatgtgattgcttgggttatatcaagtactttgatgcacattttacaaacttcactgggggcgttgaaactatagaaaattgtgtatgtatgcatgaggaggatcatggaatcctttggaagcaccaagactggagaactggtttagctgaagtaagaagatctcggcgactcacagtgtcttttatatgcaccgtggctaactatgaatatggtttctattggcacttttaccaggatggaaagattgaagctgaagttaaacttacagggattctcagcttaggagcactgcagcccggggaagttcgaaaatatggtacaactattgccccgggtttgtatgcaccagttcatcaacatttttttgttgctcgtatggacatggcagttgattgcaagcctggagaagcatacaaccaggttgttgaagttaatgtcaaagttgaagaatctgggaaaaataatgtccacaataatgcattctacaccgaggaaacattgcttaaaactgaatctcaagcaatgcgtgattgcaatcagttatctgcccgtcattggataattcggaacacgaggaccgtgaacagaactggacagctgactggctataagctcgtaccaggttcaaactgcttgcctctggctcgtccagaggccaaatttctaagacgggctgaatttttgaaacataatctttgggttactccttgtgcacttgatgaaaactttcctggaggtgaattcccaaaccaaaatccacgtgtcggtgaagggctcgcctcgtgggtcaaacaaaaccgttctcttgaagaaactgatatcgtcctttggtatgtgtttgggatcactcatgttcccaggttagaagattggccagttatgccggtggagcacattggctttatgcttcagccgcatgggttcttcaactgctcgcctgcagttgatgttcctccaggagcctgcgagtcggatgtgaaagacaccgagcataaagaaaccattgcttccaagcctgtttcaaacggtttgattgccaagctttaatgtaatcatcatcaacaaagtcgacttttttatcgccccttatctatttaccatgtcgtttaaacctttttaatttgtatgattttagacgctagactttggttgtgtaatcatcatcaggctctggttcggtttcagttgctatcctcgtttaaacctttttaatttgtatgttttatgtttgtactttctcaaggatcatagatgatgaaagttggtttg

SEQ ID NO: 182 - DNA, 2192 bp, Helianthus annuus
aaaaacacagtccagacagcaaagcaatcaacaccctcctcaccctgaatcaaactcaccacaaataccccgtttcaactcacacagatcttctgtatccgatcccaacacacccaaaaccaaacaatgggtcgaatcaaagacataatcgtcactttcttcaacaacagatggctcgtttttgttgcagcaatgtgggttcaatcgtgtgccggtatcggctacctgtttggaagcatatcaccggttataaaaagctcattaaactataatcaaaaacaggttgctagattaggtgtagctaaggatcttggtgacagtgttgggtttttggccggaagtatgtcggagtttttaccgatgtgggcccttctacttattggtgctgttcagaactttgttgggtatggttgggtctggcttgttgttaccggcaaagctccgatgttgccattgtgggttatgtgtttgctgatatttattgggactaacggcgaaacctacttcaacacggtggcattagtttcgtgtgttcaaaactttcccaagagtcgcgggccgattgtgggaatactcaagggatttgcagggttaagtggtgcgatcttgacgcaaatatacgcgttgattaactcaccggataaagcgtcgcttatattcatggttgctgtcggtcctacgatggtggggatttctcttatgtttattgttagaccggttggtggtcacaggcagcttagaatatcggaccggtcgagtttctctttgatctactgcgtgtgtctcgttttagcggcgtatttgatgggggttatgcttgtggaagacttggttgatctgaaccaaactatagttcaaatattgacatctattttgtttgtgctattagtgcttcccattgggattccgttatggttgactttttcgtctgacccgagaccctcggaagaagaacctcttatatccgaatcgcaaaacaaagaccaacccgaatcgtcacatgatccaaatgagattatattcagtgaggtggaagatgagaagcctgcagatgtagattcgcttccggctaatgaaaggcaaaaaagaatcttgcagttacagtcaagattggcccaagctgctgcggaaggggcggtgaggattaagaggagaaagggcccgcatagaggcgaagactttgaccttacacaggctttgatcaaggctgatttttggctcctgttttggacccttttacttggttctggctcgggtttgactgtgattgacaatttgggtcaaatgagtgagtctttggggtacgataacacgcacatatttgtttccatgatcagcatttggaatttcttgggccgtgttggtggtggctatgtttctgagatcgttgtcagggactacgcctatcctaggcccgttgctctagctgttgcgcaaggcataatgtcaatcgggcatttattctttgccatgggttggcccggtgcaatgtacatcggtacccttttgatcgggctaggatacggggcacactgggccatcatacccgctaccgcatctgagttattcggggtcaaaaagtttggagcgttgtacaatttcctcacccttgcgaatcccgggggttcactagtcttctctgggctcattgctagctatatatacgactctgaagcggagaaacaagctaaagaacgtggtgaaatcatcataaagtcaacttcttctatgctgaccaaactatttgaaacggatgacgccctaaaatgcacaggttccatatgtttctttctgacttacatgctaatgtcgggactctgtatcatagctctcatcctaagtttgatacttgtgcgccgaactaaaaccgtctaccaaaacctctacgggaaaacccgaacttgaaatccttcaattgatgaaatgatcaaaagtatcaaataccaggcgtatctcgtcggttcacgtcattcaatatgttcgattttggagtcttgaatttggtttgtatatcgtgttttcaacatttgttttggattgaagttttggtatgcagttttattgtaatcttattaaaatatgtaacaatctgtgtgaaaaaaatattacatataatcattatttatttgctctgatgcagtatgggccttgtatgctaaacgtacccgtattgattataagttgaaaaaaaa

SEQ ID NO: 183 - DNA, 1508 bp, Helianthus annuus
actccccgacaccttatcatcatcatctccaccaccaccatgccgacggcaacggcgatttctctctcaatcctcttcctcctctccctcaccaccaccatccacgcccacaacatcacccgaatcctcgcaaaacaccccgaattctccaccttcaaccactacctcaccatcacacacctcgccaacgaaatcaaccgccggcaaaccatcaccgtctgcgccgtcgacaatgccgcaatgtccgacctcctctctaaaggcttatcaatccaaaccatcaaaaacgtcctctccctccacgtcttcgccgactacttcggctccaaaaaactccaccaagtcacaaagggttcaacctccaccgccactatgtaccaagccaccggcgaagcccctggcactgccggttacgtacatataaccgatgtcaaaggtggcaaggtccgtttcacacctgaagataatctctcccaaacagactcagtgtacgtcaaatctatactagaaatgccgtacaacatttctgttatacaaataagttctatattacaatctccagaggctgaagcgcctactgccgcaccagatctgaacctaacctcgttgttagaccgagatgggtgtcagtcatttcataacctgttaactacttcaggtgcaattgggacattcttaagcagtgtagaagccggtgtaaccgttttctgccctgatgatgacgctataacagcttttgctccaaaatataaaaatctaactgctgcagaaaagacatccttgttgctgtaccacggaattcctgtgtataattccatggggatgctacggtcgagtaatgggttgatgaacactttggctactgaaggagctaaaaagaagtatgattttactgttcaaaatgatgggaatgatgttaagttgaagacgaaagttgtgacggcgacggttactggaacggtggtggatgacgagccgattgcgatttatactcttgataaggttttgcagcccagagagttgtttaaaggcgcggttgaggaagcggatgaaccggcgcctgcccccaagggggcgaagaagaagaagaaggcagcaaagaaaggagatgaggcggaggaggatgccgaggcgcctggaccgggttcggatgaggattatagtgatgatgatgcggcggatcagacggcgagtagtggtgaaagggttgtggcgatggtgtcggtggtggttatggcggtggtgttgaatttgttttaatttgttttttcattttttttttttgatgtgtgtcggtgtgataaagtgacagcgggtatcatgggtctcccacgagagttgctcatgcaggaatagaattctctttttatttttttgtttttaatttatgatttaaagatttttatcttgttttatttatcataaacgaaaaataatgagtcttttttttgagttcctatgcattgtaattaattgttttgtttataaaatggaaaatgtttgtatga

SEQ ID NO: 184 - DNA, 1698 bp, Helianthus annuus
atcccaatctcaatcacaccacccacgatattgatattaactgaaacccccaatctcgtcaatgccgatagatcaagccgacctcaattccgatcaggttttgaggagggacattccatgggagacctacatgacaagtaagctgatcacaggaacagcccttcagctactaaggcgctatgacaaaaagagtgaacatgatagagcaccactgcttgagaatgatggtccgtcttatgttcgtgtgtttatcagcatcttgcgtgacatacagaaagaggacactgtcgaatatgtgttggctttaatcgacgagatgcttacagaaaaacccaacagagcaaagttgtttcatgacaaatctcttgcagatgaagatatttatgaacctttcttgagattgttatggaaaggtagctggtttactcaagagaagagctctaagatacttactttagtcgtgagtgccaggccaaataagaatggtttgaccgcaaatggaaaagccacagattcaaagaagaaaatcaccacaagtgatgatgttttgaaaggattagttgagtggctttgtattcagctgaaaaagccttcccacccaaaccgtagcattcccgtttctatcaactgtcttgcagctttgttaaaggagcctgttgttaggtcttcatttgttcaagcagatggtgtaaagctgcttgtgccactaatttctccagcatccactcagcagtcaattcagcttctgtatgaaacatgcctctgtgtttggctcttgtcctactacgaacccgcaatcgagtacttggctacatctagagccctgccacggttgtcggaggttgtcaaaggttcaacaaaagagaaggttgtgaggttgatagtgttgactttcaagaacttgctttcgaaaggaagctttggtgctcagatggtagatattggactcccacaaattgttcaaagtttgaaagcacaagcctggagtgatgaggacctcttggatgctttaaatcatctggaagaagggctgaaagataacatcaagaaatcgagttctttcgataagtataagcaggaagtccttctcggtcatcttgactggtctccgatgcataaagatcctaatttctggcgagataatattacaaattttgaagagaatgatttccagactctaagggtcctgctcacgatactggaaacatcaagtgatccaagggcactagccgtggcgtgctttgatctgtcccaatttattcagtaccatcctgcgggccgagtcatagtcactgacctcaaagcaaaagagcgggtcatgaaactgatgaaccacgagaatgcggaggtcaccaaaaacgctttactctgcatccaaaggctgttccttggtgccaaatacgcaagctttttgcaagcttgatatgcatctctcatggggccttctctgttaaaggcttgttgttttgaataaaatttgatgtctgtatttttttatgctatttatggatggtgataaaataaaaggttttgagagctattcatatttattattcaaacagtactgtgattttaaaccttttacattaaaagttttacttttttacaataatttaatgtaaagttttacagtattatttttatagctgataatattattattattttcaaaaaaaaaaaaaaaagggcggccgctct

SEQ ID NO: 185 - DNA, 1029 bp, Helianthus annuus
atagattgtcaattggctccagtgagagaagacagaaaaacatcacatgattttacaactttagttttggttgagatgatgcgtatgatgtgagcttcaattgttacctgttaaatttgtagaagaaattgttgagaaattggaaacatgatgtcccctggaattaacttggtgatgactgtaatcggatttacagtgagtactatgtttatagtgttcgtgtgtacgagacttatatgtgctcgtattcattacatatcttccagaagatcctttcgtatgtcttctagatctgatctcaacgctatggagcggggcatgcgtggtgctgaaacttttgttgcagcaagcttccctacaaagaaatatagcgatccgtttttttcgtgctcaaaagatgctcaatgtatagtttgtctttcagaataccacgcagatgacacccttcgtattctgccctcgtgtggacactttttccactcatcatgtatcgacatctggctgcagcagcactgcacgtgtcccgtatgtcgagtctcattgcgtgaagtttttgacaaaaggtgcttaatgcaaccgatgttcagttcggctgtcagattcccatcaagcgcggatgacagccgtaggatggacccaaccactaatggtcaaccaaggtcaactggcaacgtacaagaagcgggactacacaactcaaacgtcagcgagaacgttcctgctggctcaaaaagtcccgggaacaaacaatttgaaagcccgtcggatgtttaattaagatcacatatgtgtgatcaaagtttgtagcttttgagtgatggtaaagtgtgaaagatgttgggggtgttattgtctttttaggaatttgtttgttttggctttaccagtagtatttgtatatatttgaagatcagaaaagtttgatgagtagattgttgtcatagttgtatacgtatatagaaagttacctttggtaaggaagtttctttagtgttttactaaagtcgcttacactttctttcaaactac

SEQ ID NO: 186 - DNA, 1456 bp, Helianthus annuus
aaggcaaaacattgcctccgtgtctccttgaggtattcaacctctctggtgccacctcttccacacatacatactcaccctcaactgccttgccttcagtacaaatggttatcgcatctgctagaatcagtacttgtggttcaatggaactagctccagcttcattcagtacgcgacatgtaggtcgtgactgtgtttatctcaaaagtacgagttcccagtggctgaagaagccgcctcgatggtttggtttttcccatgacaaaataagtaaatttaatcattcagcttgctcggtgagtatggtgtcaaataattatgttggaagaagcacttacagaattaagaaggataatgatgataagatatatcggaggcttgattcttgtttagttattcctccacctaaaggcaagaagccgaaagccgttattaaattccttggtggcgcctttattggtgcagttccggaagttacctatagctatcttcttgggctattggcaaatgaaggctatcttatcatttctgtgccgtataacgtaacttttgatcactcgcaagctgcaagagaagtctatgagaggtttcattcctgcttgaattcaatactaacatcaggattgcccgatgatggcctgttagcagccgaacttgttgatcttcctctttattctgttggtcatagtaacggtgcgctacttcaagtactcactgggagctatttttcggataagctaccaaaggctaatgccataatatcatacaacaacaggccagcaacagaggcggtaccctacttcgaacaattaggtcctctagtaagccagttgatgcctgtcgtggaagcatctccggtatcttccatggctaagggtgctgcagatgcgtggaaagccctgcttgataccgccgaagcgatgacgcctgattatgatcccgaagctagagtttcactggacaagtttgttgatcagttgccttcagtttttaatcaggttgctcaaggaatatcggaattcaaaccgacaccaactgagaaccgtgaatgttgcaagaactcgtataatgtcaagaaaacactcctggtgaagttcaatactgatgccattgatgagaccgatcttcttgaggagactttgaggcctcgtgtggaagctataggtggaacgcttgaaaaagtttcattgagtggtaaccacatcacaccatgcatccaggaaccaaaactgcaagtaggtgatgtatacactccagcggacgcgatcgcgcaagggcttaagaatctttcgctaaatgagactaaagtcgcggccagaaccattgcagactggcttagcagcattagttagtaattgtaagtgctagttactttgaacttaactagcttcagccaaattgtgtgaatattaagttgaaacacacgtacatctacatgccgtaaataaaattgcta

SEQ ID NO: 187 - DNA, 2139 bp, Helianthus annuus
acaacaacatcatcatcattatcaaaatattcattaaaatctcagaactgaaaccacttgtctctctctctcttactttcaatgctgagcactactactgttctctgaattccgggcagttcgggcagctccatagttattgtgattttgaattccaagactctatgaaattctggtcttgggatcatccttgtgcataatttgttccccacaaccacacatccatgacataatttcagaaagttgaatataaagacttgaagaaatgtcatcttacataagaagttcagaaaatgcaagagattcaactccaatgctctacttaagagaacctctacagcaatcatactcatcggaaccacccattctcgccggaaacgagatgatgtatatgaactactcatcatcttcagccggagagttttccggttcactcgctggaaactcccagcagctcaacagctgcattgacattccaaacataggagttcatgattccaacgttgtatcgcatcaagaactcctctcgagcattggcgaaccatggagagacggtaggaatcatggaatgatgttaatggatcaaatgggtagtcgaaattcgcaaggacaaggactatcactgagtctgggttcgcatattcaaccggccggaatccaattccattccggtgattacaggaatcccaacatggggttctcttcgtttttgagtgcggattccgactctatcaaaacagatgtttctaattctccctatggaatgggaaatgggtcgagggggattacggattcgaggtacttaaaagcggcacagcaactgcttgatgagattgttaatgttggtaaagctttgaaacagcataatgctaggaaagaagcgatggattattcgaaagagatcgatagtgaagcgaagaatgtagcgtcgtctaatcaacaagaagcgaacgaactctcggctgctgaaaaacaggatttgcagaacaagatgatgaagttgatttctatgctggaagaggttgacagaaggtacaagcaatactatcatcaaatgcagattgttgtatcggcatttgatgtgatcgcgggatgtggggctgctaagccctacacagcactcgcgctgcaaacgatttcacgccatttccgttgtttgagagacgcgataaatggtcaaataaaagcgactcatagaagtctcggggagactgattctaccgcaaatgagaaaggagtcgggatttccaggcttcggtttgtggatcaacagctgaggcaacaacgagcacttcagcagctcgggatgatgcaacaacatacttggagaccacaacgaggccttcctgaaacctctgtgtcgattcttcgtgcttggttgtttgagcattttcttcatccgtatcctaaagattcagacaagaccatgctagcaagacaaactgggttgaccaggagtcaggtctcaaactggtttataaacgcaagagttcgtttatggaagccaatggtggaagaaatgtacaaagaggaagctggagatgcagaaatagaatcaaattcttcatcagaattcgcacccaaaaccacgaaaggcgatcgaaagacttctgttgaccaagaagatctgaaccaaagcactgcagcctctggattcgactcaaatcaagctcctaatgttgaattaataggaaccagcaatgactcggatttccaacacatgatggttcaatcaaacagaggtgaacacgaacggcttatggcggcagcatatcagatgccaccacagttagtatcgcttacactcgggttaaaacactctgaagatggtggcttaccaccaatggcttctcatggaagaggtgacggtgacagtggttcgtcggtggggccagaggcggtcgattttgacggtgtgagttcagataaccaacaacaacgttatggatcttctcacttgttacatgattttgtagcatgagagaacactggcgggtggctttattcgaatcatcaaatgaacattttgttaaacttcttgatttattatcaagtagtgtgaagaaaacaggacgcgaaacagaaactaaatgtataactgtaaagataagatgcatataacttctttaccataatatt

SEQ ID NO: 188 - DNA, 1770 bp, Helianthus annuus
tttgatttttcttattaagatcttcttcattttatattagcatcatgagtagttctctgaactatgatgcactaaatttcaaactcatattcttcaccatcctccttatcaacgcaaccgcattgaccaaccaaaaccctaaatccaactcaactcagactcagatcaactccaactcggtcctcgtcgcccttcttgactcacactacaccgagttatccgaactcgttgaaaaagctcttcttctacaaaccctagagcaagcagtttcacaacacaacattaccatcttcgcacccaacaatgaagctctcgaacgccacatggatccagaattcaaacgctttttactcgaaccaggaaatctcaaatcactacaaaaattattgctttttcacatcattccgacccgggtcgggtcggaccaatggccgggtcaggatactggatcagtagcagtaactcatcataaaacgctctgtgtggaagaatccgaaaatcgtttaccgttgacccgtggaaattccggggagaaaatagtgggtggtctagcgaaagtgacacgacccgacgacgtgacccgacccgacgggttgatccatgggattgagagactgttggtacctagatctgtgcaagaagagtttaaccggagaagaagtttgacttcaatttcagcggttttacccgaaggagctccggtagtggatccgagaacccaccggttaaaaaaacccgctccagttcccgctggagctccaccggttctaccaatatacgacgcaatggcaccgggtccatcactagctccagctccagcacccggacccggtgggccacgtcatcactttgacggtgagagtcaggtgaaagattttattcaaacgttgttacattacggtgggtataatgaattggcggatattttggtgaacttaacgtcgttagcgacggaaatggggagattggtgtctgagggttatgttttaacggtgttggctccgaatgatgaagcaatggcgaaacttactactgatcagttgagtgatccgggtgcaccggagcagataatgtattatcatttgattccggagtatcagacggaagagagtatgtataattcggttagaaggttcgggaaggttcagtatgatactttgagattgccgcataaggtggtggcggaggaggctgatgggtcggttaagtttgggtcgggtgagggttcggcgtatttgtttgatccggatatttacaccgatgggcggatatcggtgcaggggattgatggtgttttgtttccggtggaggagacgagggagaaaccggctagtaaggtttctccggcgacggcgactaaggtcgttgcgaaccaaagaagagggaaattattggaagtagcatgttcgatggctggcgtattcggacattttacaagttgtaattgatgtatacatacatatatattatgcaaaaaagttgaatatgttaggaaaactgtgtggaaaataggacataaaagggaaacgaatggtgcagtttggcatggaaggaagttttccccagagaatcagatcccctcacacgagaacaaaacaaactctctatttttatgatttttttataataattttcaatattttatttcttcatgatgctgtataaatactgtaattagtaaaaagaaagtgattttttatgtacgtatgtttgatttttgcgaaaattgtatttgcccaaatctgcaaaatcttgaggcacaattctttt

SEQ ID NO: 189 - DNA, 1291 bp, Solanum lycopersicum
aaaccataaaccctagttaagcggcaattttttctatataaaccctctaaaaccctcattggtaccgccctcttcaatctttgcacttcgaatagcagtcttttttgctctcttacttcgcccccagtttttcagcttttcaaacaatcatcaatggagttttggggtgttgaagtgaaagcaggacaaacactaaaggttaagcccgagcttttcaagctcattcatatttctcaggctgccataggtgaagtgaaggatgtcaaagaagccaaatatgttccactacgcctaactgttggagataacaaatatgtcattggaactctatctgctgaggatagacctcagttgatgtttgacttggtctttgaaaaggagtttgaactttcacatggatggaaaaatgggagtgtgcacttcatgggatactctgctgatgatccgagcagtgaggaaattgactctggagatgatgttttttccgatgaagagaatgttatggaggcactgaatgggaaacttgaggctgatgtgaaggatgtaaagcctgatgcaaagaagtctgcacctgtgaaggatgagaaaaatgctaaggtagctgaatcaaagaaagaggcggaatctgatgaagatgatgacgattctgaagatgactctgatgatgaagacgattctgaagatgactctgatgatgtgcctctaggcatggatggaccagaagggatggatctttctgatgattccgaggatgatgatgattccgaggaagatgatgattcagaagaagagacacctaaaaaggttgagcagaagaagagaccagctccatctcctaaagtagctcctggctccggcaaaaaagctaaacaagcaacccccgacaacaagtcaggtggtaagaaaggtccagccaccccttctgctaagcaaaatggtaaacctgcattcaatggtaacaacaaaccgaaaactcagtccccaaaatctggtggtcagttctccggcaacaaatctaacaacaagaacttcagtggccaaaagaacttcaagggcaagcaaggaaggaagtagagtgcttggaagatgttgttgaagagcaaagaatttttatttttatttttttagtttatagatgtttggtctccctatggatttaagctattttccttagtaggtcaattttgatgaatgtttttgttaccagaaagttttgcccctatctatattcattactattttgaacacctttctttatatgatcctttaatcttacaacttcatagttcat

SEQ ID NO: 190 - DNA, 2672 bp, Solanum lycopersicum
acaatcaaatagtggtgtaattctctgggaagtatataaaagatgtatcttaactgaacatcaacgacccttttgtctactccattaactcttcttcttcttgttatttctgcttcagtttcaacaatggaagaatctctgttgcccggagagagtagcagcaacagttggggacggattcggaatcggaggagggtcggttccatgtttgatcccagagatgctattgctcatggatctgcttatcaaaaagctgctgctttagttgatcttgctgaagatggcgttggtctacctgaggaaattcttgagggaacgagctttgaaaaggcagcacaattgtacttcatgtttactcgttttgacttcctgtggtcacttaattatcttgcactagtacttataaacttctttgagaaaccattgtggtgctccaggcatttagctgagtcatgcaataatagagactactactatctaggacagctgccatttttgactggtgctgagtcccttatatatgagggtgttactcttcttcttcttgttgtacacattttatttccaatatcatatgaaggcttccatctctactggagaagtcttctcaacagactgaaggtcgttttgctgttaatcttggttgcggatattgtggtctacattctctttctagcagacttctattatcttccattccgtattgcatcctatctccgtgtggtgttctttattttgaatattagggaattacgagatagcttcttcatccttgcaggaatgtttcggacctaccttaatgttgtggctttaactgcgttatttcttctattctcgagctggttagcatatgtcttctttgaagacacacagcaagggaaaacaatgtttacttcatatggcactacgctgtaccaaatgtttgttttattcaccacatcaaacaacccagatgtctggattcctgcatacaaggaatcacggtggtattgcttgttttttgttctgtacgtgctattgggcgtttactttgttaccaacttagttcttgctgttgtatatgatagcttcaaaagtgagcttgtaaaacaagtagctgaaaaagatcgtcggaagctaaggactttgaagaaagcatttagcttgattgatgacagcaacactggggtcctcgacaagaagcaatgtatccttctgtttgaggaacttaacaaatacaggacattgccaaaaatatcaggagatgattttgagtcaatattcaatgagctggatgatactggtgactttaagataaatttggaagaatttgccgatctgtgcactgcaatcggactaagatttcagaaggaagattcactgccaatctttgaagcatgtccaaatttctatcattcagcagcatctgagaagttgagagacttcgtccgtggcgatacgtttgagtacataatagtgtccgttctcctggtcaatcttgttgctgttattattgaaaccacgctcgatatacagaacaactcaggtcaaaccttttggcagaaggtggagttcacatttggctggctgtatgttatcgagatggcactaaaagtgtacacttacggttttgagaactattggagggatggtcaaaatcaatttgattttatcgtcacttgggtcattgttattggagaaacagctacttttgtagcccctgatgatctgacctttttgtccaatggagaatggattcgttatcttcttatcgcaagaatgttacgattaatgagactcttgctgcacgtagagcgatatcgtgcttttgttgccacatttttgaccctcataccaagtctgatgccgtacttggggaccatattctgcatcttgtgcttttattgctctcttggtttacagatctttggggggattgtcaacgctggaaaccccaatttagcccaaactgagctttctgataatgactatttgctttttaacttcaatgactatccaagtggcatggtcacagttttcaacatattggtgatgggaaattggcaagtgtggatgcagagctacaaggaactaacggggactgcctggacttatgtctacttcgtcagcttctatcttatctcagttttgtggctgttgaatttgattgtagcatttgtcttggaagctttccaagcagaaatggatctagaggctgcagcaaactgtgcggatggtgatgacaaggagtcaagaagtgagcggagacgtaatgttggcactaagactcggagccagcgagtagatttcctcctccatcacatgctgagttctgaactaacagaatgctcccatgacgatccataagtttactcctccttttcttcatgctgctttatgcagtcctgtgaacatcagaagttgagttattttggtggtgaagccaaattgcaatgtacatttccaactaattatgagtatgtatcgcgaattgttatgtgttgtgtataaattccatcgatcctacgacaagattgtagctgttccactccattcctagatgttatttatcagcatcacacgctgctgtattactcagatattgtacgatgatttgtttgtagttttttcactctgcttctcaaacatttaaatgaaaacatgaggaatggatttaaacgatttttcattta

SEQ ID NO: 191 - DNA, 1308 bp, Triticum aestivum
ccctccggctccagcgctgctcctccggccagggtccggcggtcttgatcctgccgcgggggtgtcttcctcgtctgtcgcgggtctggttgttgctccatgtcggcgggcgacggcgcggcggtgtcggccgtcgaggggaagctcgcggagctctccaccagctgcgacctcaggaccctccccaagaggggcaagtctgcatcagcaaggacattgaacactgcccagattcagcttgttgcaagccatccggaagtgtatgaaccatgtgatgattcctttgctcttgttgatgcactgctctctgacaaggctcaacttctgacgctacagccgagtttatgcatggaggtaggatgtggcagtggttatgtcatcacttctctagccatcatgctcaggcaattaggctctgggacccagtacctagcaacagacatcaaccaacacgccgtggagacaactcaagcaacacttgaagcccatggtgttcatgcagatgttattgctacagatattgtgtcaggtcttgagaaacgtctggctggtatggttgatgtggttgttgtgaaccctccttatgtgccaacaccagaggaagaaatcgggatgaagggcattgcttcatcttgggctggagggttgaatgggcgccaagtgatcgaccggattcttcctgctgtgcgcgagctgctgtcagaaaaaggatgtctctacatgattgcccttgaagataatgatcctttgggcatatgccatttgatgaatgagaaggggtttgcatcgcgtgttctgttgaagaggtgtactgacgaggagagcctttatgttctcaagttctggcaagatgctgctgctggcgcaaatgcttctcaatccggcagatctccacgcgccgagtcgtggctttcgcaattgcctttcaaatccttttggcataagaacactggcagttcttgacatcatcagtttgggccttcccatcatgaaatatatcgaagcaaggaaacctttgcaaaattcatatggcggtaatgtgtaaaagtgtctgaatgaggtgttgagttcagacctgcctgtcctttgagaacacgaaccagactgacattgtgaacttagctgtgatccagtgagcaatcaaaccaatcgtagtcgcaatataccaaactttcccgtgtcggtaaaacagctgtcttattatgttggcatgatgcgtgttagtgtgtatatgtgctataatgaatctattgccttcctgaatgtgacatacgctgttaaattatgccttcgtcttgcagagagaaa

SEQ ID NO: 192 - DNA, 815 bp, Triticum aestivum
agatggccgaatccgacacggcggccggcaagatggccgaacccgacgcggcggacggcaagatggccaacggcgaggtctccgacgacggccgcgccgtcgaggtctccggcggcggcgacgacaccctccccgcggtgctccgcggcttcgtggacggcgtctggccgcccggcgacggcggagatccgctcctgcggcgcctccgcgcggcgacctgcgaggccgcgccgcggctgcgggacgcctccaggaactcggcccgcgacctgctcgcctggaccaagcagggcagcggcctccgcgccatcctcgtcatctcggtcggaacaatcacgatgatatcactgactggcctgctgattttcatgtccttccttctggttgcgaccgctaatgccattatcgtttcagttcttatgtccttggcagctgctggaggattcctggccttgttctttgcttgcttagttgcagtgtatgtcggagcagtatcaattgccatattcgtcatttcggccactgttatctctgcaattgtgggagtcctgattgccaccggttggatcggattcttttggatgatttggtttgccgcaaggaagagcctggaccttaccaagcactcaatcggcatgacgacctctgctatgcagtcgtattcagcttctcggagtgtggggcagaagcccacagactgactgagatagcagcaagtggtttagctacagtgcgctgtctgttatcgcgtgatgttgccgcctcgctgccctgctgttgttgtgttatatgtgctgcctaaagcgtgccgtatg

SEQ ID NO: 193 - DNA, 2781 bp, Triticum aestivum
ctcgctcactcacgcacgagagagcgagggaagaagggggcaagaactcggaacccgggaggcggaggcggaggagtgctgtgccggggagtgggaggtgccggtccctcgccggacgacggacgaaagaggcggctgcggcgcacctgccagatctgcggccccgccggcggcgggccgccatttctgggtctccgcattggttcaggatcttattatccaaaggttgggctcatcgggtttcgtaacagcttaccactgaagctttctgttgctttctgtctaacgtggaagatggcgcccgttgcctgatgattgcttccgtgacacctttctcgcactctagcacagcgtcatctgcagaatttgaaaggcgcaagagatcaattcctttgttggctgccatgtctcgcaacttgaagaaccctgtccagacccagatggcagtttcagccttgagcagctctctgatcggtgattaccctagcaaaactagaagcgaggggaaggctgttggatggaaacgtgtttttgtccagactgacactggttttgtactgcctgttcaactggatcgtggtgacagtgtacacacagtcaaaagaaagctgcaggtggccctcaatgttcccactgaggagagttctctgacactcggtgatcatgtcctcaagaatgatctcagcagcatccgaaatgattcaccactgctcctgaccaagaccttcatgcatcggagttcctccagcccatgcctgtctcctacaagcaaggatctccagcagcaaagggataggggtggtccaattgaagttttagtgtgtccaacccgctgcattcaggcaaagcagcttgttaaggatgttgctagggccataagaaacggtgtggatccaaaacttgtcaatagtgggcttggtggtgcctactatttcaagaacagtaaaggtgagaatgctgccattgtgaagccaaatgatgaggagccgtttgcacccaacaatccaaaaggttttactgggagagcccttgggcagccaggcctcaaaagatcagttcgagttggtgagaccggttttagagaggttgctgcataccttctggactatgataactttgctaatgtccccccgacagttcttgttaagatttcacatcctgtatttaatgtgaatgaaggcgtcggctctaccaacaagaaggcttctgtgggtgatccgcgaactgtcagcaagattgcctcatttcagcagttcgctcctcatgattttgatgctagtgaccttggcacttcaagcttccctgtagctgctattcacaggattggtattcttgacatccgaatcttcaacactgatagacatgctggaaatcttctggtaagaaaggtgacaggagccgatcaattcggcaatcagactgagctgattcctattgaccatggtctctgcctgccagagtgtttagaggatccttattttgaatggattcactggccgcaggcgtcaatcccattctctgaggatgagcttgagtacatagggaaacttgatccagtgaaagatgctgagatgcttcgcatggagctgcctatgatccgggaagcatgcctccgagtgctagtcctctcaaccatatttctgaaagaaggcacattatttggtctttgccttgcggagattggtgagatgatgagcagggaatttaacgggatggatgatcagccaagtcagctagaggttgtctgcatggaggcaaggaggctagcaactgaacgagaagaatgttccacagaacatgattctgcagatgaagatgtgacccaatttgaacttgactgtgaagatcatgaaatgccaaaaacaccaccagcctaccattttgaatttaaggggggaagctccagaaacccgctgtctaaattggaagaggccattgaagaagaggaagatgacattcaggaggaggaagaaagcaatgcagaaaagttagcttgccccaagcctgtcaataagtggcttcctaatatttccaagctatcaacctcactgagcagtgtcagtctcatggacaaaagccagcgtcaggtgcctgctattccgaagggtgcggattctgtgaaaacctctgaaaacagccaagttggtaactggagaaccgcgaatgagcagctcccaacaagcgcaagctttgtgaagctggccgacatgggtgtggatacatggggcctgttccttgagaagttccaggagctgctccctggcgcattccgcgcgcacaagcttggcgccaccgggcagagggggaggctgaggatgggtacttcttgtcagttttgagttagtgcaggagtagagaagtcagtttggctgctgctgtttgctgtggcttcctgtaggtgtcaaggtatgcggtcggtcgtcgaataaagccatcctttacaatagggttcgagcgttgaatatgcctgcttcagaggtccatgttcagatgatggcctttcctgtacatagttttccttctttttttttccttttttcttttctagctagttgcctggaggaggttgggatgtgatgtctgcccagttcttggccacccaattcctccatgcatgatatgcattcaaaggtgccattcaaataaaatagacatgcaagaaaaagtttctggtgtggtaattaaacattgtccagatttcagagtaatgttatatttcaacttgaaaggtttttattgtgctgtcagttgtcattgttctcatgtcatttatatatactg

SEQ ID NO: 194 - DNA, 2863 bp, Triticum aestivum
gcggagcgctggtgctcatgccactcatcacccctcgtcactagcaggaggcggtagagtagggtagggtagagagagcgagcgagagagggggcggcggggaggcagatgcgggagatcccacggggggtcgccgcagccggaggaggaggaggacgaagaagagatggacacgcccgataggccccgcgccggcgccgccgccggattcgaggactcccccgtcttcaattttatcaataatctatctcctataccacctcctaaacctcaagacacatcacataatgtgcacctattcaagtcgtctgacttggctcctgtttcttcaatctttgcctcaccccatgtcaatccaccaaaggaatctaaacttctgataagggatgattctgttcaactttctcaagattcaaactctcctaatagtgtcagaactcgactagggagtgctattaggttgatcaaatgcaaaaacattgtttcggagaattgcagtttcacctgccacctaaatcagggacctattgattcttctgccaatagatcaaactctacaagtaaattgcctcaaaccatccagtttgttggtgacagttcagaatgtggtaagaatcaaaatgctgatggtaaaaaagatcttgctagagatcaggagagcatagaactagaaggtgccctccttgatcacactggcccagataaaatcgactcatcacaacctggaagaatcgttcatgaaaaccaacaatgtgaacaacaaaaggatggatttacagcatatgatggggattacttgattacacacgaatcaagtatggatatgctgagattagccccaccatgtgagacagatacacagttagtgaatgagacactaaacgctgataatgtgttctctggcaattccttgctgaccgatgggccaagtggctcttacatcagcaatgctgcacatgatccaaatctttactgggatggaacggttgaagggcccacgacagattataccccccaattgctccctggtgcttgtcaaagtcagtcagtgtcaaatgatcaaatctgtaatgcagttgaagagcccagtgatcacataccaatcgaccaaagtgccttgtcacagaatatgcgtggtatgcgaaggcgttgccttttcaatgaaaaggctggggctgttaacaaagctgccaagaagacctcggatcgccattctgcaaatacaactacccccagatgcaaaactaattctggtgataagcctgtgcgaacccctccatgtgcattgcctggtattggcttgcatctgaatgcccttgccccaatatcaacagacaaaatagtcccccaagctgctcaatcttccataaatcaagccagcaacttcccctgtgctgtcagttcttcaacatctgaaccaaatattgtaaatgaagattcctctcaggcaatcgtggttgcaaatgctgatgagtctggtcagggcagtcccaagaagaaaagacacaagtttgatgatggtgatgggacttcatgcaagcgttgtagctgtaagaagtcaaaatgcttgaaactttactgtgagtgttttcatgctggagtcttctgttcagaaccctgttcatgtcaaggctgtctgaataagcctagcaacatggagatagttctatctactcgagagcagattgaatctcgtaatccactagcatttgctcctaaagtgattcgcacatctgagcctggtcaggaattaggggagtactctaacaaaactcctgcctcggctcgtcacaaaaggggctgcaactgtaagaagtcatcgtgtctaaaaaagtactgcgaatgctatcagggtggcgtgggatgctccataagttgcagatgcgagggatgcaagaatgcttttggtagaagggagggactcggaccgttaagcattgaggaagctaagcagggaaatgaggaaaatagtgcttgtgtgaaggaagaaaaaaaggaagatgataataatcagctcgttatctgcccagctgctaatccagctcctgctgagaatgtactgacaacaccttcagctatggatatcagacccttggcttctcttccaccttcaagctctaagaggccacggtctacgacaaaggtcctcggacatccttctcgactatgcaactctcaagctcctctgaagacggacactgtgctctccccatttgaaaactatgcagaaattatgtttggggtgggtacatcagatagcctgaaaggagggttatctcctcaaacttctgtcaaggtcgtgtcaccgaataaaaagagggtatctcccccgcgcattggtactgggttgtctccaatttgcaagagtggcaggaagttgatcctgaaatccatcccttcattcccttctctcggtggtgatgtaaataacgcggataccaagaccaccttgccagctccttgaattcatcaagcatttgtcagaggtcatttcattagttccttgattccccagatggccaatgcctcgtagctgcatcagctccttcatccttgagagtttaatgaacatccaagggagttttatttcgccagttctttttagagcctgatagtatcccatgatcctatagtggaccgttgaataataatgtaccaaaataccccctcgagagccttcggcatgctagtaattatatccacacctgtggagacagtccttgttgagttgcacatccatgttcatctgtataattaatttatatatttttgtctatgtaactgcaactgagatcaaatcatcgagccttagatttacttcttgtggttagaaacctttaagatttatatgtaagaactctgg

SEQ ID NO: 195 - DNA, 1382 bp, Triticum aestivum
ttttctccccctcttcctcgcagaaggagcagcaagtaatccggtcgaattgataggggagacgaggagcagcgatggccgccgctcgagcccgatggcggttcctcgcgctgcccctggcgctgctcctcgcgatcggctcgtcgcgcggcctcgacgcggcgcccaagccccccgtccccaaggccatctccgacctgagggaggcgatcgtcaaggggctggggctccagtcggaggagctcaaggtgtccgggttcgacgtgagggacgcgctggtggggcacgcggtggcgtacgagttcgacatggaggtcgggaggaaggccgtgccggtgcggctgctcgaggacgtcaaccggtgggacttcgtcgacctgcccatcttccggtcccaggccgacgccgacgacacggcgctcgccgagatcgggcgggggagcttcgaccccacgctgccgcccttccagctcgccgggcccatggagctctggatccaggacggcgacgacgtcaggctcgctttgccgcatgatgtggaagctggaaccctgaagaaagttgttcttgctgatggtgcggtggtaacagtgaaaggtgctagggcggtgagcctccgtttgcccctcgaactaccacttcctctcaaccgcaccacatacaagggccgcctgtctagcttgctttccattgctcgagccctacgcggtgcagctcggtctaatcagaaacccctgatgtccctccggatcgagggtccaacctccttatcctcaaccccttccatgtctccgaatgacaagctcaagctcaaaaggttggccccaggtcaagtggagctctcctcgcgtgcgatccctgctgtcacagacgatgaggatgaatcacctagccccggattgtggccctttttgtcattgaatgcatcggatggcagcctgcaggggcttgaagaactactggcgaaggttttgggtaagaaggcgggtgagaagggcacgttcaagttggtgaatgcacgggcctcggcacaaacatatgtcaaaatgggattcacggtggagaagcggattgctgatggagaggtgaactggtctaacttgcctgagtggaaaacaaagcccaagaagttgagagcgcactatgaagttcttgctcgcgtggagcgtggccaggcgatcccggaaaggatcgcccaggtgcagcctttccaggtcgacgaggccatgtccgagagcatgctcaccggaaacgtgtctagatcgaagatggaggtagtaaaccccccaccggtttatttcactttgtgagactgggaggggctggaagctttttatttccaaagctctacttgggatggatgtggcaaaaagtactgattt

SEQ ID NO: 196 - DNA, 1693 bp, Triticum aestivum
cctcccgtctccgtcctcggccaccaccaccgccacctgcccgcgccctccaccgctcctctacaagagcccctcacccccgcgtccctgccagcagcaaaccctgcgccgtgcgagtcaacctctcctctctgcctctcgtggggatctcgcgcgctcctcccggaatcaagcgccggcggtcggagggataaaggcacggacatggaggcggtcgcggcggccggtggcgccgggctgaccgggtggcaggcggcggcgctgtcgggcgcggcgggctgggtgtgggcggcctcctactacgacctcacgcgccgggcgcgcgcgctggcgcagccctgggtcacccgccgcgtccacgccgagacgccctccatcctcaccttccagaggctgcagcacaggttgctggacaacttcttctccgtgctgtcatgcgttgtctctgtccctttctacacgggattcctccccctcctcttctggagtggacatggcaagctggcgaggcaaatgaccctgctgttggccttctgcgattaccttggcaacgctgtcaaggatttagtgtcagctcctcggccgtgttcccctcccgtgaggagggtcacagctaccgaagatgagaaggaaaatgccatggaatatggactgccttcatcgcacgctctcaacaccgtttgtttgatgggatacatgttgcattatgtcctcacatatggaccttgtgatggtttcatgattgccacgggtctttctctagctttcatgctcgttacgttaattggcattgcgagggtatacttgggcatgcacagcttgaccgatgttatcgctgggatatcttttggcatcgtgatccttgcattctggttggttgtccatgatcatgttgatgcctttgtcgtctctggccaaaatgttacattcttctgggcaagcctttctctagtgctctgctttgcatatccaaggccagaattcccaactcctagctttgaattccacacagcattcaacggggtcgctttcggaattgtctacggcgtccagcagacgtacacccgtttccatggcccggaagcccccctcattctcagccatcaactacccctcctcgcgtatgccgggagggtcctggtggggatcccgaccatcctggccgtgaagtcgtgcagcaaggcgctctcgaaatggctcctgccggtgatgtgcagcaccctggggatcccgatcgtgtcgtcctgctacgtgcccgcgctgaagccatccgacattggcggcggctcaggcaacaaggacgaggccaagcaggccggcggatacctccagcggctcttctccctcttccctcagaaggcgtatgatgtagacacgggcatccggttcgtgcagtacgcggggctcgcgtggtcggtggtcgacctggtgccggtgatcttcacgcatctgaacctgtgaggccgatcgaattagcgagtcaaggttagcagcattttgtttatttcttcggaggaggggtgatcgatccctcctccatgtctcgcaggctgtagatccattgacctcagcctcatttttgtgttgtatgtttatctgtctagcacgtcctctagcgggtggtgtttttctttttgtacagttgtccaaagtagcaacgaggaaagtatacacgtgatgaccttgtttttgt

SEQ ID NO: 197 - DNA, 1085 bp, Triticum aestivum
cctgtcccattcgacaaaacacgccaagcacgcgcaccgaatccatcgccgagcaagcgaagcagacaccacctgtccagaccgccgcccaccgtctcccaggagctcagaggcgccaccaagaaccgcacggaagcagccggagcaagcggcacgtgagaggatcgatggcgatggccggcggagccccgccggcgccgctgccggtggtggggcaccagttctgcgcgccctacgtggtgccgctcacggtgaccaagaaggccctcagcctctccgacggcgacttcgccatcacggacgccaacggcgccgtcgtgctcaaggtcaagggcgccatcttcagcatccggagccgccgcaccatcctcgacggcgccgggatgcccctcctcaccatgcaggaaaaggtgttcagcatgcaccaccgatgggaggtgttcagaggggacagcaccaacgcaggcgacctgctcttcaccgtgaagacaacttcgctgatccaactcaagacggagatggatgtcttcttggccgggaacaccgcgcagcaggtctgcgacttcaagatcaagggcagctacttcgacaggtcctgtgtcttctaccttggcgactccaacaacatggtagctcaaatgagccgtaaactgactgtttccaatgtgctgctggggagggacacgttcagtgtgaccgtgttcccgcacgtcgactacgtgttcatcgcgagtcttgttgtgatcctggatgaggttcacagggacaaacgcgatgattgatgagtgagttatatacactcctggatcctgagcgttcctggagttctactactgtcgtgtcatctcaagttgatgtgttgtcactggtcactggtgttatctgcatttcttgtagcattatgcgagcatggtgaaccatgctgaattgcgatgtcgtggaataatgtttatgcaccttacatttgatccctggcctgccagtgtatcatttgtatttaccgctgtgatggattgtttgcttgagatgaaatgttgagctatatataattcttatttctcggtcgtgcgcgatggtctattgca

SEQ ID NO: 198 - DNA, 673 bp, Triticum aestivum
agcacctccagctaatcataacagccgctcgagcactcgatccgattcgatcatctctcccgagctccccgttcttcgatctccgtccatggcgccgtccatctccatcgccgccgcggccccggcctcgggctggaagggcggcaggaaggccggggcggcgccggcggagggcgaggcggagacggaggcgctgctgctgcggcgccggaacgccgagctggagcgggaggtggcgctgctgcgggcggagctcgaggccgcgcggctgcgcgccgaggccgcggaggaggccgaggagcggctgtgcgcgcagctcggcgaggccgagtgcgaggccctcgagctcgcgcgcgcgtaccagggccgcgtccaggagctcgcgcgggggctcgccgccgcacgcagctgctagtgttgcgtggcaccggacccgcttggaggaggcggagaggcaggcagagcgcgtggccgagctcgtcggtgattctttgacgatcgacgaagagacgtgtcacgctgtcgacacacgcggtgtcgcggcagtatggattgttagacaaatgtactgtaaaacgaaacgaggttaattagtttcttgtacgagcaagatgtcagtgtttgtaacttgtacgactaaaattgaatagcaggcgcggaagtatatattcgg

SEQ ID NO: 199 - DNA, 1003 bp, Triticum aestivum
ctccccgaaccctcgctccatcactctctccctctcccactcccactcccacttcggcgcgcgctcagctgaatcctgccgcaggagcaatggcgtcggtgcatctgtgcggcccgaaggtggcgtccgcggcgatggcaaagccggcgttggcggacgggctccgtgtccccacttcgtcgtcggcgcgtcccgtgccgacggggcggaggctccggggcctcgtcgtcagggccgccacggtcgtgtcccccaagtatacttctgtgaaaccattgggagatagggtactagtgaagaccaagactactgaggataaaactgctggagggatattgcttccaacaacagctcagtcaagaccacaagcaggggaggttgttgcagttggagaggggagaagcttaggcagcaacatcgtcgagatcagtgttccggttggtgccaaagttatttactctaaatacgctggcaccgagttggaattcaatgataccacccacctcattatgaaagaagatgacatcattggtattcttgacactgatgacgtgaaagatctgaagccactgagtgaccgtattctcattaaggttgcagagtctgaagaggaaactgctggcggtttgctattgacacaggcgtcgaaagagaagccttctgttggaacagtggtcgctgttggccccgggggtttgggcgatgatggcagcaggacgcccttgtcaatcactcctggaagcagcgtgctgtactccaagtatgcaggaagcgagttcaagggttcggaaggcgagtacatcgttctcaggtcatccgacgtgatagctgtgctgtcatcgtaaggaaagcctgttctgctcatgtgaactaggaattttgatatttagtccaaaaccttgtttggttatttctcttgctttggattggcgaattgcttctttgctctatcctgtcatggtggaaatgagtttttaataataagatgacggcttatatttca

SEQ ID NO: 200 - DNA, 2858 bp, Triticum aestivum
ggagaggagagatgctgctgcacgggctggtggaccggctgaccgggaagaacaagcaggcgtggaaggagggcaagatccggggcacggccgtgctggtcaagagcgacgtgctcaacctcggcgacttccacgcctccctcctcgacggcgtccacgacatcctcggcaaggacgacggcgtcatcttccacctcgtcagcgccaccgccccagacccccagaatccgaggcggggcaaggtggggaagccggcgcacctggaggagatggtggtgaccatgaagtccaaggcggccggggagtcggtgttcaaggtcaccttcgagtgggacgactcgcaggggatccccggcgccgtcgtcgtccgcaacacctaccgctccgagtacctgctcaagacgctcaccctccacggcgtccccggcaagggcaccgtcgtcttcgtcgccaactcctggatctaccccaacgtcgaccgcgtcttcttcgccaacgacacctatctgcccagcaaaatgcctgcacttttggtgcaatacaggcaagatgaactcaacaatctccgaggcgacggcacaaccggaaagtacgaggagtgggaccgtgtgtaccgctatgactactacaacgacctcggtgagccggacaagggccatccgcgcccggtcctcggcggcacccaggaactcccctatccccgtcgttgcagaactggccgacccccaacaaaaacagaccctagatcagagagcagaattcctcagtacaagatacaggaggccctcaacatctatgtcccgcgtgatgagcgctttgggcacctcaagttgtctgacttccttgggtactctctcaaggccatcaccgaggccattcttccggtgattaggacctatgttgacactacacccaaggagtttgattcgtttcaagacatctatgatctctacgacggtcttctgaaagtgcccgataaccaacacctaaaggagctcaagaagaaaatcccccttcagtttattaaaagtcttttaccagttgctggcgacgacctcctgaacctgccccttccacatgttatcagatcaaacgattatgcttggaggtcagacgaggagtttgcgcgggagatgctcgcaggcgtgaacccggtttgcatcaaacgtctgacggagttccctgtaaaaagtaccctggatcccagtgtgtacggggaccaatcaagcaccatcactgaagatcaaattcagcagaaccttgaagaaggcctcacagtgaaacaggcaatggagaaaaacaggctcttcattctagatcaccacgataacttcatgccattccttgaccgcatcaacaagctggaaggcaactacatctacgcttcgaggaccctgctgttcctgaaggccgacggcacgctgaagcccttggccatcgagctgagcctgccacaccctgacggaatacagcacggcgcgaagagcacggtgtaccttccggctgatattgactctggtgttgatggccagatctggcagcttgccaaggcttacgcctccgtcgacgactctgcgtggcatcagcttatcagccactggctgaacacacacgcggtgatcgagccgttcgtgattgcgacgaaccggcaactcagtgtggtgcacccggtgcacaagctgctgagcccacattaccgcgacacgttgaacatcaatgccctggcgcgaaccactctcatcaacgccggtggcgtctttgagatgaccgtcttcccggagaaatatgcgcttgagatgtcttccatcgtctacaagaactggaagctcaccgagcagggcctccccgacgatctcgtcaagagaggcatggctgtgccggattcatcgagcccatacggtgtccggctgctgatcaaggactacccgtacgcggtggacgggctggtgatctggtgggcgatcgagcggtgggtgaacgagtacctggccatctactaccccaacgacggcgtgctccgggccgacaaggagctggaggagtggtggaaggaggtgcgcgaggtcgggcacggcgacctcaaggacgccgactggtggcccaagatggtgaccgtgcaggagctggccaagacgtgcaccaccatcatctgggtggcatcggcgctacacgcggcggtcaacttcgggcagtacccgtacgctgggtacctcccgaaccggccgacggtgagccgtcggaagatgccggaggagggcgaagaggagtacaagcagctgcagaagggcgggaaggaggccgacaaggtgttcatccacaccatcaccagccagttccagaccatcctcggcatcacgctcatcgagatcctgtcgaagcactcctccgacgaggtgtacctcgggcagcgcgacacgccggagtggacgtcggacgccaaggccctggaggcgttcaagaggttcggcacccggctgatggagatcgagaagcgcatcctggacatgaacaaggacccggcgctcaagaaccggaacgggccggtgaagatgccctacatgctgctgtaccccaacacgtcggacgccggcggcgagaaagggctgggcctcaccgccatgggcatccccaacagcgtctccatctgagctgagcgaggtcctttaatctgaacagcgtctcgttcagtagattggttggttcgtgtctcgcgtgcagggtgtattgtgttcctttaatccttctcatcattcgcttctgggtggttgcggtaattagttgcgagggattagtggatgatggcaaatgatgatcgtagatgatgttgatagggagagaacaatgaggcatgaataagc

SEQ ID NO: 201 - DNA, 1162 bp, Triticum aestivum
actcattcttctttctcaagatctcccactcgcctccccgcgtcgccgtcgaacccactccgccgccccgtcgccggcagcgcccccctcccgcgatggccacccccgacctcctcttcaacctgcgcaacctcttctacctcggcgcctaccagtccgccatcaacaacagcgacgtcccgggcctcgacgccgacgccgcggccgagcgcgacgtcatcgtcttccgctcctacatcgccctcggatcctaccagctggtgatcagcgagatcgactcgtcggcggcgacgtcgctgcaggccgtcaagctgctcgcgctctacctcaccggcgacaaggaaggtgcgatctccagcctgaaggaatggctggttgattcagctataggaagcaatcctgttctgcgattgattgctggaattatatttatgcatgagcaagactacaatgaggctctcaagcacacacacactggggggactctggacctgcatgcactgaatgtccagatcttccttaagatgcaccggtcagattatgctgacaagcaactgaagatcatgcaacaaactgacgaggaccatacactgacacaactagcaaatgcttggctcgatattgctgttggtggctctaagatccgggaagcttatctcatattccaggactttgctgaaaagtaccctatgactggaatggttcttaatggcaaggcagtttgctgtatgcatatggggagctttgaggaggctgaaactctattgcttgaagccctaaacaaggatgcaaaggatcctgaaactcttgccaatcttattgtatgtaatctccaccttggcaaaccgtcgtcacgatacttcagccagctgaagctgtcgcaccctgatcacgtgctagttaagaccaccacgtcagcggagggcaacttcgagagggcgctccaagccgtcgcctgaaacacccctgcctcattcgagttagcgcattgagcatcccctgttccattttgaagtgctttaacagagtgaattgtattggttttgctttatattgttctgtggtaacacaccgctcggccaaccctgtactcaaacacaaacacccgctgtatgaacggatatatatgtagaatctccaatcatggcatttgttgtcaaca

SEQ ID NO: 202 - DNA, 888 bp, Triticum aestivum
tccacgcgaaccttgatctcgtctccttcctcccctctggcggcgccactccgatcgatcctccccgtccgcgaccaatatgaggagaggctacagctacagcccatccccaccaccgagaggctacaggggaagggcccgtagcccaagtccccgtgatcgttatgatggtcggggtagagatctcccaaccagtcttttggtcaggaaccttcgtcgtgactgcaggccagatgaccttcgccggccatttgcacagtttggtcgtcttaaagacgtatatattccaagggattactatactcaggagccacggggatttgggtttgtgcagtactttgatcccaacgatgcggcagacgcaaaatactacatggatggacaggtcattcttggtagagaagttgcagttgtttttgcacaggagaacagaaagaagcctgctgagatgagaaccagagaaagtagcagaggtcggtcttacgatcggcggcactctccttccccaagggggcggccatcttaccgcggccgtagctactcaaggtctccatcacctcggcccgcaaggcggaggttcagagacgagtctccctcgcgctcccgctcgcccagcggatcgaggagtgcgagtccattggatgggaagtacggcaggtcctcacgaagagagaggtcgatttcggttagcggttgaagcatcagtagctctgctcgggtctctagaactgtagtggacttgctcgtgggaatctaagtttgctatcgcttttgtgaaccgcgctaaccgtggatttatagagagaagattgccgtcgtgtatcagcaagagtatgtcaaactgtgtctgcggctctgtacctttgcactagattatttagcgcataa

SEQ ID NO: 203 - DNA, 1625 bp, Triticum aestivum
gaggcggacaccggccaggccacaccacgctcacgccaccatcataacgccactcccacgctccactccgactcccatcgcgttccatttcaaaaacgccacctttcgccccctgcatttccgccgaagtctacatgtctccgaccaccgccgcgtcccccgcgccggcgccggcaaccgacgcgcacccgaagccttcgccaggcgcgaagcgcagcctgatggggtccctcatcgacgccaccgcgctgctccgggcggcctccttcaaggaggactcgtacgtggccgcagcgctcccggcctcggacctccgcgcgctcgccgacctcagggcgctcctcgccacccacccggaccaaatctccatctggggcgtgccgctcaacccgcccagcgacgcccccgccgacgagcgcaccgacgtcgtgctcctcaagttcctccgcgccagggacttccgcgtccgcgacgcgcacgccatgctgctccgctgcgccgcctggcgggccgagttccgcgccgacgccgtgctggacgaggaccccgggttcaaggacctggagggcatcgtcgcctacatgcacggctgggaccgcgagggccaccccgtctgctacaacgcctacggcgtgttcaaggaccgggacatgtacaacagggtgttcggcgacggcgaccgcctcagccggttcctccggtggcgcgtccagatcatggagcgcggcgtgcgcgcgctccagctccgccccggcggcgtcaacgccatcatacaggtcaccgacctcaaggacatgccgaagcgagagctccgcgccgcgtccaaccagatactctccctcttccaggacaactaccccgagatggtcgcccgcaaggtgttcgtgaacgtgccgtggtacttctccgtgctgttctcgatgatctcgcccttcctcacggagcgcaccaagagcaagttcgtcatcgcgcgcgagggcaacgtcgcggagacgctcttcaagttcatccggccggagctggtgccagtgcagtacggcgggctgagccgcgccagcgagctagagaacgggccgcccaagccggcgtccgagttcaccatcaagggcggggagaaggtcttcctagagatcgacggcatcgaggccggtgcaacaataacgtgggacctggtcgtcggcggctgggagctggagtacggggcggagtacgtgccggcggcggagggaggctacacgctgtgcgtggagaggaccaggaaggtcccggccgccgccgccgagcccgtgcacaacgccttcacggccaaggagcccggcaagatggtgctctccatcgacaactccggctcacggaagcggaaggtcgccgcctaccgctacttcgtgcgcaagccgtcggcgtaggctaccctgctgctcgactgctgtggccggcggcttgccggccggcttgtgctttgctttgctgggcgtcagctcgtctcggagagtagattaatttaggtctatttaatcagtgctatataatgtgatatgcatgtattatggcatatgtagaatataatgtatgagccgtgagatcctacttgtcatcatcgttataaaagctaatgagttaagttt

SEQ ID NO: 204 - DNA, 2080 bp, Triticum aestivum
gccgcctgccggcgcatcccccctagccgccagatcgacggcggcacagtctttcttggtcgttcctctcgggcctcggcagatcgacgccggcggcgactcctctcgccctgccctcccgagcccggtttaaatggctgcaagaaaggataatgcagtccttattgcttgccaagctcccaatggccgtgtaacacgagctcaagctgctaattgtggaaggtttggagtgcctcacccagcaccggtacctgtcagaactgaacgaaaaccggcgactaaaggaaaggcgaaacggggagcttcagatgagaacacttgtgcaagtgctctaacttcagctccacctcctaaaaggcgagcagcactcaaggatgtgacaaacataagctgtgcaaactcgttcagaaattgcactgctgtgactaagctacagtcaaggcccacacagaaggtagggcgaaatccaagcaaaaacaagcagtgcgcaaagaaggcccctaagccacctcttcctactgttagtggaacttcatttgttgtgaatgattctcataatgtggaagaaactcagaaggcagagcttttgccaccaaaagaggagcccactgctctgctcgaaaacaaggggtcgttgtcattatggaattttgcacggaacagggagagtggtgttcatgagccattctttcagggaagaaacacaagagataaatctgaaactgccgactcaaacactggggactatgttggcttaaacgttatagacattgacaaagataatggcaatccacaaatgtgtgcttcctatgcggcagagatatacagaaacctaatggctgcagagcttataaggagacctaaatcaaattacatggagactttgcaaagggatatcacgaagggcatgcggggcatcctgattgattggcttgttgaggtttctgaggaatataaacttgtgccagacacactatacctcactgtatatcttattgatcaatttctttctcggaaatatattgaaagacagaaactacaacttcttggaataactagcatgctgattgcctcaaaatatgaagagatctgtgcgcctcgtgttgaagaattttgtttcataactgataacacatatacaaaaaatcaggtgctgaaaatggagtgtgaagtgcttaatgatctggggtttcatctttcagttcccacaatcaaaacgtttctgaggagattccttagagcagcacatgcttctcaaaaagctccttgtgcaactttgggctatctgggcaattatcttgcggagttgacattgaccgattacagtttcctgaaatttcacccttcagtggtggcagcctcggcggtgttccttgcaaaatggacactcgaccaatcagacctgccatggaactctactctcgagcattacacctcatacaaaagttcagatattcaaggatgcgtacgcgatctatgggagctgcagcaaggcaacaccagcggaagtccccccctcaatgctatacgtgagaaataccggcaggaaaagtttgaatgtgtagccaacatgctgtcgccggcgatgcctgggtcgctcttccatagacaagctaacggcaccagccccctgctgatcaacaactcgtagcagcgcagcgtcagccccctgctgatcaacaatttgattttttccgaagatcttgtagcatccccttcccaccaccctctccccctccgatctggttgtgttgttatttccccccgacctttttcgagtcgtgcagtcgtaggcgatggctcacataaatgttgattgagttcctgtgtaggctgctgatggatgcctagggctggtaattgtatgatgatgatgatcctgtctgtctgtctgtctgtatgataactgagtgagttccgcttgatttaacgtaggtttgcgggcgtttcccagagtttagtgagtgcaattgcagtgcagtgctcgctcttgagattaggagagcaactctagtgagtccaggatggttgatgtgatctgatgtgatgtaacctgttgttacaagaacattcattattg

SEQ ID NO: 205 - DNA, 1683 bp, Triticum aestivum
atggagcttcctcagctggcgtccttcctcggcgtggtgctcgccacggtgctcttcctcaaggccgtcctccgccgccgccgccgccgccagtacaacctcccgccgggccccaagccgtggccgatcatcggcaacctcaacctcatcggcacgctcccgcaccgctccatccacgcgctctccaagcagtacggcccgctcatgcagctccagttcggctccttcccggtcgtcgtcggctcctccgtggagatggccaagttcttcctcaagacccacgacgtggtgttcaccgaccgccccaagaccgccgccggcaggtacaccacctacaactacagcgacatcacctggtccccctacggcgcctactggcgccaggcccgcaagatgtgcctcaccgagctcttcagcgccaagcgcctcgagtcgtacgagtacatccgcagggaggaggtgctcgccctcctcggcgacctgtaccgcggcggcgcaggccgcgtggtggtgctcaaggactacctgtccacggtgagcctgaacgtgatcacgcgcatggtgatgggcaagaagtacctggagaaggaggtgagggacgaggcaggggcggtgatcacgacgcctgaggagttcaagtggatgatcgacgagctgttcctgctcaacggcgtgctcaacatcggcgactccatcccgtggctcgactggatggacctgcaggggtacatcaagaggatgaagaagctgagcaagatgttcgaccggttcctggagcacgtcgtggacgagcacagcgagcggcgtgggcacgagggggagagcttcgtggtcaaggacatggtggacgtgctgctgcagttcgccagcgatcccggtctcgaggtcaagctcaacagagagggcgtcaaggctttcactcaggacctcattgctggcggcacggagagctcggcggtgacagtggaatgggccctctcagagctcctgaagaagccagaggtgcttgccaaagccactgaggagttggaccgtgtggtggggcgaggccgatgggtcaccgaaaaggacatgccgagccttccctatgtggatgccatcgtcaaagaaaccatgcggttgcatccagtagcgccgatgcttgtaccccgcctttcccgtgaggacacgtccatcaatggctacgacattcctgccggcacacgggtgctagtcatggtctggtctattggtcgcgacccagagttgtgggaagcgccggaggagttcatgccggagcggttcctcggcagcaggctcgatgtcaaggggcaggattatgagttgcttccattcgggtcgggacgcaggatgtgccccgggtatagtcttgggttgaaggtgatccaggtaagcctagcgaacctcctgcacgggttcacgtggaggctccctgatggcgtggagctgagcatggaggagatcttcggactgtccacgccacgcaagttcccgctggaggctgtcatggagcccaagctcccagctcacctctacgttgaggcttgaatatttgatacatgtgtgctctcgtgtgttgagtaattattactacttgtgttgttttattttttctataatctttttctagtattgtatggtttgcggtgtaactaaagtgatcgagatgtgcaaggaagggtg

SEQ ID NO: 206 - DNA, 687 bp, Triticum aestivum
cttgcaaggttccatgagaccacagagcgctggcgcattagctgctacaacactggtgttcctctctttgatctgcaacatccagattttggtctcggtcacgggcttgtccagctttgcgatggataattccccaaataagccagagctcggtgctgctgccgccgccggcaatccagaggctgtagtccctgatgccgccaacgttgaggtcaacagtgtgccagcggttgatgctcaacacccagacccagcagacgtattggcttgggcattaagacagggtcaaattcatgcggacccacttatgcaaaggctggaaactgttggagcgctgctcgacatagaaatgcagattgttcccccagtgccccaccaagtgatcttggctgcactggaccagcttgccatgatgcctatgcctgccgccgatcatgctcctcccgaagcctcacaagagattgatgtagataccgagggggtggaaggtgatgtgccgccacccccggcaagtccctgagccacatatataagctgccgattgcaatcgactattttactatctatgtctgggaataattaataaatatcggcagtattatgattttatctcgcgttttgcttcagattcgtgatcctaaacagtgcaatgatttcgtttactacttcaattcttgttacggatac

SEQ ID NO: 207 - DNA, 2537 bp, Zea mays
gatcaaaggtgcagatcgcggcgcgtctcctcgttgccgtagggtttttctcatcgcttctcttaccagagccacctcctcagcaggccgcagctactccacggtgacggccgccatgagagccctcctctccctctcccgtctcgcccgacggcttccagcttctctcagccctgtgagggcgccgacaacattactcctccggcacatccatgcggacgcccctccgccaccgccatctcatgactcgacgcccttcgtctcccgcatcctcgaatcggagccgtgcctgaccccgaacgacgagtcggagccggcatccgatccgaccctcgacgagttcctcgcgcgcttcgtggctgccttccgcccgcgactggcggctgccttccccaaccatgaccgtgacgtgctcgacgagatgctccgcctcgtcgcggacgccgtgctgtgccgcctcaccgggaccgaccgggggggcgatgctattgagctcaatgacgacctctgggcggccgtatgggaggtcagcgcctccgtgcgcgaggctatgcgccgggatcaggtccgcgccgaccttcgccaataccttcactgcgacgaggtgaaggagatgacgcggttcgctgtcgatgtcggcatccgcggttccatgctccgggagctccgcttcaagtgggccggcgagaagctcgacgaggtcgagttctatcgcggccttgatgacaagcacgccgatgccgaggccggcgccgaccgggcgccagtgccgaggctgactgctttgccgaagaggaagggagaggtgaagttcacgatgtacgggctggacatgtctgacccaaagtgggctgaggtggcggagcgagtggccgaggctgaggcgcattttgtgcctgaggaggccaaggctgtagaagggagggcgaagaaggctgaggagcggctgctgtccgttgacccgaggagtggagatccggtgcctgccattgaggagtggaaggaagatctcaggccaaaccgtgtcgattggatatctctgcttgagcggattaaggcacggaatgtcgagttatacctcaaggttgctgaaattctgctagatcaagaatcttttgaggcaaacatccgagattactcaaaattaattgatcttcatgctaaagcaaataatgtggaaagtgcagagagagtacttggtaaaatgaaagagaagggtattgcacctgatgtcatcatatccatcgtattagtccacatgtatagcagggcaggcaagctagagcaggccaaggaggcttttgattttattcgtagggaggattttaaaccagatcggaaactcttcagttcaatgattaaatgctatatcaaccatggagaaccagaacaagcagaaaatctgataaaagttatgagggatacacgtgtcaaacccactagagaaatctacataggtctcttacgatcatatgttcagcgaggcttgatggcatatgcagagagggttcttaagacaatgtcatttgatagagtcgagcctacacaggaactctatacaatatgtatagaagcatatggacgtgttggtgatccaaaagaggcctgtgccatgtttgatcaaatgaggaggaagtttggacacgaagcagatgacagttcaattgctggtgtggtggccgcatacatgaagaataaccaactagaccatgctttgcagtggctgctgagtttagagaaggaaggacttcaacttggtgtcaagacaaatctcatgttactggattggttgtctatgttgcagctagttccggaggctgaacagtttgtgcagaagataaagaatcttggagaagagcccatagaagtccatgtgttccttgccgatatgtatgcgaagtcgtcccaggaagataaagcccgcaggtccctcaagatcttggaagagaagaagaaactattgaagtctgatcagtttgagagggttataagaggccttgtcgatggtgggttttcggaggaggcaaataaattctacaaaatgatgaaatcctgtggctttgaaccatcaaaaacaatcgaggtcgctgttaaggctctcaggattaggggcggttctcatcgcactggtaggtagagcctgtacgccggcagagtggcagtgatctactgggcacgcagtcaggcaaagagggattctggtgtgagaaccttgtggcactgacacggtacaatcaaattgacaaaactcagtgctgaaagatggtttggccaattttttttttctggttgtcaattgtctcgaggcgcgacgttgcttccatagactatgtagttaataggtcctggctaaatgactttgttgtttccagtgatcaggattttcacttgtattagatgaggtttgaagtgattgtaacactgatccatctttcaggttgtgccaaggaaaacatatatccgcgattagtggttattactctgttcagacatgcaatgatgtaagttaataaatattccttctggcttccggtcac

SEQ ID NO: 208 - DNA, 2178 bp, Zea mays
ccgaaacacagcagacaggagcaacattcacggacggaaacccctcaaccccgaccccctcgaggcctcgacccgacccgacccgcctccaactccaagccaagccgccatggcggctccgcccgcgaccaccgccacgactcaccaccgcgcgctcctcccgcccacgcgcacccacgccgccgctacgcactccgcgctccgcctcccgctccgcgcgcatccccacgcccacgcccagcgcgcgcgcctcaccgccgccgctgccccggcccccgcggcgtcgacggcctccctcgagtcctccgccgcggggaagcctacggtgctcgtggccgagaagctcggcgccgcggggcttgcgctgctgcgggaattcgccaacgtcgactgctcctacggcctctcccccgaggacctccgtgccaagatctcgctctgcgacgcgctcatcgtcaggtccgggaccaaggtcggccgcgacgtcttcgaggcgtccgggggcaggctccgcgtcgtcggccgcgccggcgtcggcatcgacaacgtcgaccttgccgccgccaccgagcacggatgcctcgtcgtcaacgcgcccactgccaacaccgtcgccgccgccgagcatggcatcgcgctgctcaccgccatggccaggaacatcgcgcaggcggacgcgtcactcaaggctggtaaatggcagcgcaacaagtatgttggtgtatctcttgtgggcaaaactctcgcgattcttgggttcgggaaggttggttcagaagttgctcgtcgcgctaaaggtttaggaatgcatgtgattgcacatgatccatacgcttctgctgatcgggcccgtgcaattggagttgagctagttagtatggaggaggccatgacaactgctgacttcatctcattgcacatgcctcttacccctgcaacaaacaagatgctcaacgatgaggcctttgctaagatgaagtatggtgttcgcattataaatgttgcacgcggtggtgtgattgatgaagatgctctagtcagggctcttgattcaggaatagtagcacaggctgctcttgatgtgttcactaaagaacctccagctcctgataacaagttggtgctgcacgagaatgttactgtcacacctcaccttggtgccagcacagtggaggcacaggaaggagtggctattgagatagctgaagctgtcattggagctctgaaaggggaacttgcagcttctgcagtcaacgctccaatggttcctgctgaggtgctgtcagagcttgcaccttttgttgtgcttgcagaaaagcttgggcatttagctgtgcaactagttgctggtggtggtggcatcaagtctgtgaaagtgacctatgcatctgcacgggcccctgatgatcttgacacgagacttctccgtgcaatgatcaccaagggattgattgagccaatctccagcgtttttgtcaatcttgttaatgctgacttcaccgcaaagcagaggggagttcgcatcactgaggagaggatcatcttggacggctcacctgagacgcctatcgactacattcaagttcagattgccaatgtcaagtccaaatttcctagtgcgatatctgagactggagagatcacagtggaggggagagtgaaggatggcgttcctcatctaacaaaggttggagcattccaggtggatgtgagcttggaaggaagcctgatcctttgcaggcaggttgatcagccaggtatgattgggtcggtaggaagtgtcttgggtgaggagaacattaatgtcagtttcatgagtgtcggaaggattgctcctcgcaagcatgctgtcatggcaatcggtgttgatgaggaaccaagcaaggtcacactgagaaagattggggagattccagcaatcgaagagtttgttttcctcaagctttaggcaactaagcgcaaatgtatgtttcaagttgcaagcatgctgtgcaattttgatgtagcttagcaatatagaggacggatggttctccttaaataagcttttaggattatttttgtagtggcgctcttgaatttggtgcaatattgatgccatcttttgaacggggtgttattctcagctactgtttcccaggttataaaaaataatatgtactccacgttccaatttat

SEQ ID NO: 209 - DNA, 3739 bp, Sorghum bicolor
ctcctctagtcttctccgcccttcccttcgctcgctcgtctcatttctcagctcgaactgctccccccactcctctcagacgccatccccatttctcgccggcggagcgcgcctgcgccccgggtgagagggagccaggatggccaagcccgctgccgccgagccattctccatacggtaagcgcgcgcgcgcgcgcgtccttctccgtctttccctcccggctccagcttctgcttcgtcttctgaccattcggcatggctgtgctgtgttctgacgtgagcgggggtgttcccgagcgtacgcgcctgacctgttggactgaatggcgcgcaggggttacgccatgaggatgcgggccgtcgacgcggccgagtgctacccgttcgtcggcggcggctgcagcgaaggggagggggagccgccgccgccgccgcggttcccgccgatggacccgaagccgctgtcacggtggtggaagcacgagctcgcggcggggcaggcccggcttttggctggcgccaagggcggagaggctgcggcagccggggtccgcggcagtgcgctgcggaaggggaccaagaggaagggatctcgctcgaactccacgggcgagagggccaggaaacggcggcgtgtgcttcagtttaggtcctttctgtcgaacaaggagagaactgctaagcctcagtcaacatttcgtttacatgaacagaagttgcatatggcaatgctgagaaagcataaaagttctactgtccatacaagtacagtacttgaaccaaggaagaaactggaagaggcatgtgatcgcatgccaactcatgaaaacagcgtgaaaaagcgacacagagagagaacggacccttctagtgaaatgaatagtgacctctacgggataaaggaagtgacctcctctgtaaataagcaagtcatagaagtcaatggttcaactaataagcctacaaacactggccacgaaatggtgaaaacttccacagggcccaaagatgatatctttggagatctccctctccttgaattagagagctccaaggttatgtttcggactggtgttcatgaacttccaactgttatagaagaatcatttataacaaatcaaaccgaagcagattctataccagaagttgtacccttggagctgatagatgcatctgacatcactgctcagacgccatctcctcttgaagacttggtgaaaagtgaagacagtgagccagcatgcatctcccacaatgatgtggcagggagtcacccttccactgttgggattgatggtctgccgaatcataagaacatcaatatggtgaaaccaggtcttggtgatatgcagttgaaatttactgacgtgtctgctttaggttctcattctgttctgaggtcaaaatctggttctggttaccctctgcagggttgttttgatgtgaacaagaactgctctcaggaaataaaaaaacatggtactaattctactagcagtccacctgccatgagaacaagaactgaagaaactaaatataaagatgcaccagttaagggcaagaagagtactgatatcactagtgcagcggttgcactacccgtgcctgccaaccaactttcatatcaagctagcgcgttgccctctgcagtatcacattcagttttcagcacaagagttgattcaaatgacatgtcttcattcagaagtatgcctgccaaggaatgcatcccaactaccagacctggtaacttaagaactaatgtgtgccatggaagtaggaaacatgtggatccatgtgtggcactatctacagataaccagggtagctcgcactcaaaacttcatccaatttgcagtcctgctaacattggaatgacttttatgaagctaccgggcctcgaacggatggagatctcaaactgcaatgtaaagataggcgaaaacaggtttagtaatgcagagtcaatgaacgcagtaagatatcagaaacaaccgtggttgagtggcatgacctatgtaatgcaaggtcagaaacagataggtctaagcagctctcaagttgggaaaccagctcttgatggttatgggggcgaaggtgatcatcatctgcagcaacccacagttcgtttgatgggtaagaccgtctcagtttgctcacatagcaaggatcataatgtatcgaccatggatcaagtgagtcctgacaatgttgccattgaagcaagccgcctatccacaatctcatgtcagttaccccaaaagagatcattcccttgtcaggattctgtgacaccaagagtgcatctaaacaactcttcagattttttggcaaggattcccaacaatagcatgcaagggcaaaatactgctttcagtggcctccataaccaaaggccacaaccaataaatagtgctccaaccgtgaaagattgcacttggaattttggtaatcagtttgttcgtcaagctgaactcaataaggcagctatagtcagcaccaactctcagactaggcatctagagctacatcaaccacctcaattgataagcattcctcagaatcaacagtctcatttgtggactccggcagcacagatgagtaggaaagatcagtgttttgtgggtccagcagtgaaccaatcttccctggttccaaaatcattgctaactgcaagtatgaaggaaaagtatcagaaatccactttgttgtcttacgatgatcctagttctatgcctatttgccaaccctaccagatacctggtgcaaactcatcttctgcatctgtcacatccttttttgagtatggtgcggataattcgttgtccagaagctcttctcctggactgagtctttctcttgcaactggtttggctaatgagtctgtttccacaggtagagtagcttgtgcaggcagtcttacaaatgcagatggtaggaaggctgctagctttgccgaaccaataagcaatagttcagcttatgcagataatgtttcacagcaacctgcaaagccaataagcaacagaacagcttatgcaacagataatgtttcacaacaacctgcaaagagacaacttgttacagatacacaggatttaatgtctatgggcccaaacattgtgaaccattcacctggctggtcacttagtgatgcagttggtcctcaggtacttgattttagtaaaagaatagcaagggatgctgttcaaacgtcaagaaatgaaagcaacaatccaagggccagttccggtccagttccgcctattgaaacatggtctaggcctgggttggttgcaggggctaataccatgttgaagccaggtcaaaacctgaatgatcattccaaactgctatactccaccaagttttcggttgataggggtatcaattcggttgtattatagtggaaagcaataaaaaaataataaggcgtccttgttgaagatagctctggagtttttcagtattcaaacagtcaggcacaggaaacttgtaagagctctacatttctgaacattttagtttagcaattgatggattgctttattcttgtaattttcctggtcaaatgtgcaaggttatttgattgtttgattacatgtcatgccatatctgacaaaagcttgaggacagttcaattgtacagattgtaactacttgagtgttttgtgggcattcaatttctaagactaagcagtatttgctatgaacccacttgatgggcagcagttcaat

SEQ ID NO: 210 - DNA, 1787 bp, Oryza sativa
gtctccggtccagagcgggaggcggccggcaatccgcgacctccacctcctcctcctcctcctctcgtcaccaccaccacggcgaccccgtcctcctcgcccctctaaaagcctctcccttcctttctctctccccttctcgtgggatcttgtattcttgcgtcgtcttgggactcttgtggtggtcaagaacgaggacgagagaggtcggagagcgaggcggcggctgtgccgttgcgcgtgcggtgcgggtgaggtagctagcgagcgagaggggagatggaggcggtggcggttgcgggcggtggcgcggggctgacaaggtggcaggcggcggcgctgtcggcggtggcggggtgggtgtgggcggcctcctccttcgacctcacgcggcggtcgcgcgcgctggtgcagccgtgggtcacccgccgcgtgctcgccgagacgccgtccatcgtcagattccagaaggtgcatcacaagttgctggacagtttcttctctgtgctgtcatgcgttgtctctgtccctttctacaccggattcctccctctcctcttctggagcggacactccaagctggctaggcagatgacgctgctcatggcattctgcgattaccttggcaattctgtgaaggacgcggtgtcagcccctcggccaagctctcctccggtgagaagagtgacagctactgaagacgagaaggaaaatgccatggaatatggattgccttcatcgcacgctcttaataccgtttgtttgatgggatatctgctgcattatgtcctaacatatggatcacacgacaatgttatggttgtcacgggcttatctctagctttcttgcttgttatgttagttggcattggacggatatatttgggcatgcacagcttgattgatgttattgctggcatctgttttggcgttgtaatcctggcattctggttggctgtccataatcatgtcgatgcttttgttgtctccggtcaaaatgttacaaccttctgggcgagcctttctctgttgctgtgcttcgcatatccaaaaccagaattcccaactcctagctttgaataccacacagcattcaatggggtggcttttggaattgtctatggaatccaacaaacctacttccatttccacaatcctgatgtccccctcattttcagcccacaattaccgcttattgtatttgtcgggagggttctcgtggggatcccaaccatcctagttgtgaaattctgcagtaaagctctctcgaaatggcttctaccggtgatgtgcaacaccctgggcattcctattgtatcaacctgctatgttccagcgctgaaggcttccgaaaagtgcaaggtcaagtccgacgcgaagcagggcggttatctccagaaggtgttctccctctttccacagaaggcgtacgatgtggacaccggcataaggttcgttcagtacgccagccttgcatggtcagtggtcgacctggtgccggccatattcactcatttaagtttgtagtgaacactgcaagatgcattctacttggagacttgcaaaatcccaaatgggctattcctactcatgagagagagataatcttatgggactgtaaatccgatgatctccactttatttttatttttgcgtggtgtgtgtagaggtgttttgtccatagtagcaaccaggaagtattaacatgctgtgaaattttgtttcatgatgaagacagcgaccaccacgaactctgaaacttaactgcaaagaaatgccattccttt

SEQ ID NO: 211 - DNA, 2862 bp, Zea mays
acagcactgttcggtggaatgcctcactagtcactcactactcactagtagggctcctgctgcctccaggtccagcccacgctaccccacaccgccgttcctccactgagcaaaccccgccgccgacgagatgaagggagcaatgccgccgcgccagttcatggtgccgggccctggggggccgatgctgccaccgcagcagcagttcgggctggtggagacgcgccccccgctggcggccgtgctgcggccgcgcttcaacatcccgggcctccacccgtcagcggcggccgccgccgcggcctcgggcgcgggcaagatcgcctccacctatgacctcgtcgagccgatgcggttcctctacgtgcacgtcgtcaaggcgcgagacctccccgcggtgtccgccacgggcgccatcgaccccttcgtcgaggtcaagctcggcaacttcaagggcaccacgcccgtcagggcggccagccacaacccgtcctggcagcaggtcttcgccttctccgccacgcacctccagtcccatctgctcgaggtcgccctcaaggccaaggatctcgccggcgacgacctcgtcggccgcgtcgccttcgacctcgcggaggtgccggtccgcgtgcccccggactcgccgctcgcgccgcagtggtaccgcctcgagaccaagcgcggcgagaagctgccgcacggcgagatcatgctctccgtctggctcgggacccaggccgacgaggcgttcccggacgcctggcactccgacgcgcacgccgccgcgggcccggcggccgtcgcgtccacgcgcgccaaggtatacttctcgcccaagctcgtctacctccgagtcgcggccatcgccgcgcaggacctcatcccgcatgacacctcgcgcccgatgagcgcctgcgtcaagctgcagctcgccggccagctccgccgcacgcgccccggcgcaccgccggggacgcccaacccgatttggaacgaggagttcatgttcgtcgcgtcggagcccttcgacgagccgctcgtcgtcaccgtcgaggaccgtgtcgcgccaggccgcgacgagatgctaggccgcattttcctgcccctcgcagcagcaatgccgcggcacgaccacttcggcaaacccgtggagccgcggtggtacagcctcatgcgcccctctgatgatcctgataagaaggaagtcaagttcgcaagcaagatacagattcggatgtcgcttgattttgggtaccatgtccttgacgagtccacctactacagcagtgatctgcagccatcatcaaaacctgcaaggaaaccaagcattgggatgcttgagctgggagttctgggtgcgcgaaacttggtaccgatgaagcccaaggatggacgcaccacggacgcctactgtgtggccaaatatggaccaaagtgggtgcgcaccaggactattcttgacacgctgaatccacaatggaatgagcagtatacctgggaggtctttgatccttgcaccgtgatcacagtggtggtgtttgacaatggtcaaattgggagcaagaatggcggtggcccagatcagcggattgggaaggtcaggatccggctctcaacactggagacggacagagtgtacacgcatttctaccctctgctggttttaaatccgagtggactcaagaagaccggcgagcttcatttggctgtgcggtttacctgcacagcttgggtgaacatgatggcgctgtatggtcgtccgctgcttccaaagatgcactacacgcagccgatcgctgtgatgcaactggactacctgaggcaccaggcaatgcagattgttgcagccagactcagccgcgctgagccgccgctgcgcagggaggttgtggaatatatgctcgatgtggattcacatatgtttagtctccggcgcagcaaggctaatttccatcgtatcacctcactgttctttggttttctggcaatgctcaagtggtacgacggcatcaggagctggtggaactcgatcacgacggtgctagtgcacatgctgttcctgatactgatctgctacccggagctcatcctgcctaccatcttcctctacatgttcatgatcgggctctggaactatcgtttcaggccaaggcatccgtcgcacatggacactaagctgtcccatgctgagctgacacaccctgatgagcttgacgaggagttcgacacattcccttcctccagaccagctgaaatcgtaaggatgcgctacgacaggctgaggagcatcggaggccgtgtgcagaccgtggttggggacctggcgacacaaggcgagagagcccatgctttgctgagctggagggaccctcgggccaccgccatcttcgttttcttgtccctggtggtcgccgttgttctgtacgtgacgccgttccaggttctgatggtgataggcatgctttacctgcttcgacatccccggttccgcagcaggatgccctccgtgcctttcaacttctacagaagactgcctgccaggtccgatatgctcctttgagatcacagtattcggcgtgagagaatcgggtgcaagtctttacttatttatgtctgttctgctcggttccttctgattagtatcagatcagatgtgaatataccagatgagttcgtatattagaggtcatttagtgtcccaggaataaggtgttggtttaatggttcatttccttttgagtttttgggatagtgaggggaggtttttgggtgcagaaatgtaatgttaactccgggctattagcatagaactaaaggcaggaacaatattatcccccgtgtattatgtttgtactatttgtg

SEQ ID NO: 212 - DNA, 4348 bp, Glycine max
atgaacatatcaggttatattggggtcctctatgattcattgggattttataggcaattccaccggcgagaaggagctttagaccttagaagaaacgaaatggaaaaagctgcacaagaaaagtgatcccgtttgctttcagccaaacacgtcgttaggcgcgtacttgagttgcgtcctaaaatctaattgaaaagtcccctgtttgttcttcttctcctcattcctcaacgatatggacaaactcggcgaagaagagcaactcagaaccagcaccttccaacgcttaaaatcacacactttgcaccttctcgaccttttgcagaaccctcacattcagtatcagaagcattgttctctcaccgtaatcccccaactccttcgtttccttcagagttcttcgccctctacgttacaacccttcttcgactacactctgtttccgttacttctgctcctcgatgcagcgatccagtgcaggtctactcagaaagttgattctcaggaaaattataacatgcctggtgttctgaaaacacctgttaatgtgagtgatggcgttgctgaaggtgtggttaattgtttggaggagcttcttaggaagtgtcgtttgaattctgtggatcagatggttgtgctgctaaaaaagttaacatatggggccatgttatcaccctccgaagcttcagaggagtttcgtgaaggaattttgttgtgcgtcaaggcactgcttttgagcttatattcctgttccgatgtgtcttgcttgtgtgaacaaattcctggtttgcctgcactttcggatgacatttataatgatgaacttcataaaactttcaagtatggttcggaatcagacaaatgtttacttgcatttctccagtctcaatttgcatcagctgctgttggacactggctatcacttcttctcaaaattgcagatacagaggctgctaggggacaaaaaggttctgcaagacttcgaattgaagcattcaaaactctgagggtgcttgttgcaaaggttggttatgcagacgcattagccttctttttgcctggcattgttagtcagttagctaaagttttgcacagtgcaaaaacaatgataagtggggctgctggaaatgtggaatctattgaccaagcaatcagaggtttggcagaatttcttatgatagtcctccaggatgatgctaatgcacctgccctagatattgaagcgtcttcagacttttattcaaatgagtgtaattcaacactttctcttttggatgagcttcgccacttgcaagttaaaaattgtgttaaaacaaaagctgctgaagatacagatgttgagtcagaaaaaatctcttgctcccaaactcaactccaagaaatggggaatactgatcctggcagagagaacatgtctttgcatgtgaaccgaacaaaagattggatgcagaagacatcagcacatgtaaataagctgttgagtgcaacatttccacatatctgtattcacccttcacaaaaggtgagaaagggacttgttgatgctataaaaggactcttgtcagagtgcttctacacactgggggaaagtagactgatgcttttggagtgcttatgtgccttggtcgttgatgtatctaatgatgtgtcttcaactgcacaagatttccttgagtgtttgttctcacaaaatttgaaacatgttataaaacacaatgctgctgagatatttatcaggaaccttgaaaagcttcccagagtggtgcttggccatgaggagtcacatgctgtgttacatgctcagcaattactaacaataatattttattctggtcctcgtctgttagtggatcatcttcagtctcctgtagaagctgctagattcctagatttgtttgctgcatgtctaagccataatacagtgttttctggtttgctcggcataatcactaaaacagatcgatcatcaactctgggatatcttccctccattgctgagttgaaatctggagctaatttcttcaattatggcccccttcttataaattctgctttatctgaagtccctaagtgcaggcttattgaggaaaaaagtatagatgaacctgtgaaaactgctcaaaacaactatgagcttcctcgcatgcccccttggtttagttatgttggtagtattaaattataccagcctcttgcagggattctccgatttgtgggtttatctttagtggcagataatataagtgaagggcttctgtcgcatgtgattgatattctactcggttacttccgtagattggtttctgagcttcgtttaaaagaatacaataaagaaagctggcagtcttggtatgacaggaatggttctggacagttattgcggcaagctagcacagctgcatgcatgctgaatgagatgatatttggtctatcagatcaagcaactaatgattttgctaggatatttcataggtctactctaagcagaggagttcaggttcagtcttacaaacatgatagtgcatttcatgaattttcctggaagaagtccaaggataaaggtgtaaggagttgtttagttgagtgcattggtgggatcttacacgagtatttatctactgaggtatggaatgttccaattgatggcagaattgctgacttgcagcttaatgctgcagttgaagaagatattagcctatactttttccaagatgctgcaatgctacgtgaggttattattgatggagtaggaatctttaatctgtgccttggaagagattttgtttcaagtggttttcttcattcttcactttatttattgctggagaaccttagttcttcaaattaccgagttagaaatgcagcagattctgtcttgcatatacttaccaccacatctagctatacaacagttggacagttagttttggaaaatgcagactatgtgattgattcaatatgtcaacaattacgccatttggatctaaatcatcatgtgccaaatgtgctggcatccatgctctcctacattggagtggctcacaagatattgcctcttcttgaggaaccgatgcgctctgtgtcaacagaacttgaaatactgggtagacaccaacatcctgatctaactgttccattcctaaaggcagtagtagaaattgtgaaggcatcaaaacgtgaagcttgcctgttgcccactcaggcagagtcgtttgccagatatgtcaggtctatggtctctaattcagaagaaacaacacaagacctgtgggaggacattttattcaagttaaatgattctagaagatatagacgaacagttggttctattgctggttcatgtattactgctgcaatcccacttctagcatcattcaagcaagaaatatgcttggccgctctggatataattgagggtggcacgttggcaatagcaaaagtagaagcagcttataaacttgaaagagaaattaaagaagcaacagaagaagcgctacaatcactatcattgtatcaactgaaggatactttggaagctaatgaagaagcggctgatgaaaacaggctgcttccggcaatgaataaaatatggccattcctggttacttgtattcagaacaggaacccagtggctgtccggagatgcttgaatgtgatcagcattgtagtgccagtttgcggaggagatttcttcacacggcgtttccacactgatgggacacacatttggaaacttctgatcacgtccccatttcataaaaagtcaaatttcaaagatgagaagacccctttacaactaccttatagaagcagttccgtgtgttcagaggattcattcgctgagacttcctatcttaaaattcagattgcagtgcttaacatgatagctgatttatgccgtaataagagcagttcctctgcactagaactcgttctgaagaaggtaagtggtctggttgtggggatagcttgtagcagtgttgttggacttcgagatgcttctctgaatgccctccatggacttgcatctattgatcctgatcttgtgtggattctcttggctgatatatactacactgctaagacagaaaattttcctccacctacaccagatttacctgaaatctctgaaattctccctcttcccatatcacccaaagaatatctatatgtgcagtatggaggacagagttatggttttgacatagatttggcttctctggatattattttcacaaaaattgattctcaatatcaaatgtatagctaaaatccgaattagcttatataatgttatttgtagcttttctatcccatttactcatcaacttccgatcttcccccacgc

SEQ ID NO: 213 - DNA, 1260 bp, Triticum aestivum
gcccactcaactcaagctcgagcttcacttcagccccacaaatggcgagcagctcactggtagtactggccgccatggccaccgtggccgcgctgctgctctccccggccacatccctgcccgtcttcaccggcgatgcctccccgggcttccacgccgcgtcgtgcccgcagctggacggcatcgtgtggtcgtccgtcgaggcggcgctgcggcaggaggtggcggtggcggcgggcctgctccgcctctacttccacgactgcttcccgcagggctgcgacgcctccatcctcctcaacaacaccgccgcccgcgagacggcgctgggccccaacctcaccatccagccgcgcgccatgcagctcatcgagtccatccgcgcccgggcgcacgccgtctgcgggcccgtcgtctcctgcgccgacatcaccctgctcgccacccgcgacatcatcgtcatctccggcgggccctggttcaacgtgccgcaggggaacctcgacagcctcgcccctgcggcacaggagaaggtgttcgacctcccggcgcccaaaacggccagcgtggcgacgctagtggagtccttcgccaccaggggcctcggcgacgtcgccgacctcgtggcgctctccggcgcgcacaccatcgggcggtcgcagtgcggcagcttcgaagaccggtcgcagcgcgccgacgataccttctcgcgcaagctggccgccaactgcagcaagcacccggagcggctgcagaacctggacgtgatcaccccggacctgttcgacaacgcgtactacaaggcgttggggttcaaccagggcgtgttcacctccgacatggcgctggtcaagaacaagacgacggcggccatcgtgaagcggttcgccgagagcaaggacgccttcttcgggcagttcgccaggtccatggagaagctcgccagggtgcccaagccggccggcaacgtcggcgagatccggcgcttcagctgcttcaggagcaacgcccagcgtgccgacgctgccgtcgacgccgccggtgaggaggaggaggagggcttctccgcctccgcttgatctgatggttcggtcaagtactaccgtgagtaagatggtcgtcggcaggcaggctagctaccagtgcgttgtgttagcgtgcatgcacggcatggccgtaggccgtagccaatcgtgtttgagttctcggcatgcttcgttttcttgcgtgcagcagtgttggtgtgtgtagcaataaaga

SEQ ID NO: 214 - DNA, 1258 bp, Glycine max
gtggcctggtttcttgttaaccaggtcctcaccagcttttaaatacttaaatttcaatcaatcccaattttctcacattccctttttgccctttctatctctctcgtctttctcccacaatgaacgatcttctaacggaatcatttgaaattccacgtggccaaggtcacggaggtggtggtgacattgagttaggagaatatgcaaggaattcaggagacctgggcttggatagtttcttcaagaaggttcaagagcttgataaacaatatgctaagctggataagcttttgaaaaagctccaggatgcccatgaggaatccaaagctgtgaccaaagctccttccatgaaggctataaagcagagaatggagaaagatgttgatgaagttaagaaaactgcacattacttaaagaccaaaattgaagaactggacaaagagaatttggcaaacaggcagaagcctgggtgtggaaaaggatcaggtgttgaccggtcaagaacagcgacaaccatttctttaaaaaagaaactgaaagataaaatggctgaatttcagaccctgagagaggccatccatcaagagtatcgcgaggtggttgagagacgcgtttttacagttacgggcacaagagctgatgaggagacaattgacagattaattgaaactggagatagtgaacaaattttccagaaggctattcaggaacaaggacgaggccagataatggacaccttggctgaaatacaagagcgacatgaagcagttagagatgttgagagaaaacttcttgatttacaacagatatttctggatattgcggtgttagtcgacgctcaaggagacatgcttgacaacatagaaacacaggtttcaagtgcagtggatcacgtgcagcaaggcaacaatgccctccagaaggcaaagaaactacaaaggaactctagaaaatggatgtgcattgcaatcatgatacttctcatcgttgttataatcattgttgttgctgtcatcaaaccatgggttaccaaaaagggtgcatagtatcctatcacttatacctcatgattctttttcctgatccattcttttatttccgcatgttttaagaacattctttccgtgttgtttgcacctgaaagaaacattggaccaacaaatattgaattgagttgtatactattgttacataaaagaaaatgtattgattactatctccaacacttctgaaagaaaacaaattacttttatttatc

SEQ ID NO: 215 - DNA, 2074 bp, Sorghum bicolor
cctgcccacctcaccccgccgttgctcccgagtcccaaaccccagcgcgagagaagaagagagggagatggtggggccgcagtacgatctcgtcgggaacccactgggcgcggtgcgcgccaccttcgagaggacggctgccgccgcggcggcggagtccggaggagccgaccctgtggcggccttccgggggaaggattggggcgctggcgacctcttccgctccttcctcttcgagcaagacggccttggcaaggttccggtgttggatgcatcaaatcttggattgatcaaaccaaacaccctggtccggtaccggggaatggtccaggatatgcttgggaatgagtactacattggtgctttcaaggatgggtcaacttggaggacaaacaagttcactgacgtctcaccgttctcaatgccgcatccttgtgattcgcatctttgggagcgccatctcttccactgtgtgcctgcacctggacaaaattcttggacactggagtcttcaccaggacctgatgttcgcaggatgtcaaactgcttggcacctgaattaagagagaaaaggaagagagatggggatgatgatactatggatgtttcagaaaatgggcacagagagtcttcttcattctgcaagaagccgaaggaaggcgatgctcatgtctcatccagttcaactgaagtggcaggaactgttccagagatgaatggaggcgatcatcatatacctggaagttccttttcatgtctggtgaagatctatgatatgcctgaaagtcaagtgaagctaaatgatgttattgagtttattggtgtatatacatttgacccagaacttgctgctcctagtgacaacccagatgacataatgttagacctcatggaagatgtaacagttcagttgcccccgagcaaggtgccacgtcttcactgtttggtatggagaaaattatcatcccacgattatatttcaaggcctgttgttgagccttcacctagcctgttaaaaggcattcggcaatctttgctctctcacctcaccctcgtgttaggcaatgatgaacttgcagcccagtgcttgctattgcatcttctatccagacttcgcaatagggtggacgtggtcactgttggcagactctccttgaatttcactggcttcaacaaggaaagtgcttccatatttgggaatcaactgtattctttaatccagaaattggtgccatattcacaagccatacctctgtcaattgactatctcaacacagccacacttcaacctagaaaggacaacaagtcaggaaggttggtcacaggagttctgcagctacctcaaggcactcatctgacctttgatgagactcttctgcagacagggtcattgacatctaaaggtgtggaaaataccatgctgctcaagaatctgatggagtcgcagaaggttgactacgattttgagtactacaagctggaaatggcagctgatgtgcagctacttactctctctgagggaaaatcaaacatccttccttcagacttggtagtgcctttccggccatcctctgttcccacagttaatgcaggtgctgaggaaactgagagttggaggtggtatttggccacagtaaggtctcttcctcagtccactgaacctgagacctaccagatgattcaagatgaaatggtcagtgccatgcgtgatgataggagcttgggttgttctgaacttagcaggtggctaacaatggcacaaataatggcctcaagctttggtgagaagagtctttctttggagcattggcagatggtgaaggagcttgagaggcttagaaagcagaggatgcaatgagatgatgcatcattagcatgtgtttttacactctaaatgttattatggtggtatgctgttatgtgtatagtactggatgtgtgaatcaagacatggatccaagtcatttcgtaacaactaacaacttctatgatcctatggatgctatgatgatgtctgctgtgcatttttttgctcaaatttgaaatttactctggttactatggcatgccaaaa

SEQ ID NO: 216 - DNA, 2198 bp, Sorghum bicolor
gccttataagcgcgcgcagcctaggcagctcgacgcatcttcgccgccgcacaaggctcccccacacgaaacctaccttcctccgggagacgattcgacagggagaggaaagaggcaagaggagccatggacgctgccaactcggtaacgccgggcgccgtgtcgcacatcctggcgcacccgtcgacgggctccgacggcgccgtgccggatctcgtcgtccaggtcctcgacctcaagtccatcggcacgggcagccggttcagtttcatggcaaccgacgggaaggataagatcaaggcgatgttccccaccagcttcgcgtcggaggtccgctccggcaatctgaagaacctcggcctcatccgcatcctcgactacacttgcaacgccgtcaacggcaacaatggcaaagtcttgattgtcatcaaatgcgagcttgtgtgccaagcgctcgacgccgagatcaacggcgaggccaagaaagaggagcctccaattgtgctgaagcctaaggacgaaggcgtggtcgtggctgagcaggcaaatgctcccccagtcgcgattaagcccaagcaggagttgaagtccgcgtcccagatcgtgaacgagcagcgtggaaatgctgctcctgctgcgcgcctttccatgacaaggagggtccatcctttgatcactctgaacccctaccagggtaactgggtcattaaggtgcgggtcacgagcaaaggcaacctgagaacctacaggaatgctcgtggagaaggctgtgtcttcaatgtagagctcactgatgaggatggcacccagatccaggccaccatgttcaatgaggctgcaaagaagttctatccaatttttgagctgggaaaggtctattatgtctcaaaaggatctcttagaattgccaacaagcagttcaagactgttcaaaatgactatgagatgtcactaaacgagaatgctattgttgaagaagcagagggggaaactttcattccgcaagtgcaatacaactttgtcaagattgatcatctaggaacatatgttggtggcagggaacttgttgatattatcggtgtggttcagagtgtatctcccacactcagcgttaggagaaagattgacaatgagacaataccaaagcgtgacattgttgtagcagatgactctggcaaaactgttagtatttctctctggaatgatcttgctactactactggccaagagcttttggacatggttgacagttctcctgttgttgcgataaagagcctaaaagtatctgatttccaaggcgtgtcactttcaactataggcagaagcactcttgctattaatccagacctgcctgaggctcagaatgttaaatcatggtatgactctgaaggcaaagatacttcactagcaccaattggtgcagaaatgggtgctgcacgggctggtggcctgaagtccatgtattctgatagagtttttctgtctcacatcaccagtgatcctgctatgggccaggaaaagcctgttttcttcagtttaaatgccatcataagccacatcaagcctgaccagaatatgtggtaccgtgcttgcaagacctgcaacaagaaggtgactgaagcttttggatctggatactggtgtgagggatgccaaaagaacgactctgaatgctcactgagatacataatggtcctcaagatctctgatcccactggtgaggcatgggtgtccgtgttcaacgagcatgctgagaagatcattggctgcagcgctgacgagcttgatcggatcaggaaagaggagggcgatgacagttacattctcaagctcaaggaagccacctgggttcctcaccttttccgcgtcagcgtcacgcagcatgaatacatgaacgagaaaaggcagaggatcaccgtgaggagtgaagcaccggtcgactatgcagctgaatccaagtacctgcttgaagagatcgcgaagcttactgcttgctagaagatgcaatctttctggtggttcgtgaaggaggactggcccctgatatggttccctcgcaagggttttgagctgtagtaactttattactgttctgtgttgctctcattggtctttagcacttctgtaagatatgtagatgttggttcaccttgatgtaagcacaacagatgctatgacagttcaagcatgaagccttt

SEQ ID NO: 217 - DNA, 1508 bp, Sorghum bicolor
ctcctcccccatctcctctttttctctctctccgagtccgctccaatgccgttgcctctctcctccacctgccgcttctcataaacgcctccggccgcccccccccgggcacaaaccctagccctcaaccacgccgagctcgccggaacccgcccaacccgagcccaattccgctcgggtcccggccgatccggcggctccccaccagcacgatccggggcagcgtccccccgcggatgctagcctgatcgggtccccacggtcgatgggttcgcccgggtccgccaatggcagacgcggcgagtacgtgaggatcccggaggaggtggaggtggcgtccaagggggagggggatgccgcggcggccgtcaaggcggccgcggcggcggagtgcccgagggtgctgcggtgccgcgcgatccggtggtgggccaaggtcgccgtgctcgggatcttccttgcaggggccggagctgctgcggtcgtcttcctcggcccgctccttatcaagaaggttgtttcacctattctttactgggaatcaacaactttcagcagaccagctattgctctaatatgttttggcgcaatcgctttattcccaagtgttttgttaccttcttcacccttcatgtggcttgcggggatgacttttggatatctttatggctttttgataatcacagtggggatgagcataggcatgtcattgccgtatttcataggctccgcattccacagtaggatacatagatggttggagaagtggccaaagaaagcagcttttgtaaggcttgctggcgaaggagattggcatcatcaatttaaggctgttgcattactaaggatttctccatttccatatatagtttttaattatgcttctgtggctacgaatgtcaaatattacccatacatagcgggttctatggctggaaccatacatgaaacttttcttgcaatatacagtgggaaacttctacaaagcttggctgtagcaactagccatgggtccttcttgtcgttggatcagattatctacaatggaatcggctttacaattgctgcagcttccactgctgcgatcactatttatgcaaagaaagcacttcaaaagctccaagcggaggacgagatattttgagcgcatgaggtccaagccaaggatcaaacccataacgctagtttcctttcaggtgtattatatatgaacagttgctactaatttggtttcctgtgtcaactacctgactactacaaccatctgaggaggggggagggtgctgcagcaattgtaaagaaaatagacccagaaaacacttacgttttccgttcttcttgttttgttttctgtagagagaactgtcaacttcatcagtgtattgcattgcgcgatgtaaattcccaagtcgaaagttgtttccttgtcttgagaagtataacatgatatgcgttgttggatgctggcagcgttgatatatattacatacactgcaggcatgttttgc

SEQ ID NO: 218 - DNA, 3551 bp, Sorghum bicolor
ctactctcttcgggccgcctctccgctcttccctcctcccaaatctcaaaccccgctcccagctccgccgccgagcaaaaccctaggggcttcccagcgctgccgccgccgccatggacgacagcctctacgacgagttcggcaactacataggcccagagctcgccgactccgacgccgatgacgactccgacgctggcggcgcctcaccgtccccctccgcgtccggctcgccgtcaccggcggcgcgctcctcgtcgggctccccctcccgcccagccgcgctcatggacgtcgacgacgacgagggcgacccgtcccagcaggccgtggtgctcgccgaggacaaaaagtactaccccaccgccgaggaggtgtacggacctggcgtggaggcgctcgtcatggacgaggacgagcagccgctcgagatgcccatcatcgcgccgccccgcgtcgtgaagttcgaggtcgggacccgcgccgcggccacgtctacctacgcgtccaccgacttcctcctcggcctcgcgggcaaccccgcgctcgtccgcaacgtcaccctcgtcggccacctccagcacgggaagacggtgttcatggacatgctcgtagagcagacacacgaagtggacaccttcgactctgagggggagcgccatgtgcggttcactgacacaagggtggacgagcaggagaggcaggtctccatcaaggctgtgccaatgtcgcttgttctcgaggggggaaacggcaagtcatacctgtgcaacatcatggacacgcccgggcatgtcaacttctctgatgagatgactgcagcactgagacttgcggatggcgctgtgctcgttgttgatgctgccgagggagtaatggttaatactgagagggcaattcgtcatgcaattcaagaaaggcttcccatcgttgttgtgattaacaaggttgacagattgataacagaactaaagctgcccccaaatgatgcatatttcaagctgaggcatactctagaggcaattaatgatcttatctcatcatgttctactacagtaggtggcactcagctggtggatcctgctgctggaaatgtatgttttgcaagtggtgctgctggctggtcttttaccttacagtcttttgcccatctctacttaaagattcatgggattcaatttgaccatgagaaatttgcatctcgcctatggggagacctgtattttcaccctgattctagaacctttaaaaagaagccgccaaaggaaggagctaacagatcatttgttgagtttatccttgagcctctgtacaaaatttatagtctggtcgttggtgagcaaaaagggaatgtggaatcaaagcttgctgaattgggtgtcacgttgagcaatgcagcttataagcttaatgttagacctttgctgaggttagcttgccgctcaatttttggcactgctactggttttaccgatatgttagtgaaacatatcccctcagtgaaggatgctgctgcaaggaagatagaccacatatacactggaccacaagattcctctattgtggatgctatgaaaaaatgtgatcccaatggaccccttatggttaacgtaacaaaactatatccaaagtctgattgcagtgtctttgatgcctttggacgagtttacagtggcacaatacagactggacagactgtgagggtccttggagaaggctattctccagatgatgaagaggatatgactgtcaaagaggtgaccaaattgtgggtttatcaggcacgataccgtgttgcaattagtaaagcccctgctggctcttgggttcttattgaaggtgtagatgcatcaataatgaaaactgctactatatgtcctatgaatattgatgaagatgtatacatatttagacctctacgtttcaacaccttgcctgttgtaaaaatagctgctgagcctctcaacccaagtgagcttcctaaaatggtcgaaggtcttcgtaaaattagcaagagctatcctcttgctattaccaaggttgaggagtctggagagcacactatcctggggactggtgaactatatctggattccataatgaaggacctcagagagctttattcagaggttgaggtgaaggtagcagatcctgttgttacattttgtgaaacagttgttgatacttcttctatgaaatgttttgctgaaacacctaacaagaggaacaaaattactatgcttgccgaaccattagagaagggcttagcagaagatattgagaatggtcttgttagcctggattcaaggcagaaagaaattactgacttctttcgccaacgctaccagtgggatgtgcttgcagctaggtcgatatgggcttttggacctgacaagcagggtcctaacattcttctggatgacacactttcaattgaggttgacaagaacctgctcaatgcggtcaaagattcaattgttcaagggttccagtggggtgctagagaaggtcctttgtgtgatgaaccaattaggaacgtgaaattcaagatcttaaatgcaaacatagctccagaaccattgcatcgtggtggtggtcagataattcccacagcacgtcgtgttgtctactctgcattccttatggctaatcctcgccttatggaacctgtgtattatgttgagatccaaacaccaattgactgtgtgtctgcaatttatacggtgctatcccggcggcgtggtcacgtaacagctgatgtgcccaagccaggcactccaatatacattgttaaggcatttttacctgttatagagtcttttggatttgagacagatctcagataccatacccagggacaagccttttgtttgtcagtattcgatcactgggctattgttcctggtgaccccttagataagagtattgttcttcgccccctggagccagcacctatacagcaccttgcccgtgagttcatggtaaagaccaggcgaaggaagggcatgagtgaagatgtgagcatcaataaattcttcgacgaggccatgatgaatgagctggctcaacaggctgctgatatccacttgcaaatgatgtagtccaaaagcgagatgaggtgcacacttgagaagatgcaaatgccttcagcttctttatacactagctgcagatgggacttccggagttccagtcacaccactatatgctggcatttgcccgtaccagtttttgcttggctgacacattttgattgctgggtttcatgtagcgaatgatcatggtggtaccgtatgcaatcatgtatgtactagcttctacaccatctaaccaatcagcacccttgaggatcgagactaattttttttactatttttattaaactctgagcggcaatggcatcttcgccggtgtagatttgaagtaagattttacttatttgatcccttttgtttttgctgctcggtttcttgaaatctcaacaaatgtaccactgaaaatggtctgaaagtgttcagggacaacgtggaatgcaatgatattgttttttt

SEQ ID NO: 219 - DNA, 3076 bp, Sorghum bicolor
tcctccgccggcccccgcaccgcatcctcatttcttcgctttgctttgcttttgggaaggaaagtctcccttccctcggctcggcaccacctgcctgccactcctcttccacccaccttccccccccgccccaaaaacaccagcagatctaccacaacgcctgctcggccttgctcggcgcttcttgggccgagccctagcagctagtcccgatttccgatctcggccaccaccaccaccacctccacctcccctatatatctcacaagttcagctcctgctagcctatcaggatggctgaggaaactgccaatgaagttcaggtggcacaagataacgagattgtccccggcaatgaggcaatccaaggcgatgaatttgtccatggtgatgagttgatccaaggcgaagagttggctcatggtgaagagctgccccaaggtgatgatttggttcaaggaaatgagctggttgtttctgaggtagcaacccctcctactactggaaccagacgtaggagaaaaaagtccttggtatgggagcacttcactattgaagccgtcgccggtggggccacaagggcctgctgcaagctctgcaagcaaacctttgcttacagctctggttcaaaaattgctgggactagtcatctcaagaggcacatcaccttgggctcctgtccaaagataaagaatcaagagcagaggctggcactaccttcaaccggagggactgacaatgatggtgagggaactatcgagcgcccaaccaagagacgctacagatatactggctatgcaaatgctgcttttgatcaggaccgcagttgctcacacttggcaaagatgatcattcagcatgactacccacttcacattgtccaacagccggcattttccatttttattgaaagtctgcagccacgtttcaagattgtggatgttgatacgatggaaggagaggtgtatgctgtttatcagaaagaaaaggagaacctgctacaatcattcagcactatgcctggaaggatcagtctcactataggattgtggacaactagtcagactcttgggtatgtttcacttgcagggcagtttatcgactccgagtggaaagtgcatcgaaggatgcttaacttcatgatggtgtcatctcctcattcagagaacgcacttagtgaggcaattagcctgagcctctctgactggaatatgaaggacaagctattcaccatcacattggataatgattgctcctcacatgatatctacagtgcaaatttgagagatcatctctccaacaagaacaatctcatgcttaagggacagctctttgttgtgaggtgctacgctcatatccttaatgctgttgcacaagatgtcattgcttcgattcatggtgttgtatacagcatccgtgaaagcataaagttcataaaagcttcttctgcccgtgaagagaagtttgccgagattgctctgcagctggagattcccagtactaagaccctctgtctggatgttacaacccagtggaacaccacttatctgatgttgttagctgccttggattataagcagactttcactacactagaaacatgtgatgacaactacaatgaagctccgtcagcagaggattggaagaaagttgaggctgcctgtaattacctgaaactgctatacgattctgcacatagcatcatggcagcagcaaacccaactgcaaacatctttttccatgaagcttggaaacttcagctagagctagcaaatggcacaggacatgaagatcccgctttcagtagcatcgccaaggatatgcatgagaggtttgacaagtactggaaagattgcagcctcgtgttagccattgctgttgtcatggatccacgttttaagatgaagcttgttgagttcagttactcaaaaatttatggggctgaggccgcaaagtatgttaaggtggtcaatgatgctgtacatgagctgtataaggagtatgtggctcagccactcccactgaccccagcttatgttgagcaaggtgaagggaataatggaccagccaatgcgaataacagtcaaggcccgcctgcttccactggtgatgggcttctagactttgatatgtacctttccgagatccaaagtagccagccctcgaaatctgagctggaacagtacctggatgaatccctcactccacgtatccaggagtttgatatcctgaactggtggaagctaaacacagtaaagtttccaaccctctctaaaatggcccgtgatatcttggccattccaatgtccatggtaagcagtggcagctctatattctctgctggaacaggaagtcacatgctcgatgattacagaagctctctccgacctgagattgtggaagcacttgtctgcgcaaaagactggctccagtattcaccacctgccaccgaggcaccgagttctgcactggtgaaggctgaaggatcgtaggtttgtcgtcgccactgatcactgcctgccttgtggaagcaagaatctatttatccatctgtcgtatctatgagtgtagttaactgtaggtgtattgtaggctgagattgtgaactgattgtgatctattctggtatttatctcgtaaaggtgtgtaacttgtgttgaactctgctgaacttgtcactgttgtcatgtaatagtttatgtatcattttctggtatcgtctgatgttggagtttgcatgcttggctatgtacgtgtacaagccgtgggatgcatcagctggttgctgtgtattttgtttgaacccccgttttgtattcaatttgttttgtactgtgaattggtgtccatgttcttgtatagctgtagaaattgtctaatttaagtgtgtgctccctgtggccagttttactgaatgattgctgtttttgtgtttgagatgcttgtcgtggtgtgatggctgcgctgcatgaattttatcttctcaggcaagtgctgactgatctttgagttaggcattgtttagtttcactcaaaatccaaaacttcttaagattctccatcacatcgaattttg

SEQ ID NO: 220 - DNA, 2516 bp, Oryza sativa
atggtgttgtaatcgcttcattgtccaattttatttagacgtaagcaggcagtactacttatgtacaggtgcggagagttgcatcgggagaaaaagcctactatatgataattcgacggatttgctgttaaatccgagttaaccaaacagaagccgatcagagaccctaccctccgccgatgcgtcgagaagaagcctccgccgccgccgccgccgccgaggctgggaccccgcgctcaccggacctccacgacctctccgacgactccgactacgccgccgccgccgccgcgtcctccagtcactcggcgatgcggagcgatctggtggatcaagggtcgggcgagacggcgaaggtggatgtggtgtacgagaaggagcgtgtgacgatccacccgacgcagtatggctccggccggatcagcgggaagctgcgcctctacttgcagcagggctccctgttcctgagttgggagccaaatgagggagttgattctttatcaagcaattcagctaccatggaaatagaaaaatatagaaacctgtacactataaaggccttgccattaagtgatgtacgcttcatccgtaagcacaccccgacatttggattcgagtacataatcattgttctctcatcaggattggcttttcctccattctatttctacaatggtgggcttcgtgaattgtttgcgacactaaagaagcatgtttttattatcaggtcggacgatgatcctaatgtatttcttgtcaacgactttcaagatcctctacagaaaagtttgtcatcactggagcttcctggtgttgccaccgtagcaaatgccatgtcacgacagaactcactcagtttcactagttcagttgatgaagccagacatgggagtgatgccaaacatggggcatcttctagcatgactgaatatgtctcaaagcaaaagcacagatcgaatgatccgggtcgtgatctttctatccaagtactggagaaattttctctggttacaaagtttgcacgagataccacgtcaagtctttttcgggaaaaccacagtagtggtggtcatacttatggaaggcagcagcaagaatatgttttggacaacagagcaaatgataagtacaaagatcagcaaataacaccagataaggattctttgctgtcagattcaatggagtctaataaaattctagcgtggggaaaaccaagagaacaaccgttgagtgttgatgagtggagatccttcttagatcctgaaggtagagttatggattcgaaggcgctgaggaaaaaggttttctatggagggattgaccatgttctgagaaaagaggtctggaaattcctgttggggtatcatgaatacgattcaacatatgccgagagggaatatcttgctgtcatgaaaagaacagaatatgaagccataaaatcccagtggaagagtatttcgtccacacaagctaaaagatttaccaagtttagggaaagaaaaggccttatcgacaaagatgtggtgaggacagatagatcagttccatattatgaaggagatgacaatcaaaatgttcttgtgctacgggatatcctgttgacgtattccttctataatttcgaccttggctattgccaaggaatgagtgattttctggcacctatactttatgtgatggaggatgagtctgagtcattttggtgctttgcaattttgatggaacgactaggagccaattttaaccgtgatcagaatggcatgcatgctcagttacttgcattatccaagctcgtggagcttcttgatcctcagttacataactattttcggaagaacgactgcttaaactactttttctgttttcgttgggttcttatacaattcaaaagggagttcagtttcgatcaaatcatgctgctgtgggaagttctgtggacacattattggtcagaacatttccacctctacttatgcgtcgcgatcctgaaaaggtaccggtcgcggataataggagagcagatggatttcgacacccttctcaagttcatcaatgagctcagtggcgagataaatcttgaccgggcaattcaggacgcggaggcattatgtgatcaggcaggccctaacggggctgcctgcattcctcctggaaccccgccttctatgcccatcgagacggacggtggcctctacgtacaagaagacgaggtcatgtgagataccggcgattcagtggtcacctcatacgacaactgccatagaaagcattgcactggtttccataattccattgggtgcttggtacgttggtatatataaattatgaaggtgatcaaaataatgaaatctggctgttgtatatatgtacgttgaaatatcagttctcgatgaacccaacaatagttaacacaagtctcttttttttgcttaatggaaatggattgtcttttagacgcctatgtttggcttcactgcgtaaatatataatattatgtcacgtgatacttatcaact

SEQ ID NO: 221 - DNA, 2145 bp, Oryza sativa
acgcatccactcctctcctctcttccgttccttctccctcgccgtcggccaccgcatcgccgtcgtccgccgccgacagggacagcgttccagccatggacaagggcgccctgatgccgtcgcccgacgagacgtgctgcgtcggcggaggcgggggctcgtcgttctcgagcctgcgcgcgtacgggcgcgcgctggcgcagacgccgcggcggctggcggcgcgggcgtgcgccgcggcctcgcccggcgaggagatgagccgcgtgcgcgcgcgctcgggggccgacatggcgcgcgccctgcggtggccggacctcgtcgggctcggcctcggcggcatggtgggcgccggggtgttcgtcaccacggggcgcgccacgcgcctctacgcgggcccggccgtcgtcgtgtcgtacgccattgccggcctctgcgcgctcctctccgccttctgctacaccgagttcgccgtcgacatgcccgtcgccggcggcgccttcagctacctccgcgtcaccttcggggagttagcggcgttcttgacaggggcgaacctgatcatggagtacgtcttctccaacgccgccgtggcgaggagcttcacggcgtacctcggcacagcggtgggcgtcgacgcgccgagcaagtggcggatcgccgtgccaggcctccccaagggcttcaacgaggttgacctcgtcgccgtcggcgtcatcctcctcatcaccgtctgcatctgctacagcacgaaggagagctcgtcggtgaacatggtgctgacggcagtgcacgtgttgttcatcatgttcgtcattgtgatgggattctggcgcggtgacacccggaatctgacgcgccccgccgacccggagcacaaccccggcgggttcttcccgcacggcgctgccggggtgttcaacggcgccgccatggtgtacctgagctacatcgggtacgacgcggtgtccaccatggccgaggaggtggagcggccgtcacgcgacatccccatcggcgtctccggctccgtcgtgctcgtcacactgctctactgcctcatggccgcttccatgtccatgcttcttccctacgacgcgattgacacggaggcgccgttctctggggcgttcaaggggagctctgggtggggatgggtgtccaacgtgatcggcgccggcgctagccttggcatcctaacgtcgctgatggtagcgatgctgggacaagctaggtatctctgcgtcatcggccgatccggtgtcatgccggcctggctcgccagggtgaaccctcgcactgccacccccgtcaatgcctccgccttcctcggggtgttcacggcggcgctggcgctgttcacggagctcgacatcctcctcaacctcgtctgcatcggcacgctcttcgtcttctacatggtggccaacgccgtcgtctaccgccgctacgtcgccgccgccgaggacgacgaggaggggcggcggcgcggggcggtgccgacgctggcgttcctgctggccttctccctggtggcgctctgcttcacgctggtgtggaagctggcgccgcgcggcggggccaggacggggctgctggtggcgtgcggcgcggcggccgccgccgccgtcgcggcgttccgggcgctggtgccgcaggcgcggcggccggagctgtggggcgtcccggccatgccgtgggtgcccgcggcgtcggtgttcctcaacgtcttcctcctcggctcgctcgaccgcccctcctacgtccgcttcggcttcttcaccgccgccgccgcgctcgtctacgtgctctacagcgtgcacgccagctacgacgccgacgaggccgccgccgcgctcgacggtgccaaggtgctcgacgagggctgcaaggtataactagctttggggggtggctgacatgtagggacagctggtcaagtgtactctgtagtagattttttttttcttcttctttcttgctatatggtgtttcagcctttttttcaggctaaagtagttttttagtgttggattaaaaaaaaggctctaagtagtttttggtggtaaaaaaagattcaagatgctaacagggtgaaaagacaaggaaatagacaggagtgtgaatgagtggaaggaaagagag

SEQ ID NO: 222 - DNA, 1477 bp, Oryza sativa
gccaccgcgtgatcgagcgccgcgcgggcagtgcacacgagggaggcctggactgggcggcgctcgcgagtcgcgacgccacccgcccgcgccgcggccatctcatctccctccttcctcccaccttcccaatccctcccccccgcgccacctcacgtcgccatttcaactccatcctcgcgtgaacgagacgagacccctccgaccccttcaactccgcgtctcctcctcctcccccctcttaactcctccctcctcccgatccaagaaaccggagcaaatcgtggccgatcttgtgttctagtgagttgctgcagccatgaacaatctcttctctagctcgtggaagcgcaccggcggcggcggcggcggcgacggggatattgaatcgggcggcggcgtggagatggcgccgccgccgggggcggcggcgggggcgagccttgataggttcttcgaggacgtggagtcgatcaaggacgagctccgcgacctggagcggatccagcggtcgctccacgacgccaacgaggggggcaagtcgctgcacgacgcggcggcggtgcgcgcgctgcgggcgcgcatggacgccgacgtcgccgccgccatcaagaaggccaaggtggtgaagctccgcctcgagtcgctcgaccgcgccaacgccgccaaccgctccgtccccgggtgcggcccgggctcctccaccgaccgcacccgcacctccgtcgtcgccggcctccgcaagaagctccgcgactccatggaatccttctcctccctccgcgcccgcatctcctccgagtaccgggagaccgtggcgcggcggtactacaccgtcaccggcgagcagcccgacgaggcgacgctcgacaacctcgccgagaccggggaaggggagcggttcctgcagcgcgcgatcgccgagcagggccgcggcgaggtgctcggcgtggtcgccgagatccaggagcggcacggcgccgtggcggagctggaacgctcgctgctcgagctccaccaggtgttcaacgacatggccgtgctggtggcggcgcagggggagcagctcgacgacatcgagacccatgtcggccgcgcgcgctccttcgtcgaccgcggccgcgagcagctggtggtggcgcggaagcatcagaagagcacccgcaagtggacctgcatcgccatcatcatcctgctcgtcctcatcctcgtcgtcgtcctccccatcgtgctcaagttcgtcaacaacaacaagagcagcagcagctcgccggcgccggcgacgccgtcgccgccgccgccaacggcatgatggtcgtatgatagtccatgttgagttcatacttcatagtgagagatttctatttttttgtcgggttttttctttcgtgattgtaattacttctgtatgattagttgatcgtcttgattattatacatatctgattcttctaaatatcattgcatttgaaactgc

SEQ ID NO: 223 - DNA, 2053 bp, Zea mays
caccgaccactctccccccctccccagtccccactactgctactgcgagacagcgcagcacaggctgccgcccgctggccgctgcgagcagagagaatccaagaacgcgcaagagcccccctcgtcaccaccgtccatgggcggcgctgcgggcgaggcgatgtgggccgctgttgtggcggcgacggtggtcttcttggccgtcgaggtttcgggtgccgcgtcggcgttgccacggtttgcggaggcgcctgagtaccggaacggggaagggtgtccggctgcggcggcgggggtgtgcgacccgggcttggtgcacatcgccatgacgctcgacacgcactacctgcggggctccatggcggcggtgtactcgctgctcaagcacgcgtcctgcccggagtccatcttcttccacttcttggccgcggaggccggggcagtggacggggcggacccggagccggagctgctgcggcgcgcggtggcggcgtcgttcccgtcgctgcggttcgagatctacccgttccgcgccgaggccgtggccgggctcatctcggcgtccgtgcgcgccgcgctcgaggcgccgctcaactacgcgcggaaccacctagcggacctgctcccgcgctgcgtgccgcgggcgatatacctcgactccgacgtgctcgccgccgacgacgtgaggcggctctgggagacgcgcctccccgccgccgccgtggtggcggcgcccgagtactgccacgccaacttctcccgctacttcacgccagcgttctggtcagacccggtgctcggggcccgcgtcttcgccgggcgccgccggccgccgtgctacttcaacaccggcgtcatggtcatcgacctccgccgctggcgcgccggcaattaccgccaacgcatcgagcgctggatggaaatccagaagcagaagcgcatctacgagctgggctccctgcccccgttcttgctcgtcttcgccggtgaggtcgaggccgtcgaccaccgatggaaccagcacggcctcggcggcaacaacgtccacggtagctgccgcccgctccacgctgggcccgtcagcctcatgcactggtcgggcaagggcaagccctgggaccgcctcgacgccggcaggccgtgcccgctcgaccacacctggaagtcgtacgacctctacatccccggcgactctggaggcgccgcctcgccggcgtccgggccggcattgtccgcatccgtgttctcttggtagagagatagcttctagttccattgtcttgctgtggctgttgccgccgctgctatgatctagctgccgctcgtggtgggctgtacagggcggcgttgggagcggcggtggcgacatgacaggggaaatcaggaatgagttgatagagaagggggagcctttgccctcgggggtagaattcagataagttattggggagagattttgattctttttggtcgggctggtgattcttgggttcccaattctctcgattggatgttgtaaagacttggaattttgttcaattattgatcattctttcattcatgtgccatgccttcttgacctgaatccttttgctattttttttttacctttattacattagatgaactaacctaactgtactgaaatgcgcatgtatatgagttctctgccagtttgagacaggcttatctcccctgcaatggttcttgtatatgatgttaatgctgaataattctccactgaatttgtcaaatgaggcgaggagcctagctggcagtacattgatgattcatggagctgagatgttgcattggtccatcggacctgatgcgtctgtcttgaacgaaatgttcttgaaacctggctagtagtgggctattcatctgcagtggactgtttgtgatgtactttctaccctgatcgaccagctgaaggctgaattagcaccggaattgaatctctgtttctagaaaatgcctattgcagctgttatattctctgtattcattcctgttgtatcgatttttatgtcagaattcaatactcagcaca

SEQ ID NO: 224 - DNA, 1639 bp, Zea mays
acacacttcaattacgattattccagataagcacgatccgatgatggccccaccgatatccgccgatgccttggtggaggctgcctcggccgtcgccgcgtacccagccatcgcgccgaacagaatgctttgcaaggacgcgccggcgccggccatctctgtcgtctcgaagcagacggtccggcccgccggcgcgtcggcggcggtcggcagtggagacctcaggctctcggtgtcggacatgccgatgctatcgtgccactacatccagaaggggctgttcttcccgccgcctcctcccggcgtgctggcggcctcgctggtgtcgtcgctcgtggcggcgctctcccgcgcgctcggcgtcttccccgcgctcgccggccgcctcgtcacgctccacgacgacagcatcgtgatacggtgcggcggcgacgacgccgccgtcgagttctaccacgcggtggcgccgtctctgtcgctcggcgacttcctggtgcccggcgccgacgtgccgacccgtttgacgaacggcctgttccccatggaccggacggtgagctacggcggccacggccgcccgctcacggcgttccagctcaccgtgctcggcgacggcgccgtgttcgtcggcttcgtcgccaaccacgccgtcgtggacggcacctccttctggcacttcttcaacacgtgggcggggctgtgccgcggcgcgccggtccgggagcccgacttccgccgcaacttcttcggcgactccaccgccgtcctacgcttccccggaggcgcgagccccgccgtgacgttcgacgccgacgcgccgctccgcgagcggatcctccacttcagtgctgccgcaatcagcgagctgaaggcgacggccaaccgctcgaaaagagcaggtcaggaagccgaggctaacggcaagctcgcgcacgacgactccagacttgaagggcgttccggtgaaatctcgtcgtttcagtcgctgtgcgcgcacatctggagggcggtgacgcgcgcgcgccggctgctggctgccgacaagacgacgacgttccgcatggccgtgaactgccggcaccgtctgcgcccggcgatctccccgctctacttcggcaacgcgatccagagcgtggcgacgacggccaccgtagccgagctggcgtccaacgacctgggctgggcggccgcccggctgaacgccaccgtggcgtcgcacaaggacggcgcgatccggcgcgccgcggcggagtgggaggccgcgccccgttgcttcccgctaggcaaccccgacggggcggccctcacgatggggagctcgcctcggttcccgatgtacgacgggaacgacttcgggtggggccgcgcgctcgccgtgcggagcggccgcgcgaacaaattcgacggcaagatgtcttcgttccccggacaggctggggacggtagcatcgacgtggaggtgtgcctcgcgccagacaccatggcgcatctcctcctcgacaaggagttcttgcagtacgtgtcctcccctgcaccgtgaggcggtgacagagtgaatgtgtggcttgttgctgcgcagctacatatagtaactggatttgtaccctttcagcagatatcaagtgcttgccaactttaa

SEQ ID NO: 225 - DNA, 1286 bp, Zea mays
ccgcacttcaccggcctcctcctcctccccgtccatcgccgtcgccggggcttcctacaacttcaaaatggcggctaccgccaccgccatggctatagcaactatctcccccgccgctccgattccatccgcgcccttcccatcccttcccctccccctcggcctccgcctccgctctcaacccctcctcttcgctgcttcccgccgccgcttcctccatgttcccaaagccgcctcctgggacgaatccgtccccgaggatggtggagatgcggaggaatccgttgccgctggggacgacgaggacgaggaggagaagcagcggcccgagccggtgtcctcctccgagttccagttcgcggcgccacccgagggctacgtcgagcccgcggcgtttgacgagctaccgccggagtccccagaagacgtggcggcggcgtacgaatctctctacgggccggccttcagcggcgagacattgctggggaacaatgtctttgaggtcaaggtggtcgaccccatcgacatggaccgggagcagcgcccgaacgacgatttcaccgagcgcgtcgtgcaggtcaaccgcgtcaccaaggtcgtcaagggagggaggcagctctcctaccgcgcaatcgtcgtcgttggcgacatgaagggccacgttggtgtcggcgtgggaaaggccaaggaggtcacggaggccatcaccaaggccgccatgaacggccggcgcaaccttgtcacagtgccgctaactaagtactccacattcccgcacagagctgatgcggactatggagcagccaaggtgatgctgaggcctgcttgccctggatctggtgtcattgctggtggagccgtgagggttgtgctggagatggctggtgttgaaaatgctctgggcaagcagctgcgcagcaagaaccccctgaacaacgctcgagccactatcaaggcgacgcagatgatgaagcagttcaaggatgtcgctgaggagcgtggtattccaatggaggagctgtggaaatgataaaaacaattcgaaaccaagacccccccccccctttgtagcattctttctcctgtcgctgtatttttcttaaggtcttcatttttctgctgtatctatgggatgaatcccgcctcacggtttcttttttgcatctctcttctgaaattctgtgtgtgagaatttagtccatgagatctgaccctatatgcttgctcttcacttctgtacactgctactggtggaaattcagaccaaagaatgaacagatttagcg

SEQ ID NO: 226 - DNA, 1952 bp, Zea mays
cagcggcagccaggcactcaccaaggaaacctttttaaatctggccccttgacgcgcagcgggagaggctcatcaccccgtgtgccctcgcctcgcctcgccccgccgcccgccccaatcgaccaatcccgtccatatcaaaaaaatgggaattgtcgccgccgccaccaccgccgccgccacgtgcacgtcccgactcctccaccaccacgcaacctatcaccggcaccagctcaggtactctgcgagtccgtttcctctctcgctgcactgtggctccggccggcgtgaggcggcggcccgggcgctcctgcccgaccgcgtcaccccgttctcttacggcgtggatgaggacgcggatgaccacccgcgcgaggagtgcggtttagtcggggtcgtgggcgacccggacgcgtcgtcgctgtgctatctggggctgcagaagctgcagcaccgcggggaggagggggccgggatcgtcgccgtgggcggggacggcaagctcaagtccgttaccgggctgggtctcgtggccgacgtgttcggggacccgtcccggctcgcctcgctcccgggtcccgccgccatcggacacgtgcgctactccacggccggcgccgccgcttcgctgcgcaacgtgcagccgttcctggccgggtaccggttcgggcaggtcgccgtggcgcataacggcaacctcgtcaactaccaggcgctacggaacaagctcgaggccagggggtccatcttcaacacgtcctcggacacggaggtcatcctccacctcatcgcgacgtcgctgtcgcggcccctgctcgcccgggtctgcgacgcctgcgagcgcctcgcggggtcctactcgctcctgttcctcacggccgacaagctcttcgccgtgcgcgacccacatgggttccgcccgctggtgatgggccgccgccggaacggcgctgtcgtcttcgcgtcggagacctgcgcgctggacctcatcgacgccacctacgagcgcgaggtggagcccggggaggtggtcatggtcgaccgccgcgacatgtcggtcgcctcggcctgcctcctcccgcaccgcccccggcgcgcctgcgtgttcgagcacatctacttctcgctgcccaactcggtggtgttctcgcacgccgttcacgagcgccgtaccgccttcggacaggcgctggccgaggagtcccctgccccgggcgccgacgtcgtcatcccggtgcctgactcgggcttctacgccgcgctcgggttcgcacgcgcgtcggggctcgagttccagcagggtctcatccgttggcattacagcggccgcagcttcatccagccgacgcaagcgatccgggacctcgccgtgaagctgaagctcgcccccgtgcgcggcgtcatcaccggcaagagcgtcgttgtcgtggacgactccctggtgcgcggcaccacctcgagcaagatcgtgcggctgctccgagacgccggcgcgcgggaggtgcatatgcggatcgcgagcccaccagttgtgggctcctgcctctatggcatcgacacgccgagcgagggcgagctcatctccaatcggatggacatggatggcgtgcgccgggagatcggcagcgactcactcgccttcctctcgctgggcaagctgcacagcatctacggcgaagagtcgagggactactgcgacgcgtgcttctcgcgcaagtaccctgtgctgcccacactagccgacccggccgccgagccggaggagtgagccgggagcagatgagctctgctctgctctgcttcgtctgccatacttctaggttgctgtcgctggattcagccctgttccgagtgttggacaattgtgcgcggctgtagttttatatgacgataaagcgctatgtcatggtactctaataaaaaaaataacaaaagccaaaaatttagtacgg

SEQ ID NO: 227 - DNA, 639 bp, Zea mays
acttgcgtgccaattcatccccagtggtaaattggaagttactagaacgaacagccgtttcgtatttcgttttgtcttctgactccggtccggtaagtaatcagagtccaggcggcagcacagcagcttcctttcctccggcgatggcgaagaatcccaaagatgccgctccggaggaggagatgcccgccgcggccgaggaacaggcagcgcctgccgcgacggtgaaggtgctcttcttcgcccgcgcgcgggacctaacgggcgtggcggattccgcggtggaggtgccgccggggagcaccgcgggggagtgcctcgcgcgggtcctagcccagttccccaagctggaggagatccggggctccgtcgtgctcgcgctcaacgaggagtacgcggccgactcggccgcggtcgccgacggcgacgagctcgctgtcataccgcccatcagtggcggctgacgttattaaccacggccgacttgtgtggaggtaataaaagatatgaagacatcgatcgttgaggaaaaaaaaaagagagaagaaaggttcctctcccttcttcatggtcagtttatcaccacgaatgattgaaattattatatgctcgataaaataatctcttgttcttgattac

SEQ ID NO: 228 - DNA, 1758 bp, Zea mays
tcgccacccaaaagacaccgcgatcccgtgcttccttctcgcacctgcggatctactctccgcacctgcggatctaccccccggcgaaacaagcgccccgacgcctcagggaatgcggagcgatgaggcggcgctcaggcactgacgtcgccggtcagcgcgagctgcgcggcgaccgaacctgccatcgcaagcacgtcgaggacgggtagactcgtccatccttccttcctcttgttagtggtcgtagggtagtttgcactttgcagatagctagctagctagtagtaggggatcaggcatgggtgagggcgaggcggaggtgaagggcggggtgctgcagggccgctacgagctcggccgcgtgctgggtcacggcaacttcgggcgcgtccacgcggcgcgggacctgcgcaccgggcgggccgtggcggtgaaggtgctcgacaaggacaagatgctgcgcacgggcatgatggagcagatcaagcgcgagatcgccgtcatgaagcgcgtgtcccaccccaacatcgtggagctccacgaggtgatggccacgcgctccaagatctacctcgcgctggagctcgtccgcggaggggagctcttcgcgcggatcgtgcgcgccgggcgcgtcaaggaggacgtggcgcggcgctacttccggcagctcatacacgccgtggacttctgccacgcgcggggcgtgtaccaccgcgacctgaagctcgagaacctcctcctggacgacgcggggaacctcaaggtcgtcgactttggcctcagcgcgctggccgaccacgcgcgcagcgacgggctgctgcacacgctctgcggcacgcccgggtacgtcgcgccggaggtgttccggaacaagggctacgacggcgccaaggctgacatctggtcgtgcggcgtcatcctctacgtcctcctcgcagggtcgctgccgttcccggacgacaacgttgccgccatgttccggaagatgagccgcggcgactaccggtgcccgccgtggctgtccacggaggcgcgcaggctcatccccaagctgctcgaccccgaccccgacacccgcatcaccatcgcccagctcgtcgagacgccgtggttcaacaagccgtccgtctcgaggtccgtcagagccgccgccggcgcaaccgagccgccggccgagcctgcctcctccgcaaaggacggcggcgacaaggacgagccaccggagacgatgaacgcgttccacctgatctccctctccgcggggttcgacctctcaccgctgttcgacgtggaaggcggtccggcgagggggccccgggagggcggcatgcggttcgcgacgcgggagcccgcgagcggcgtcgtctcccgtctcgaggaggtggccgcccgcggcggcgggcggatgcgggtgaccaagagcggcgcccgcggcgttcggctcgagggcgcggagcgcgggggccgcaagggccggctagccgtggcggccgacatcttctgcgtggcgccgtcggtgctcgtcgtcgacgtgaagaaggacggcggcgactccctcgagtaccgctccttctgcagcgaggagctccggccggcgctcaaagacatcgtctgggcggccgacccccagcccgccgtcgtgtgacgcccgtgctgccgcctgcccgctcattgtttctggatcgtagtggtgccatagtttagtcagtgtcagttccatttccaaagtgattgcgtcactgttctcgattcgat

SEQ ID NO: 229 - DNA, 4031 bp, Zea mays
cgcttccgcagacggccaggccaacgcaaccgctcctgccatccgcaccagtccccccctcccctccctcccggactcacccggccgccagcggggtaagtcgccggcgggctttctttgcatgtttatttatgtaacccggcccggccgaaacaaaacccccggccgcgcgcacgccaagattgctgcccccacccccctggcctccgctcaaaccaccgctcgacttctcctcgtgtaggtttggccgcttcctcctcctctgcggcgggagcgggacaacagacacaggggcacagaggaaccggcgcggggcggcgcaatgggggacgctgcggcggcggggaccctgcacaagagctacttcgacgtgctggggatctgctgcccctccgaggtgcccctcgtcgagaagctgctgcggccgctgcccggcgtgcgcaccgtcaccgtcatcgtcccgtcccgcaccgtcatcgtgctccacgacgccgccgccacctcgcccgcgcaaatcgtgaaggcgttgaaccaggcgaggctagaggcgtccgtgcgggcgtacggcggtgggtcggacgggaggcaggcagccggcagcaagagatggccgagcccgtacgtcctcctctgcgggctcctcctcgtcgtctcgctcttcgagcgcctctggcctcccctcaagtggtgcgcgctggcggcggcggccgccggcctgccgccgatcgccctcaggagcttcgcggccgcgcggaggctcaccctcgacgtcaacatactcatgctcatcgcagtttccggggcgatagctctcaaggactactccgaggctgggttcatcgtgttcctgttcactacggccgaatggctggagaccagggcgagccacaaggcgactgctgggatgtcgtcgctgatgagcatggcgccacagaaggctgtcgtagcagagacgggggaggtggtggcggctcaggacgtcaaggtgggcacggtgctagccgtcaaagccggggaggtcgtgcccatcgacggcgtggtcgtggacgggcggagcgaggtcgacgagagcaccctcaccggggagtccttcccggtcgccaagcagccggagtcccaggtctgggccggcacgctcaacatcgatggctacatcgctgtcaggacaactgccatggcggacaactctgccgtcgctaagatggcgaggatggttgaggaagcacagaacagtaggtcccgaactcagaggctgattgatacgtgcgccaagtactatacgcccgctgttgtggtcatggctgcgggggtggcggtggttcctgtggtggtgagagcgcacaacctcaagcactggttccaactggccctggtcctgctggtgagcgcgtgcccgtgcgcactagtgctgtcgacgccggtggccaccttctgcgctctcctgacggccgcgaggacggggctcctcatcaaaggaggggacgtcctcgaaaccctggccaggatcaagattgccgcctttgataagacaggtacgatcactcgaggggagttcagcgtcgaggagttccaggcggttggcgagcgcgtcactacgccacagctcctttactgggtctcgagcattgagagcagatcgagccacccaatggcgtctgtgctggttgattatgcccagtcgaagtcagttggacccaaatctgataatgtcgccgagttccaaatcttccccggtgaggggatttacggtgagatcgatggggaaggtgtgtatattgggaacaagaggattttgtcaagggcctcatgtgaaacagttcctgacatgaaagatatgaaaggagttaccgtcggatacgttgcctgcaaagggcagttaatcggagtattcactctctcggattcctgccgaactggatcagatgaggccatcagggagctgaggtcgctgggcatcaagtcagtgatgcttactggggatagttctgcagcagcttcatatgcacagaaccagcttgggaacatacttgatgaggttcactctgagcttcttccagaggacaaggtgaggatcgtcgacgagctcaaggcaaagcatggcccgactctgatgatcggcgacggcatgaacgatgccccagcgctggccaaggccgacgtcggagtctcgatgggggtatctgggtcagcggttgcgatggagacgagccacataaccctgatgtcaaacgacatccgccggatcccgatggccgtccagctggcgcggaggacgcaccggacgatcgtcgtcaacatcgtcttctcggtgatcaccaagcttgcgatcgtcgggctcgcgctcgccgggcatccgctcatctgggcagccgtcctcgcggacgtcggcacatgcatgctggtgatcatgtacagcatgctgctgctgagatcggaatcgaacggcggccggaaggtgaagaagtgctgtgcctcgtcgcagcatgggtcacactcacacgccaggaagaagcattgtgtctcccaccactgttcagatggcccgtgcaacaagtcgacggcaggctgttccaaggaatcgccgtctgctggtaagcatgcttgcagtgatcatggccatgcccacacccactgcaaagagccgagcaaccaccggccggaaaggcatgcctgtcatgatcacggccacagccataaccactgcaaagagcccagcagccatgtggttacagaaaagcatgtctgccatgaccacggcaacacccatagccactgcgaagaggcaggcaaccagctgctgcttgtagagagccacggttgcaatgaccatggccatgggcatagccatgaccgctgcaaagagctcagcagcccgcgcttcaccagcaagcacgagtgccatgaccatgagcatagccactgcaaagagcccaagactccgtgtgctgacagtgaggctgcttgccatggccatggccatggacacgaacatcggcactgcgaaggggacagccactcacacgctacaggtgagcatggctgccatgaacatgatgcgcacagccactgcgaggagcacggccattcagacaccgctgttgagcatgcttgcgagcatgagtgccatggtgagcaccaaactgtgcacgctgtggaaacacaccactgccatgaccacgaccatgagcacggacagcatgagcttggggagatcgaggaacctgagaaggactgccacgaccacagccaccactgctgccatgagcctcacggcaaggacaaggtcgcggccgagccagttgaagaggtcacgatctcaatcgctgccctgcccaaagacgaaggccaccaccacagcgaggaacaacacaatggggagcactgcaggaaggcgaaagactgcggcggcggcggcggcgctgctcccaccgactgcgctgcgagcaagaactgctgcggcgtcaaaggtggagacgcctgctcgagcgtgcaggccgcgcgtgctagggagaccggcccgtgctgccggagctacgtgaagtgccccaggacggcggcggcgagcaggagcagctgctgcggccacagcatgctgaagctgcccgagatcgtggtagagtagtagtagtactgtagtagggtggaaattccaccgtgggagaagggtgtgcacatatgaacaagcaactgtgaggtgagtgtgactcgccggcgtaaatgtagactaagatcgccggtgcagggtgtttgatctagtagtctagttactatataggtttgctggagaaaaaaatgatgtaggattttgactgagcagagcagggggtctgaaaggtggaaggaagggctctgcttggttttcctgcacactgctcctctgtttgcgtcttctgtggcggcggcggcaatggagactgtcacagacgaaggatgtcatgtgactagtgccggccggggccaacactaatattcaggaactatccatatccatttcggtcccttttaaaatgggagtttctttttctatctcc

SEQ ID NO: 230 - DNA, 1527 bp, Zea mays
gccaaattgccaatgacaatatcataagctgcatccaggtcggagatgcccacacagccaccaacacgtacccaactcccacgcagctcggttcagtaaaagctactagcagtagtgggcggtggttggcacatcgcagttgatacggaggcgtagcgtaggctgtactggttctcccgcgtcggcgtcgacggccgtgtccttctcgggaagatggtaatgggggccgcgtccgtcggcacgctgctcgtcgcgctcgccgtcctcgctccggcggtgatgacgcagagctgcgacgacgagctgccggctcagctcgccggcaacttctcggggctcgcctgcgcccccgtctggaacagcttcgtgctccggtacgcgcaggacaaggacaacgtgctgcgggtggtgctgtcgaccatgtacagcacggggtgggtggggatggggttctccaagaacggcctcatggtggactccagcgccatggtggggtggatcggcaagacggggctcccgcacatcaagccgttctcgctgcggggcaagaccccctcccaggtggtcgcggaccagggcttcctcgtctccagcgacaaccacaagcccaccgtgctcgtgcagcaggccaagatctacctcgccttccagctcagcttcaccgagccgctcaggcgccagaacgtgctcctcgccgtcggctccgccatccccgtcaacgaccgcctcgccgagcaccaggataagacctccatcgtattcgatttcaccacaggcagctcatcaggctcgtcatccttcccggaaggtctgaaaaggacccatggggcgctcaacctgttcgcctggggcgtgctactgccgatcggcgccatcgtcgcaaggtactgcaggagatgggaccctctgtggttctacctccacgccggcatccagttcgtggggttcatcctgggcctagccggcgtcgtggctggagtatccttgtacagcaagatccaggccgacgtccccgcgcacaggggccttggcatattcgtgctcgtgcttgccattttgcagatcctggcgattttcctgaggcccaacaaggactccaagtaccgcaagttctggaactggtaccaccactgggtcggcaggctcgccctcttctttgcagccatcaacattgtgctcgggatcaaggtcggcggagcaggcaactcttggaagatcggctacggtttcaacctggccgtccttctgatcaccatcgtcaccctggaagtcctgctctggacgaggtggaaaaacagcaccggttccacgggggcatattagctacttaaccgatttttataggtgtttgtgatggtcagtgaaggaggttcgtattcttttgttcgaatattttcgcgtgtatgcagttgctgtaatgtccgcgtttgctgcgtgatgtgttttccttttggtgcatgtgtcctggacttgccgttccgatgccttttgtgctgctcggaatggagatggaatgatgatttccgc

SEQ ID NO: 231 - DNA, 1168 bp, Zea mays
tccgcctgctgcctgcctcaacggatcgacgcgacaggagggagggaggaaggagacggtcgatcagagtctgagacggaggccgatccaccaccgcagcgacgagcgggaggagatgaagatcatcattgacacggatcccggcatcgatgacagcgtggccatcctgatggcattccagatgccgggcgtccaggtcctagggctcaccaccatcttcggaaactgcaccacagagcatgccacacgcaacgccttgatcctgtgcgagaaggcaagccatctagaggtcccagtagctgagggcagccatgagcctctcaagggaggaaagccgcacgttgctgacttcgttcatggacctgatggcctcgggaacgtagatcttcctgatcccactatcaagaaagtggaggaaagtgctaccgacttcttggttgataaggtctcgcgatttcctggagaggtctctgtgctcgccttgggtcctctgacaaacatagcattggccatcaagaaggatccctcattcgtgaaaaacgttaagaagatcgttgtgctgggtggagcgttctttgcggctggaaatgccactccttccgctgaagcaaatatccacagtgatccggaggcagccgacatggttttcacttctggggcggacatctacgtcgttggcctcaacatcacaacgcaagtcagcttcacagataaggatctcctggagctaagaaactcgcaagggaagtacgcacagttcctatgtgatgtatgcaagttctacttggactggcacaccgagtcttatggtgctcctgtgattttcctccacgatccggtcagctttgccgcgctagttcgtccggagctgttcacgttcaagaagggcgtggtgagggtggagacgcagggcatctgcgtcgggcatacttccatggacatgttgctgaagaagtggaactcagagaacccgtggactggctactcaccgatttcggtcgcatggacggtcgatgtgcccaaggtggtcgcgtttgtgaaggagctcgtcaccaagccgtgaaccaagttaactaacgtgttgtggtctcgcgcaccagatgtgcagcaaatttgagatgtcgatatatttactcacattcgaagcactgcaaacactattatctca

SEQ ID NO: 232 - DNA, 2101 bp, Zea mays
atttttgtaaggacttggctgcgtttcgtaattagtaacagtaaacttttccatggaaaagacgggttagcggagctgcaacttcaccgactgcagtctcagcggtgatccatgaatcccctttgggccttccgctgccagcaaatagcaatagtagtgtttgatcccgttccaaaaacaaaaacaaaaagaagagccacacattttggaaacttttttgtggggcccgcccgcagcaccaaaaccataccaacccccgcaatggcaaaccaaacaaattcgtgtactcaaattggacccgtctcggcgctctctcccaaaaaaacgctataaaatccccggcattcctccttgcctgttccatcgcctccacgaacaaaccacacaccccacctaccccggccggaccggcaggcagcacagcatggacctcgccctcctagagaaggccctgctgggcctgttcgccgcggctgtggtggccatcgccgtggccaagctgaccggcaagcggtaccgcctcccaccggggcccccgggcgcccccgtggtgggaaactggctgcaggtgggcgacgacctgaaccaccgcaacctgatggccatggcgaagcggttcggcgacatcttcctgctgcgcatgggcgtgcgcaacctggtggtggtgtcgaccccggagctggccaaggaggtgctccacacgcagggcgtggagttcggctcccgcacccgcaacgtggtgttcgacatcttcacgggcaaggggcaggacatggtgttcacggtgtacggcgaccactggcgcaagatgcggcgcatcatgaccgtccccttcttcaccaacaaggtggtggcccagaaccgcgccgggtgggaggaggaggcccggctggtggtggaggacgtgaggaaggaccccgaggccgcggccggcggcgtcgtgctccgccgccgcctccagctgatgatgtacaacgacatgttccgcatcatgttcgaccgccggttcgacagcgagcacgacccgctcttcaacaagctcaaggcgctcaacgcggagcgcagccgcctgtcgcagagcttcgagtacaactacggcgacttcatccccgtgctccgccccttcctccgcggctacctcaaccgctgccacgacctcaagacgcgccgcatgaaggtcttcgaggacaacttcgtacaggagcgcaagaaggtgatggctcagactggtgagatccggtgcgccatggatcacatcctcgaggccgagaggaagggcgagatcaaccacgacaacgtcctctacatcgtcgagaacatcaacgtcgcagcgatcgagacgacgctgtggtcgatcgagtggggcatcgccgagctggtgaaccacccggccatccagcacaagctccgggaggagctcgcctcggtgctgggcgccggcgtgcctgtgacggagccggacctcgagcgcctcccctaccttcaggccatcgtcaaggagacgctccgcctgcgcatggccatcccgctgctggtcccccacatgaacctcaacgacggcaagctcgccggcttcgacatccccgccgagtccaagatcctcgtcaatgcctggttcctcgccaacgaccccaagaggtgggtgcgccccgacgagttccggcccgagcgcttcctggaggaggagaagtccgtggaggcccacggcaacgacttccgattcgtgccctttggggtcggccgccggagctgccctgggatcatcctcgcgctgcctatcatcggcatcaccctgggccggctggtgcagaacttccagctgctgccgccgccggggctggacaagatcgacaccacggagaagcccggccagttcagcaaccagatcgccaagcatgccaccatcgtctgcaagcccctcgaggcctagaaatcaatgcgtgtttcctgcacgcgcccccgcagatgaagcactatgtattttctcttttttttgtgtgttgtgttttttttactaagaggagatgtatttcttgttcgtaaaatgcacttagtcaaatggatcgagattatgttgatcattaaacaccaaaatcactta

SEQ ID NO: 233 - DNA, 940 bp, Zea mays
aagcctgtggacgcgagtgagtgaacaccagccgtattgtcccgactcctgacccctaccgatcctcgcctgctgcagccatggcgacctccgcggcgctctccaccgccgccaatcccacccagctctaccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaacggcgctgagaacaagttcatctgcccctgccacggatcccagtacaacaaccagggcaaggtggtccgtggaccggcgcctctgtcgctggccctggttcacgccgacgtcgacgacggcaaggtcctcttcgtcccgtgggtggagaccgacttcaggaccggcgaggacccatggtggaaggcatgaggatgatccggaaccagcggtgctcagtgctcacacatgagacctatgtatgcctccgttccttgtgatgaggaaataggcttgcgttcgttctccgtgggcgttgttcctacaaattcacttgctctttgtctctctctatatatacacactgtataaaacaagaacacctgtttatc

SEQ ID NO: 234 - DNA, 1148 bp, Gossypium hirsutum
attattattcaaattggtagttggagttataaaacatatccaaatgtcatgggtactgggtaggccgaaaacattataaaagagctttgagcaattaagttggtttctgtctttcaacttctgagcttcgttctttctttctttctttgtttctgtcagttgttcaacaatggctacaactgacgtttccccaatggatcaaaatcccacacctcctaaacagccatcatttcaacaacactgccctcctgattttccaagaaaggtgtttgcagagacgatagcaacctacttgctggtttttgtgacatgtggatcagctgccattagttcggttgatgaacataaaatctcaaggttaggagcttcagttgcaggtggacttattgtgactgtaatgatctatgcagttggtcatgtttctggtgcacatatgaaccctgctgttaccctcgcttttgcagctgtcagacattttccatggaaacaggtcccattttatggtgcagctcaactaacaggggcaatctctgcatcattcacactccgtgtattattgcatccaataaaacatgttggcaccacatcaccatcaggctcagatttgcaagctctaatcatggaaatagttgttaccttttcaatgatgtttatcacctcagctgtggccactgatactaaagctataggagagctagcaggcatagctgttgggtctgctgtttgcataacttcaatcttggctggaccaatatcaggtggatcaatgaacccagcaaggagcatagggccagcaatagctagtggtgagtacaagggaatatgggtgtacgtggtaggaccagtaacggggacattgatgggggcgtggtcttacaatctcatccggatgagagacaagcctcaccatgcaatctctccacattcctcctcgttcaaacttcggcgaatgaataaccaagatggagaggtataaggtaaacctgagtgtattcagtattgattcatatccattgttcatcctcaagagccaataatattcctcactacccttttctcattttaccctcaaacttagatcatatataaactttgtaaatttattatcatatgaataattacttatttcaccctctaactttacaaaa

SEQ ID NO: 235 - DNA, 1611 bp, Brachypodium distachyon
gaacagcataacagaagcatttgtttgcgagctctcaaagttgaactcagcgccggccgcgagctcaccacagcatattactatcatagcagcgcagcgcaatatgggggaacgcaagccggccagcgaccggcgatccggccgctgccagcattactactaccactgccggccggcaaacaccatcacccccctcgccttcgtcctcctcgtcaccggcgcgctgttcctcatcctcggcccgaccaactcctccctcactctccccgcactccgcgtccagttcagcaaccccatccacatcgccgccgccgaatctccccaaccgcctcccgaagccggcaacaacaccgcgacaaccgtcgacgacggcgacgaggatgcgggcctcccgccggcccggcagctgacggacccgccctactcgctgggccgcaccatcctgggttacgacgcgcgccggtccgcgtggctcgccgcgcacccggagttcccggcccgcgtgccgcccgcaggccggcccagggtgctgctcgtgaccgggtcggccccgtcccggtgccccgaccaggacggcgaccacctgctgctgcgcgcgttcaagaacaaggcggactactgccgcgtccacggcctcgacgtcttctacaacacggcgttcctggaccccgagatgtccggcttctgggccaagctgccgctgctgcggtccatgatgctggcccaccctgaggcggagttcctctggtgggtggactccgacgcggtgttcacggacattctcttcgagctcccctgggaccggtacgcggggcacaacctcgtgctccacggctgggaggccaaggtgtacgaggagaagcactgggtcgggatcaacaccggcagcttcctcatccgcaactgccagtggtcgctggacctcctggacgcgctggcgcccatggggccccgaggccccgtgcgggacatgtacggggagctcttcgccaaggagctcacgggccggccgccgttcgaggcggacgaccagtcggcgctcgtgtacctgctggtgacgcagcgggagcggtggggcgacaaggtcttcttcgagaactcgtacgacctcaacggcttctgggaggggatcgtggacaggtacgaggagatgcggagcaaaggccgcggcgagggcaagtggcccctcgtcacgcacttcgtcgggtgcaagccgtgtcgccggtacgtggacagctacccggcggagaagtgccgcctcgggatggagcgcgcgttcaacttcgccgacgaccagatcctcaagctctacgggttcgcgcacgagtcgctcaacggcaccgccgtgcagcgcgtcgggaatgacaccggcgggccgctggacgcggacgacggcgagctcgcccggctgttgcaccccacgttcagggccgccgtgccaacgtagacggccacactggcctgcgatgttattctgttttgtcgtcctttggcttgtttttcaaattctttttccacgtatttttctcatcgttaccggagcgcctgcttaattgcttggaagccgtcaaatgcgaagtgccgcaacatatgcactatagaaaaaggagc

SEQ ID NO: 236 - DNA, 2042 bp, Hordeum vulgare
caacagcgtcccgtcatcctcctcgtccgcgccacccccgccccctctcgcctatttaaggccgccccagcgatatgctctccaggaggccgctcgccgccgcgctacgcctcgcgcccctctcgcctcccctcctcctcttcttcgcatcctcctcctcctcctcccccgccgcgtcggcttcggggcccagaggctgcagtgctctaaggatggatagcggtgctgcggaacctgcttcaacaggggcaatctggtcaacaccgtcggtggagccgagaagcatttctattgggaagcagatattctgcaataggtcactcaacatgaggaacatcaccgcagtaggatttgatatggactacactctcgcgcagtacaagcccgagacattcgaggcccttgcttaccatggcactattgagaagcttgtgaaggatctgaactaccctgtggagctgttgacatggcaatttgactggaaatacatggtcagaggactagttcttgataagaaaagaggaaatatcttgaagatggaccggcacaagtatgtaaaagttgcataccatggatttagggagatgtcgaaggaagaaaaagttgctgcttatggaagtacattgataagggattcctttgatgaacctgattatgcccttatagatacacttttctcactgggtgaagcctatctgtttgctcagcttgttgatttcatggacagcaatcctgcaaaagtaccttcaggcactgactatgcgcttatgtataaagatgtgaggtctgccgttgatctgtgtcatcgtgatggaactttaaaacgaatggttgcaaaggaacctagcaggtatatcaatgaagacttggcaattgtaccaatgcttgaaatgcttagaaaatctggacgctcaacattcttggtgacaaacagtttatgggactacactgatgttgtcatgaactacctatgtgggccatatatgtcagatgtaagctcaagtcacaaccgcaagtggcttgagtattttgatgttgttataacaggcagttcgaagccaagcttttttcatgatgataatcgagcaggattgtttgaagttgagcctgattctgggaaacttctaaatgctgatcttcagattggaagcccaagatcaagtcaacatcagccaaaaccaattcacaaagtttaccagggaggcaatgttggtcatcttcacagactactttctgttgcatctagttcacagatcctttatgttggcgatcacatatatggagacatactccgcagcaagaaagttctaggttggcggactatgcttgtaatacctgagctggagcaagaggtgaagcttctttcagaatcaaaatctactcgaaaggaacttagacaccttagaatggagcgtgattcagttgaagacacaatccatcgccttgaatggtctcttcaatttgaagatcttacagagaatgagaaggggaagttgttatctgagcatgacaatctactgcaaaagctgaagggtatccgctgccttctccgagatgctcagatgcaacatcatcagaagtttcacaaggtgtggggacagcttatgaagactgggtaccaaaattctcggtttgctcatcaggtcgagagatttgcgtgcctatactgcagccaagttacagactttgggttgtattctcccaacaagtactaccgtccgagcgaagattacatgccccatgagttcgatgtgcttggcctgtagtactagtttgtgctcatgcagaatcggagttctccattgaggtgtaggcaagcaagataggggcacaattttagcatggtactgaataacttgtttacatcctcacacaatggatgaggtttatacttggtgaaactgcacccatttccacatgtttatatactagagttgctcataggaaattacacaggtttcccattttgtacataacatgttctaacatggggcgaatgaaaccaatgttcaatgttgatcattccaactttcaaagtaaat

SEQ ID NO: 237 - DNA, 831 bp, Hordeum vulgare
gcctcctccgcacgaaacaccggcgccgcactcatcggagaggaggaagctcctgccccggctcgatccgatggccaacagcaacctcccgcgacgaatcatcaaggagacgcagagactcctcagcgagccagctccggggattagcgcttcgccctcggaggagaacatgcggtatttcaacgtcatgatccttgggccggcgcagtcgccctacgaagggggagtttttaagctggaactatttttacccgaggaatatccgatggctgccccaaaggttaggtttctgaccaaaatatatcatcccaacattgacaagcttggtaggatatgccttgacattctcaaggataaatggagtccggctcttcagattcgaacagttcttttgagtatccaggcactcttaagtgcaccaaatccagatgaccctctctctgaaaacattgccaagcactggaaatccaatgaggcagaagctgttgaaacagcgaaggagtggacccgtctgtacgccagtggtgcatgacaaccccatgctgctcttgatgtaataacccatcatactttagccagcaatctagtgccatttggttggtaaagaacaaactggagatgtttgggctggaaggaagtatctaaatgactagtgctcgagctattgggttggttgtacacctgtgttggttggttccctttaccctggggcaccttctggctgatctgtatctgatagaactttctatgctccagtacattgcccttgtgtaggagaacttaacaagtgtccacattgttgaaattgaagctggcttgttaatttgttct

SEQ ID NO: 238 - DNA, 1200 bp, Hordeum vulgare
gatcacatccccattttgcctctcctccggtctacacacacacacacactcacgcatccttccgatcttacatttgctctggaaatcagggaggaatccaccttacaccggcgaggaagaagttccgagcaaagagagatggaggcagtggaaggcaatggaggagggagcggcctggtggtgacggagctgagccacatcaaggagctggtgaagcagctggacgtgcacctgggaggctcgccgggcctctgcaagcacctcgcccagcagatcttcgccgtcaccgagaagtccatcggcatcatcaggtccggccacttcaactgccccaagcgctcggccgccggcgccggcctcgactcgccgccgctgtccgcgacgcccagccccgtcagcggcgtctccaacacgccgttcaagcccaacaagaagaggaagacgtcggagaaagggcggcatcagatcagggtgagctcggcgggaggaggagcggacgccccggccgacgacggccacagctggaggaagtacggccagaaggacatcctcggagcccatcacccaagggcgtactaccgttgcacgtaccagaagacccagggatgcgcggcgacgaagcaggtgcagcgcgccgacgaggacccggcgctcttcgacgtgatctaccacggcgagcacacctgccttcacaagacggcggcggccatggtgcagccggacgggcagaaccaggacgcgcagagccttctgcagaacctgagctcgagcctgacggtgaagaccgaggggctcatcgcggcgggaacgcagggctggagcaccaccacgcccttcagtttctcctcgccggccgtgagcggcatgacgccgccggagcaccacccgttctccgcgccgtcgacgccggagaactgcttcgtgtcgatgcccacgtccctcgaaccctcgccggcgacctcgggctcgaaccacatgtgtttcaacccgttccaggcgcagtctgagctccagacaatggtgtctgcgctcgtggaagccacgagcatgccgccggccgacacggaggaggccggcttcgcctactggagcttcgacgattctgccttggacgtcaacagcttcgacgaggacgttaccaacttcgacatttctgccttcttagcatcagacgtttgaaaaaagagagaatgcaaccca

SEQ ID NO: 239 - DNA, 1212 bp, Hordeum vulgare
agctctatcctcccaccacccatcgcttcgccggtatccgcagccagccagcgcccaaagaatggcgtcggcaccctcccgcgccctccccttcctctcgccgccgtccaccgccccgcgcgccccctccgtccgcctccgctgcgcggccgccgccggccaagccggcttcttcacccgcctcggccgcctcatcaaggagaaggccaagagcgacgtcgacaagctcttctccggcttctccaagacccgcgagaacctctccgtagtcgacgagctgctcacctactggaacctcgccgacaccgaccgcgtcctcgacgatctcgaggaggcgctgctggtgtcggacttcgggcccaagatctcgttccggatcgtcgacaccctccgcgacgagatccgcgacggcaagctcaagtccgggaccgagataaaggcgtcgctgaaaagatgcatcctcgagctgctcacgaccaagggcagcaagactgagctgcagctcggcttcaggaagccagcggttatcatgattgtgggagtgaacggaggcggcaaaacgacatcgctaggaaaacttgcccacagatttaagaatgaaggagcaaaggtattgatggcagcaggtgataccttcagagcagcagctcgtgaccagctagaaatttgggctgaaagaactggctcagagattgttattgataacgataagaaggcacaggctccatcagttctttcgcaggcagtaaaacgtgggaagcgtgaaggatttgatattgttctgtgtgatacgtcaggacgacttcatacaaattacggtctgatggaagagttggtttcttgcaagaaagtcatagctaaagccctgcctggtgctcctaatgagatcttgctggttctggatggcacaactggactaaatatgctacagcaagcgaaggagttcaacgatgttgttggaatcacaggattcattctgacgaagctagacggcactgctcgtggtggctgtgtggtgagcgtcgtagacgaacttggaattccagtcaagtttgttggtgtcggcgaaggggtggaagatctccaaccttttgatgcagaggcatttgttgaagccattttcccataaatttgaccctgttattagtgtttctcatgtaacaagattttggctaacatgctagaacttattagaacaattttttcaacgat

SEQ ID NO: 240 - DNA, 1562 bp, Hordeum vulgare
tttatcgttcagcagccaacaagactctgtcccgcgtaccggcgtggaagtttccacccgcacggcaacctccccaacaaccgcgccatcacgtcgccggctcgccggcagtggtacatatacctcctccccccccacctcctcctctcaccaccaccagctcccagcaccaccatctccatcgcctcccgcgctccatttcgcgcctcgaacctcgtgctctgacctccaccgctgccatggcgcggccaggccactccacggcgtggctccccgtcctggtgctgctgctctccgcggcgggcgcgacggcgcagagctgcctctccgcgaccttcacgtccggccgcacgttcctcaagtgcaaccagctgcccgtgctcggcgccagcctccactggacgttccacgcccagaacggcaccgccgacgtcgcgttccgggccccgtccggcgccgacgggtgggtcgcctggggcatcaaccccagcggcgccggcatggccggcagcaacgtcttcgtcgcctcgcacagcggcggcgccgtgtccgtgctcaccaccatcctgaggtccacgaaacccgccctcgacaacgccgccctccagttcggcgtgcccgtcccggccagcgccgagtacgccggcggcgcctacacgatatacgccaccgtggcgctgccgggcaacaccacgtcgcagaacacggtgtggcaggccggcccggcctccggcggcagcatctcgccgcaccccctctcgggcccgaacctccagtccgtccagaggctcgacttcctctccggaaccagcaccggcgcctccaactccaggctgcaccgccgtaacctccacggagtactgaacgcggtgggatggggcgtgctgatcccgctgggcgccatgatcgcgcgctacctccgggtgttcgaggccgccgacccggcctggttctacctccacatcacctgccagatctccggctacgtgctgggcgtcgccggctggggcctcgggctgaagctgggcagcgagtccaaggggctcacctacagcacccaccgcaacatcggcatcgccatcttctgcctggccacgctgcaggtgttcgcgctcttcctcaggcccgacaagaagaacaagtaccgggtgtactggaacgcctaccaccactccgtcggctactccgtcatcgtcctcgccgccgtcaacatcttcaagggcctcaacatcctcaagccggtcaccggctggaagacgagctacatcgtcatcctcgccacgctcgccggcgtcgcgctcgtcctcgaggccatcacctgggccatcgtcctgcgccggcgcaagcgcaacagggcccacggcggcgccaacgggaccggcgtgcagctataatcgtcaggatgtgtttgagcgattccgatccatgtctttatctttcgtcttgctgcttttctgtagtagtagatctttctacttcttcttcttcttcttcgacttctttggtggccattgtatacattctttcttcgagctgatgtacgattactttcatttatatgc

SEQ ID NO: 241 - DNA, 1511 bp, Hordeum vulgare
tcatcagttcatcactcatacacatacatacatatgtacatgatcagtgcacacagcacaccagtagtactactcgatcagttagctagctggtgatccatatggggaaggtggtcgtcacggaggccacggcgcgccaggtggcgtccttcgtcctcggcgccgccgctgcgctcaccgtcgtcatgctcgtccagtaccgggcgccggccgccgggctcagccgtgcgaggacaccggggcacttttccggcttgagatcatcatcatcagatgaccaccaccaccaccaccgcaacgggacgactgcacgtgccgtagttcgtcaggcgccaccggtcgccactaatgcagaggacgatcatcgtcgtccggcgaacgccacaacaatcacaaagcccaattctacctctactgctgctgctctacctctacgtcatcttcccagcacaaatcaccatggacaaaagggagccaatgaggagtcgccggagttccggggcctggcggcagcggtggcgcgagcggcgacggacgaccggacggtgatcatcacgtgcgtgaaccaggcctgggcggcgccaggctccctgctggacctgttcctggagagcttccgcatcggcgacggcacggcgcggctcctcccacacgtgctcgtcgtggccatggaccccggcgcccacgcacggtgcctcgccgtccaccggcactgctaccactacaccatcccgggcctcaacatcgacttcgccgcccacaagtacttcctctccaaggactacctggagctggtgtggagcaagctgaagctgcagcgccggatcctggagctcggctacggcttcctcttcaccgacgtcgacatcgtctggctacgcgacccgttcaagcacgtgacggcgtacgccgacatgacggtgtccagcgacgtgtacttcggcgaccccgacaaccttggcaacttccccaacacggggttcttccacgtgaagcccaacgcgcggaccatcgccatgacgaagctgtggcatggggctaagggcaagtacccgggagccaacgagcagccggtgtttaacatgatgaagaagcggatggtggcggagctggggctccgggtgcagtacatgaacccggcctacgtcggcgggttctgcagctacgggaaagatttgaggaagatcgtcaccatgcacgcgaattgctgcgtggggattgagaacaaaattaaggacttgaagaacgtgctgggtgattggaggaactatacgaggatgccgccatgggagaggcaccgggccaaatggaccgtgcccggcgcctgcattcgagccgaaaaacaagtttgattcatcaattggttgatggattttccaatcgcctgttatagagtagcttatttaattctacatatatatatatatatatactccctgtgtgagggtggagagagagacgataagtatttgttgctatacctgtaaaatgctctattatgaaagcatata

SEQ ID NO: 242 - DNA, 1703 bp, Hordeum vulgare
gccgggatggaggcggtcgggccgcgccggtcgcccagatctcgccgtcggggcgtcgtctccctgaggggcagcctttgaacctctgaacttttgtgtccttgggtttgcgtgataaatctgacaaaacaatggaagatttacaagactgcaactccaaaagccttgttgctgttcctgggtctctcgttctgcacgtcttcaggctgttaggtcagcaggataattcctggcagaagtacgccttggcttactttcttttggtcaggaatgagtacttcccgagggagccaaggaaacactcagctgtgaatgggcaacttgttcactgctgtgttagttcagatttgggcagtaaagaagtggaagtggaggagcagaatgctgttgtcaagacccaatcaggaggtgattccagttccaatggatcaaatgattgtttccttccaggccttcatgatgatctggctcaagactgccttgcctggacaagcagatcagactacccttcactctcttgtctgaacaagaaattcagtacactggttaacggtggatatctgtacaagctgcggaggaaatatggcattgttgagcattgggtgtatctggcctgtagcctgatgccctgggaagcattcgacccgtcgcgaaaccgatggatgaggctcccaaggatgccatgtgatgactgcttctcctgtgcagacaaggaatcacttgctgttggtacacagctgcttgtctttggccgagaatatgcaggccttgctatttggatgtacaatttactgacacgccattggtctcgctgcactccgatgaatcttcctcgctgcctgtttgcctcgggaagctgtggtgagattgccattgttgctggtgggtgtaatgggactgggcaggtgctgaggtctgcggagctgtacaattcagaggctggccagtgggagaccctgccagacatgaacttgcccaggagactctcctcgggtttcttcatggatggcaagttctatgtcattgggggtgtgaccagtgaggggcattctctgacttgcggagaagaatacgatcttgacaccaggacatggagaagaatacatgacatgtaccctggaggaaccagcgcctctcagtcgcctcctctcatcgccgttgtaaataaccagctctacgcggccgaccagtccacaaacgtggtgaagaagtacgacaaagcaagcaacacatggaacatagtgaagcccttgcctgtgagagcggactcttccaacggctggggcctggcgttcaagggatgcggcgacaggttgctggtcatcggcggccatagaggacctcgcggcgaggtgatactgctgcattcctggtgccccgaagatgggaacggcgtcgccgactgggaggtgctgtcggtgaaggagcgtgccggcgtcttcgtctacaactgtgcaataatggggtgctgagttagtgccttcggttcggtatatccgtatatgcccacttgtttagcaaaaccaccgattcgttgctgccattttagctgccacttcttataatgaatgacttgtaattcagaaatgacacccccccttcccgcggagctgtcgattaaaatgtcgggtcgagagcatagagatcattcagttcagtttacctggaactgccttccttcttaacactcttcaaaagtcctt

SEQ ID NO: 243 - DNA, 1992 bp, Zea mays
gccagcccatgcccaccttttgtgccggctccatcttcttcgacccgcacgagcacggctgccatttcatcgaacaagcgccataccggacatggcaaccggatcccctcgccgccgtcctctgccgctcctcctcctgttcctgctcctcttcgccgccaacggcagggccaatgccgcccgccccggcggccccagccccataaagaacgtggtggtgctggcgctggagaaccggtcgttcgaccacatgctgggctggatgcgccgcctgttgggcctccccgtcgacgggctcaacggcacggagtgcaaccccaattccaactccacatcctccatctgcgtgtccgccgacgccgacctcgtcgtccccgacgacccgggccactccttcgaggacgtcctggagcaggtgttcggcaacgtctccgccgccgctgcgcagccgcagccctccatgtcgggcttcgtccgcagcgcgctctccgtcaacgcggtcctctcctccgccgtgatgcgcgccttccgcccctccctcctcccggccttctccgcgctcgcgccccaattcgccgtcttcgaccgctggttctcctccatcccggggcccacgcagcccaaccggctgttcctctactccgccacctcccgcggcgccgtcgcgcacgacaagctcgacctcctcctcggctacccgcagcgcaccatcttcgagtccctcgccgccgacggccacgacttcgccgtctacttcaagaccatccccaccgttctcttctaccgccgcctccgcgcgctccgctacgccgcccgcgccttccaccgctacgacgccgccttcaaggaacacgcccgacgcggcgtcctcccggcgctctccgtcatcgagcccaggtacttcgacctcacggggacccccgccgacgacgaccacccggcgcacgacgtcgccaacgggcagcgtctcgtcaaggacgtgtacgaggcgctccgggccagcccgcagtggaaccagacgctgctcatcgtcacctacgacgagcacggtggcttctacgaccacgtcgccacgcccaccgccggcgtgcccagccccgacggcatccggggcccgccgcccttcttcttcaagttcgaccgcctcggcgtcagggtgcccaccatcatggtctcgccgtggatcaagaagggcaccgtcgtcggccgcgccctcgggcccacggacacctccgagttcgaacactcctccattccggccaccatcaagaagatcttcaacctctcgtccgatttcctcaccaagagagacgcgtgggccggtaccttcgaccacatcttcaccgagctcgaccaaccaagaacagattgcccagagacattaccggaggtgccatttgagagaccaactccacccaaagaacacggctggctctcagatttccagcgggagctcgtcgagctcgcgagcttcctaaacggcgactacatgctgacgagccttgcgcaggagaaccgtaagaagaagatgacagtcaaacaggccgatgcgtacgtgcggcgagccatcacgagctttctgcaggcgagcaagcaggcggtgcggttggccgcaaacgaatctgccattgtgacaatgaggtcgtctctgacaagcaagagcacacgctcatcaagcccttgagttgattcagtctgctaatacatatagctagtgaacagatggatttgagtccacggtctaatgtatattgcctctgaaatgtttatagctgaatagggagctagcagagcctttttaaatataacttttgtttctcttgtcacatattaccaatgtagtataagagttttctgttgacctcaaatgtagatctgcaacctcattttgatcttggattcacgttttggagggacacacgtaagtgttacatatatgtttttttagataatgaaatggaacatggagtgttatatatcacaaattgaata

SEQ ID NO: 244 - DNA, 853 bp, Setaria italica
aaacgcgcggcccccatggcatccgccgtttcgctcctcctcctctcgtccccgcgcccgctccaccgcacatccggccacctcctctgcagcccccgccgccgcgccctcccacctccaccgtgccccgcccgatccccgcgccgcctcctcgccgccccgccgcgcgcctccaacaacaacgacaacagcggggccgtggaggctcccgaccgcctcgtggccgcggtcgcctacctctacccgttcctcgacggcgcgcaccacggccgcttcctcctcgcgcagttccccttcttcagcgcgctgctccgcccgctgggccccgcggcgcgcctcttccactcctcgccgctcacgcccttcctcctcttcctcacgctctacttcgccgtcgtgcggaaccagcaggccttctcccgcttcgtccgcttcaacgccatgcaggccgtcgtgctcgacgtgctgctcatcttccccgacctgctcgcgcagtccttcgcgccatccggcggggtcggattcgagatcttccagagcatggagagcacggtgttcctcttcctgctcgtctgcttggtctacggcgggggcgcgtgcctgctcgggaagacgccacggttgcctatcgtcgcggatgcagccgagcgccaggtgatgtgactacagttcgcttgaatcatgctgatgagaagggaaaggggatctgtgactcacagtgacatctcaatttctcaatgatttactggcgcttgctgcaaatcacaagcttagtatagtttacattgtccatagctctagctaccaatttaatggatgaattgtggaaggttgacacagtgacgttgcaacc

SEQ ID NO: 245 - DNA, 1299 bp, Sorghum bicolor
aagaacagcaggcgaagaagcatcgccagattggtatattgattgatcgatcgattgatcggtggcggaggaaggggaggagggcggcagatggcggcgtgccggggcttcttcgagtgcctgctcaggctgctcaacttcatcctcaccgtcgccggcctcgccatggtcggctacgggatctacctgctcgtcgagtggacgaagatatccgaggacggcagcggcgggggattgacggcggaggtgctcgtctccgcccggccgttgttgggggctgtcgctctcggtgacagcttcctcgacgacctacccaaagcatggtttatttatttgttcattggtgttggtgctatcgtcttcctcgtgtctctgtttggctgcattggagcagggacaagaaacacatgctgtttgtgtttctatgctttcttggtcatattgttgatccttgctgaagctggagctgctgcattcattttctttgaccaaagctggaaagatgtaattccagtggacaagacacataactttgatgttatgtatgactttctgaaggaaaactgggagattgcaagatgggttgctcttggtgttgttgtttttgaggcagtgctctttctgttagctctggttgtcagggcaatgaacaaacctgctgagtatgacagtgacgatgaaattattgcaattggccgaagccctaccatgcggcagccactgatccatgcccaaaatgtgcctgccactggtgttcctgtcccaacactcgatcagcgtgcaagtagaaatgatgcctggagccaaaggatgcgagagaagtatggtctggacacgagccagttcacatacaacccttcagacccaagcaggtaccagcagaatggcacgccacaggctgaagaaaggagtcgatgcactataatgtgaagaatccttcatgaggtcctaccgagataatgaccaatccttcatgaggtcctacgagataatggttttcttgaacgggctacctcagcttgtgtagtttggtgttatggtgttgttcagacttcatagcggtgtgtggaatagaagaatgccgaccatattgtttgtcacgcttgatatgtcttctctgcaaatgttctatgttactgtaattttattgtggatgaggaactgttagccattgacaccatcatctattctgtatttttgggggtttgtttcttgtttgctaatccccttttttcatgtagctctgtttaatctaagatttggttgtgccgtgagactggtagaatctgttttgctttg

SEQ ID NO: 246 - DNA, 1797 bp, Sorghum bicolor
gtacagaatcagaactcggcatcacacagctttgcgccccagcagttttggggagtggggacgacggaagtccggcacgtagccttttcagttcatcgccttcacggttagttgccgacttgccgcgcactgccccccctgcagccctgctccctcctcgcctggcctcacgatcggcaacggcatgactactcgcgacgcccatctcggagtcggagtcggagtcgagggggacgccaaggacaagaacgccgccgctgacgccttgacggacggaggcggcggccatgaaggagccgggtccggcggcgggcgcaagctgtccctggtgccgctcatcttcctcatcttcttcgaggtcgcggggggtccctacggcgcggagcccgcggtgcaggcggcgggcccgctgtacgcgctgctgggcttcctcatcttccccttcatctgggccatcccggaggcgctggtcaccgcggagctctccaccgccatcccgggcaacggcggctacgtgctgtgggccgaccgcgccttcggcgcgctgccgggctcgctcatgggcacgtggaagtacgtctccgccgccatcaacggcgccgcgttcccggcgctgtgcgccgactacctggcgcgcgtcgcgcccgccgtgtcgggggggcctgcgcgcgccgccaccatcgtcgccttcaacgtcctcctcacggccgtcaactgcgcggggctcaccgtcgtggggtggtccgccgtcgggctcggcgtcgcgtcgctctcgccgttccttgtcatgtcgggcgccgcgctgcccaagatccggccgcggcggtggcgcgtcgtggcccgggagagggactggaagctcttcttcaacacgctgttctggaacctcaactactgggacagcgtcagcaccatggccggcgaggtggaccggccagggaagacgctccccaaggcgctcgtgtccgccgtctccatgacctcgctcgggtacctgctgccgctcttggcggccaccggcgccctcgacgtcgcgcccgacagctgggggaacggattcttcgccgacgctgcaggcatgatcgccggcaactggctcaagtactggatcgaggtgggcgcggtgctgtcctccatcggcctctactcggcgacgctgagcagcgcggcgttccagctgctggggatggcggacctgggcctgctcccgggcttcttcgcgtcccgcgccccggtcttccgcacgccgtgggtcagcatcctggccaccgccgccatcacgctggccatgtccttcctcagcttcaacagcatcgtggccgccgccaacttcctctacagcctcgggatgctcctcgagttcgccgccttcgtctggctccgcgtcaagcagcccgcgctggcgcgcccctaccgcgtccccgcgcgcctcccgggcgccgtcctgctctgcctcgtcccctccgtcttcctcgtcttcgtcatggccatcgccggctggaaggtgtacgccatcagcgccgcgttcacggccgccggggtggcggtgtactacctcatgaggctctgtaaggctagagggtgcctcaggttcagcgacggcgctggcgccggcgatcaagggtcgacggcggcggtttaccagcagggcagcagcaacggcggcgatgtctgaaatgatagtagactctgactctaacgacatcaaactatcaaagacagtcagctgtgggagctgtggtgctcttgtgccaaagtactacacgaatttgtagggtagtagtgtttccaattagt

SEQ ID NO: 247 - DNA, 3653 bp, Setaria italica
gccatcttccccgctccctccccttcttttctctttggaagcttctccactctacaccaacccggccaggcggtctcaggccgcgccctccagggagccccgcgccgtacgggctcggccggaggaggaggagcggggaacgggcggtggagttcccggatcgcgtggaggagcccgcggggacggggctgggcggttgatccctttggcctccatgctcgtggcggccggatcagttcatccttcgagccgaggtcgctgctactgctaaagtgctaagtgcaggcagaggcgctcaggcgcaggaggaagaggcagcgtcagagacgccaccacccacgcggacggcaataatggacggccgccacccgccgccctcccaccaggcgccggcagcgcagccggagcggcacggcagcttcaactacgacatcgagaacacggacgcggcgtggcgcggcgcgcacacggcctcggaggcgctgctgcggtacgacgacgacggcccgcgggagccgctgctgcggaagcgcaccaggaacactacctcccagatcgccatcgtcggcgccaacgtctgccccatcgagagcctcgactacgaaattgtggaaaatgaccttatcaagcaagattggcgatcaagaaagaagcagcaaatattccagtatattgttctgaaatggtccttagttcttctcattggcttgtgtacgggacttgttggcttcttcaacaaccttgcggttgaaaacattgctgggttcaaactgttgctgacaggtgatctaatgctcaagcagaggtacatcacagcctttctggcatatgcaggctgcaatctagtcttggcagcaagtgctgcagcaatctgcgcttacattgctcctgctgctgctgggtctggtatccctgaagttaaagcataccttaatggaattgatgcttatgctatattggctcctagtacactctttgtgaagatatttggttcaatacttggagtttcagctggatttgtacttggaaaggaaggtccgatggtacatacaggagcatgcattgccaacttgcttggtcaaggggggtcacgcaaataccatcttacatgtaactggctcagatattttaagaatgatagagataggcgggatttgattacttgtggggctgctgctggagttgcagcagcattccgtgcacctgttggtggtgtgctcttcgctcttgaggaagcagcatcatggtggcgaagtgctctcctgtggagagcattctttactactgctgttgttgctgttgtattgaggggcctgatccagttctgccgtagtggaaaatgcggtctctttggtcaaggaggattgattatgtttgatcttagctcaaccatacctacttacagtacacaagatatgatcgcaatcattgtccttggaataatcggaggggtctttggaggcctgttcaactttctcttggataggattctccgcgcctacagttttatcaatgagaaaggtgctccatacaagatccttcttactatcacaatatcgattatcacatcagcatgctcctacgggctcccttggctcgctccatgcactccgtgcccagctgatgccgtggagcagtgtcccaccattggacgctctgggaattttaagaattttcagtgcccagcaggttactacaacggtcttgcatcactcttcttcaacacaaatgacgatgccatccgcaatctgttcagcagtggcaccgagaaagaattccacatgtccactctttttgtcttcttcactgccatttactgccttggccttgtgacatatggtattgctgtcccatctggtctcttcatccctgttatacttgctggggctacgtatggacgcatagtggggacgcttcttggtccaatatcagaccttgaccctggactcttcgcccttcttggtgcggcatctttccttggtggaacaatgaggatgactgtctcagtttgtgtgatacttctggagctcacaaatgacctccttatgctcccattggtcatgctcgtccttctgatatcgaagactatagccgacagcttcaacaaaggggtttatgaccagatcatagtgatgaaaggaatgccgttcctggaggctcatgccgaaccatacatgaggcagttggttgctggcgatgttgtatctgggccactgatctccttttcaggcgttgagagagtagggaacattgttcaggcgttgaggatcacaggacacaatggatttccagtggtggatgagccacctctatcagaagctccagagctcgttgggctcgtgcttaggtcccatctgctggtcctgctgaaaggcaagggcttcatgaaagagaaggtgaaaaccagtggtagctttgtgctgaaaaagtttggcgcctttgattttgccaaggctggatctggaaaaggtctgaagattgaggaccttgatttcacagatgaggaaatggatatgtatgttgatctccatccaattacaaatacctcaccatacaccgtggttgagaccatgtcccttgcaaaggctgcggtccttttccgggcactaggattgaggcacctgttggttgtgccaaagaccccagggagaccaccaattgttggaatcctcacaaggcacgatttcatgccggagcacattcacgggctattcccgaatctccacaagtcacactgaggaaagaattcagtacatgttttgtttgctatttgtttcctggtagcttagctgtacgcagagaaagctgccttgtgcaatttgctgcccccgtctagcattttgtttgtcctttttgtatttattctggagtactccaaaatctcaaaactgttgaataatattgtattcgttgtaaagagctgattaccccatccgcaattgagtggatttttgtagttcatcctcttgtcgattttcaacaataattttgcagtattctcatgtttgtcttcagccgtgtgcttctcacgctcctgaagtgagtagagggcgcttacttttgccctttaacctctgtcaaagtcgatctgttgtcttttcgtgcagatagttcatagttttaagtactttgttgtgcatatattgacttactgattactaacatgttgacccgcaaccagaaaacaagcagtctttatgcggaatataatggctaaagctcaaacattatctgtcaagcttgctttttttaaaagaaaaaactatccgtcacgaaaatgccgttgcttgcagggaaaacggatcagcgaaagacgacaccgtatttgttgctatcacatgtccaggatctctcgagatccccggaaattcgccaggatcctccgacggtgacgcgggtggcatctgttgatcaacaaccaaaacatcacggggtcccacatgccagtggcccaggacacgaacaagaaggtacctgagaacagtgacagcctgacaggtggacgccatgatgctcccccttggattctgccattctggcatgtggtggtgtctcacctgctcaaaatgccgttttttattgagagaagctcatcactcgccatggaccagcctcggccttctttttttttttgtgtgtgtgtgttttctgtg

SEQ ID NO: 248 - DNA, 1711 bp, Zea mays
cacggccactgctcgtagtcgtagtctcgtagctagctcccggctcccccccacacacggccactggcgcctacaagttgcgcatgtggtggtggtccgtgctgctgctgctggcctgctagctagctgctaccagccgacgacgacggccgcgcgcgtttggtgtgtgtgtgtgttataagcgcgagggtttctggcgaggttgctaaagcgttagcaaactagtagcggtcaccgggcgcccatggagcttgacgaggagacgacgttcttggacgagctcatgtcgctgcggcgggaggcggcggcggcggcgtccgcgcagtggcaagcagctgccgcctacacgggcggcggcggacaaggcatgatgatgggcgacctcctcttctacggcgggacgacggaggccgccgcgactgccaccagcggcggcggcatggaccagctctcgccgttccaccagcaggagccgctgcaggtgcaggcgcccccgcaccctcactcgcacgaggagttcaacttcgactgcctcagcgaggtttgcaacccgtacaggggcggcggcgtcgccgtaataacgggggccgaggccgccgcggtgcccggaagggcgctcgccgctctccacgacgccatggtggaggacgagacgagcggtcacctgcaggggcagcaatatggagccggcggctccccgacgttcgtgttcggcggtgccgccggcgagagctccgagcagacgcccgtcgtcgtcaggggtgccgccggcggcccccaccacaggagcaaggtccacggcggcggcgcgccgtccaagaatctcatggccgagaggcggcggcggaagcgcctcaacgaccgtctctccatgctccgctctattgttcccaagatcagcaagatggacaggacatccattctcggtgacaccattgactacgtgaaggagctgacggagcggatcaaagtcctggaagaggagatcggcgcctctgcggaggacctggacctcctaaacaccttgaaagcttcttcgtccagcggcagcaacgagatgatggtgaggaactccaccaagttcgacgtcgagaggcggggcaacgggagcacgaggatcgagatctgctgtgccacaaaccccgaggtgctgctgtccacggtaagcgcgctggaggtgctgggcctggagatcgagcagtgcgtggtgagctgcttcagcgactttggcatgcaggcctcttgctcacaagaggaggaggacggtaataataagaggcaagttctaagcaccgacgagataaaacaggccttgtttcggagtgctggctacggagggaggtgcctctaatatagctagcttagctaccatgcaagcagctccgatccaaacccaggccatcgatcccggcaaatataaagctagtaagttgcatgcatgattgttattgctgtgtgttgatgctttagttttcatcaatatatatatcccgtacgttaattggttttctccatgagttcatagcgctaataagtgtgcgtagtagtagcagcaagaggtatgtatgtatatatatctgaatcccagcaccaaattgaagatttgttgctcaggtattgtaagttgatcatttcttacggtctgtatcattgggtcatggtatgtatgcggattgatatattccaataagaagcagattgttcctttctc

SEQ ID NO: 249 - DNA, 4353 bp, Zea mays
aaacaactcataaaagccactcgccgactcgcgtaaacaaaccaaaccccattaacacccgcccatgcacccgcgggccccgcatgtcagcggcagcggcgagccgtcgcctcacgccgcgtcaccctcgtggcgctcggcgagcgcgcgacacgccggcacgccgccctcccgtgatgcccgttctctctccgttttggaatttctcggcgacagcgaccctgcttgcgatttgcgaagctgcgagagtggcggtgctagtagtctagtagagtactcccagtagataagcaagctgcgggcgccgcccagatgggaatcgggttccgacttccgacacgcacacgcccccacatcgcgccgcgatggctgcttcgccctcgccgtcgaccgcgaccgcgaccgcttctccctcagcgtcagcggcggcggtcttggctgtaaacggggagcgggttgagctccgcgagggggacgtgaaccccggcaccacgctcctcgagttcctccgcacccgcacccgcttcaccgggcccaagctcggctgcggcgaaggcggatgcggcgcgtgcgtggtgctcctctccgcctacgacgcggcgtcgggcgcggtgtcgcacgcggcggcgagctcctgcctcacgctggtgcacggccttcatcaccgcgccgtgaccaccaccgaggggctcgggggcggcggccgcctccacgccgtgcacgagcggctcgcggggttccacgcctcgcagtgcggcttctgcacgcccggggtgtgcatgtccctcgccgccgcgctcgcgggggccgaggccgaggccaaggccaaggcggggaggaggcccgccccacccgaggggttcgcgaggctcacggcggctgaggcggagtgggccgtggcgggaaatctctgccgttgcacggggtaccgcccgatcgccgacgcctgcaagagcttcgcggctgacgtggatttggaggacctgggcctcaactccttctggaggaagggggacgcccatgcttccaagctgccgcggtacgacgaggggagcatcggtgtgttcccggagttcctcaaggctgagatcagagcttcttctggggttgaccagtacacaccgccggcattgctgggaagtgccaccacttggcaccggcctcggagcgtggaggagtactataagctggtagattctgagttgtttgaccaaagtaaaacaaaggtggttgtggggaacacagcttcaggcgtttacagagaaacagaggtgtatgataggtacatcgacctcagatgcatcccggagctgaattcggttagtaaggaagccaatggtgttcaaattggagctgcagtaacgatttctcaggcaattgagattttaagagtagaagctggtggctgcaatgatgtaatcttctgtaagattgctgatcatatggaaaaggtggcgtctccatttgtccggaacactgcaagtttgggtggaaatttggtgatggcacagagggaccagtttgcctctgacatcgcaacgatccttcttgctgctgggtcatcgatatgcatccaggcatcatcaaaaaggttgactgtcatgatggaggacttccttcagatgccaccttgcgatcacaagacactgctattaagcatttgcattcctcgttggactcccattggtggcctattttctggtgataaaaccatggctgggacagaaagtaagacaggaacttctgtgctgtttgagacgtaccgagctgctccacgccctcttggcaatgcagttgcatatcttaattctgctttcttggctcaggtctcttcagatggaacttcaagcagattaatattgagagagatatgtctggcttttggtgcatatgggagccaacatgccatcagggctaggaatgttgagaaactgttagtgggtaaacctattactacatcggtgctacttgaagcatgtagacgtctcaaggaaacaattgttcctaaagaaggcacaaggcatgctgcttataggtcaagcttggcagttgcctttctgtttacttttctttacccagtaactgaaggaactttgaagactgtaaaggaagttcatcttaatggctatgcaacttttggcaccaatggaaatccaaattgtggacccgatgcacatgttgatgtttcacttaaaaaggtcattgatgtgaactccggttcatgtaccaatgaacgcattcttgaatattcaaatcagattattgaaatcaataaagactatttccccgttggcataccaaccaagaaggttggagcagaactccaagcctctggtgaggctgtatttgtggatgacatccccgctcccaaggattgtgtttatggagcatttatatatagcacaaaacctttagcccatgtgaagagcatagaactcgacctttcactcaagcagcttaaaacgctgggagtagttactgttaaggatattccagaatgtggcagcaatgttggggccaacactatatttggacctgaacctctgtttggtgatccagttactcagtgtgcaggggaacctcttggtgttgtgattgcagaaacacaaagatttgccaatatagctgcaaaaaaagctgttgttaactacagtactgagaacttagatgctccaattttatccatagaggaggctgttaaaaggtgcagttattttgaaaccccaccgtttcttcttcccctgaaaattggtgatttctcaaaaggaatggcagaagcagatcagaaaatctactctgaggttaaactcaattctcagtactacttttacatggaaacacaagctgctctggcaatacccgatgaggataactgcatggtagtgtatagctcaagccaatgccctgagacagcacagaatgtcattgcaaagtgccttggtttaccttgtcacaacgttcgtgttattaccagaagagttggtggtggatttggaggaaaggctgttagatcattacctgtggcaactgcttgtgcacttgcagcatttaagttgcgccgtcctgtccgtatgtatcttgaccgcaagactgacatgatagtgactggaggtcggcatcccatgaaaatatgctattcagtgggattcaaaccagatgggaaaatcactgctttgcatataggtttgttcataaatgcaggaatgacaaaagatattagcctcataatccctcataatttcattgaggcactgaagaaatataattggggtgccttttcttatgaagcaaaggtctgcagaacaaaccttgctacaaagtctgcgatgcgggggcctggagaagtacaaggttcttatgttgccgaagctataattgagcatgttgcttccacgctctccgctgatgctaatttggttagacgtaaaaatcttcacacggttgagagccttgctttgtttcacagtgagtgcactgaagatgccatgggttatacacttcactctatatgtgatcaagtgactgcatcagaaaactatcagcatcggcttgaaataatccagtctttcaacaaaaacaacaaatggaaaaagaggggcctctcttttgtgccaatagtacacaaagtattatctcgaccgacacctggaaaagtgtctattcttaatgatggatctgttgctgttgaagttggaggcattgagttaggccaggggctttggacaaaagtgaagcagatgacagcttttggtcttggacaactctgtcctaatcgaagtcaagagctgttggagagaataagagttattcaagcggatacattaagtaacgtacagggagggtggaccactgggagtaccacatcagaatctagttgtgaagcagttcgtctcgcatgcaatgtcttggtcaacaggctgaagccagtcaaggagcaatctcaagaaaagcaagacaatgtttcatgggatgaacttatttccaagggacgaggaggtatcagcgaatgttggttcgcatgccagccttttccccttctattgtacgcaatgtgaaagggtcgcaaccagaaggttgtttccccctcgatcagggcgtgaggtggagtcgggctcagtcctctgaccaagttcgacatgagataaacctaacattctccccctgttctcatacttactcgcttatgtttagaacttgttagactatgtgtgtgtgagtgtgtgtgggccggcaccactgttgggctgccagcccattagggttagggtttcctgtctctatatattgtaaccccatctattatcaatacaacacttaatcttccaacagaacttactctctccatcccataaa

SEQ ID NO: 250 - DNA, 4494 bp, Setaria italica
cgagtgaccagtgtgagcggtggcagcagcagtagtagataagcaagctgcgtgcgccgcccagatgggaatccgattccggcccgcagcgcatctctcccgtcccgcgacgcgatggctgctgcggctgcggctgcggcttcgccctcggccgctcctccctccgcggcggcggcggtcttcgcggtcaacggcgagcgcgtggagctccgcggcggcgaggtggaccccggcgccaccctcctcgagttcctccgcacccgcacccgcttcaccggccccaagctcggctgcggcgaaggcgggtgcggcgcgtgcgtggtgctgctctccacctacgacgcggcgtcgggcgcggtgtcgcacgcggcggcgagctcctgcctgacgctggtgcacgggctccaccaccgtgccgtcaccaccaccgaggggctcgggggccgcggccgcggcctccacgccgtgcacgagcgcctcgcggggttccacgcctcgcagtgcggcttctgcacgcccggggtgtgcatgtccctcgccgccgcgctcgcggccgccgacgccaagaagggtgacgggaggccggctccgcccgaggggtccgccaggctcacggcggccgaggcggagcgggcggtggcgggcaacctctgccgctgcacggggtaccgcccgatcgccgacgcctgcaagagcttcgcggccgacgtggatttggaggacctgggcctcaactcattctggaggaagggtggcgcccatgcttccaagctcccgcggtatgaggaggggagcattggtgtctttccggagttcctgaaggctgagatcagagcctctgctgggattgaagggtgcacgccgccggcattgctcggaagtgggagcacttggcactggcctcggagtgtggaggagtactataagcttgtaggctctgagttgtttggcaaaagtggaacaaaggtggttgtgggcaacactgctgcaggcgtttacagagaggcagaggtgtatgataggtacattgacctgagatgcatcccggaactgaatttggttagtaaggaggccaagagtgtcgaaattggagctgcggtatcgatttctaaggcaattgaggctttaagagaagatggtggctgcaatgatgtgatcttttgtaagattgctgatcacatggagaaggtggcttctccttttgtccggaacacagcgagcttgggtggaaatctgataatggcgcagagggaccagtttgcctctgacatcgcaacgatccttcttgctgccggttcatcgttacgcatccaggtatcatcagaaaggttgaccatcacgttggaggaattcctgcagatgccaccttgtgattacaagacgctgctattaagcatttacattcctcgttggactcccattggtgacttatctggggatggaaccatggataggacagtaagtacaagaggaaattctgttctatttgagacataccgagctgctccacgtcctctgggcaacgcagttgcatatcttaatgctgctttcttggctcatgttgcttcagatggaacttcaggcagcataatattgagagagctatgtctggcttttggtgcatatggaacccagcatgccatcagggctagcaatgttgagaaactgttagtgggtaaacccattactgcatcggtattgcttgaagcatgtacacttctcaagaaaacaattgttcctaaagaaggcacaagacatgctgcgtatagatcaagcttggcagttgcatttctgtttagttttctttgtccagtgaccaaagaaactttgaagcctgtaaaggcagttcatcttaacggctctgtgccttctggcaccaatggaaatccaaattgtggacctgatgcgcgtgttgatgcttcactgaagaagataaataatgtgaaacccggttcatatggcaatgattgcatacttgaatattcaaaacagaaaattgaaatcaataaagactatctcccagttggcataccagccaagaaagttggagcagcactccaagcctctggtgaggctgtgtttgtggatgacatcccctctcctaaggattgtctttatggtgcctttatctatagcacaaaacctttagcccatgtgaggagcatagaactcaacccgtctctcaagaaacttaatacattgggcatcgtcactgttaaggatatcccagaaggtggcagcaatgttggagccaacactatctttggacctgaacctctgtttggtgatccagttactcagtgtgctggggaacctcttgggattgtgattgcagaaacacaaagatttgccaatatagccgcaaaacaagctgttatcgactacaatactgagaacttaggtgctccaattttatcgatagaggatgctgtaagaagatgcagttattttgaaaccccaccatttcttcttccccaaaagattggtgatttctcacaagggatggcagaagcagatcagaaaatctactcagcagaggtgaagcttaattctcagtactacttttacatggaaacacaaactgctctggccgtacccgatgaggatgactgcatggtagtgtatagctcaagccaatgccctgagacaacacaaaatgtcattgcaaagtgccttggtttaccttgtcacaatgtccgtattatcacccgaagagttggaggtggctttggaggaaaagctgttagatcattgcctgtggcgacggcttgtgcacttgcagcatttaagttgcatcgtcctgttcgaatgtatcttgaccgcaagactgacatgatagtgagtggaggtcggcatcccatgaaaatatgctattcagtgggattcaaatcagatggaaagatcactgctttgcatctagatttgttcataaatgcaggaatgacaacagatgttagcctgataattcctcacaatttcattgaagcactgaaaaaatataactggggtgccttttcttatgaagcaaaggtctgtaaaacaaacactgcaacgaaatctgcgatgcgtgggcctggggaagttcagggctcttatgttgctgaagctatagttgagcatgttgcttccgcactctccactgatgctaatttggttaggcagagaaatcttcacacaattgagagccttgctttgtttcacagtgagtgcactgaagatgacatgggttatacacttccctctatatgtggtcaattgactgcatcagaaaatttccagcaccgtcttgaagtagtcaagtctttcaacaaaaataacagatggaaaaagcgaggcctctcttttgtgccaattgtgcacaaagtattatctcgaccgacacctggaaaagtgtcaatccttaatgatggttctattgctgttgaagttggaggcattgagttaggccaggggctttggacaaaagtgaagcagatggcagcgtttggtcttggacaactgtgggctgatcgaagtcaagagcttttggaaagaataagagttattcaagcggatacattgagtaatgtacagggagggtggaccacagggagtacaacatcagaatctagctgtgaagctgttcgtcttgcctgcaatatcttggttgacaggctgaaattagtcaaggagcaatttcaagaaaaacaaagcaatctttcatgggatgaacttatttccaaggcaaaaatggctggtgtggacttatcagcacgagaatactacattcctgggccttctggttcttatctaaactacggagctgctgctagtgaggtggagattgatcttctcactggggccaccacgattgtgcgaagtgatcttatatatgactgtggccagagcttaaaccctgccgtggacttggggcaggttgaaggggcatttgttcaaggaattggctattttatgaccgaggaatatgtcaccaactcggatgggttggttatatctgacgggacttggacatataagatcccaactgtggacactatcccaaaacaattcaatgttaagttgcttaacagtggattccacaagaaacgggtgctctcttcaaaagcatctggggagccgcctttgcttcttgccgcttcagtgcactgcgcgacaagagaagccatcagagcagcaaggagggaaccccactgctctgcttctggaccttcttcaccttcccatttcgatctggaggttcctgccatcatgcccgtggtgaaggaactctgtggcttggacaatgtggagaggtacttggagagcctgctgagctccaaatgaagaaccaatccaagtcggcacctgtttttcccaactttacttagctgtgtaatacgattaggttattgcgcggttcggcatgttccaaagttcaaagagaggagaggttcatagctgtagtctgtagatggtgggtgttgtgttttaaggactagcaaagtttggcttatc

SEQ ID NO: 251 - DNA, 406 bp, Hordeum vulgare
catatcaacttagtccttttcttggataaattttgcagacaaaggctggggatgccaagaagaaatgaggaaagattcttgactgttggctgctttcagttctatctgttcacaatcagtgtctgtaccctttagtaaagctctttgtggcaatgtcgcagtatgcttgatttagtagaaaagtgaattttgagcttttacatcgtccccggtatgctggttagtattactgacttgatttttgctgcttgtgttctgctttctcaagttgagatgagttcattgagtgggtttctcatccaaaattctgctgtttttgtttaagttgtggatcttttttttttctgtgatgccatcggtctgagcttgtggaaatctcatgttgtatttgacagctacagcaaac

SEQ ID NO: 252 - DNA, 709 bp, Gossypium hirsutum
tatttggaaggggaggaagaaaaaaaaatgagagaagaagggagaggaagagaggggagggagaggggaaggggttctcagcctgggggccggtcaccggccgatcgtcggccactgtctgtcgccggcgccagccacagcgcacggtggccggagaaggtactggggcggtggagcagagagtgggtgaacggtgggtggctgaatgttagaggattcggcgtcacaagctaggattagggtttaggtattttttgtttctgatttgtggtattgggcttagtgtttagttgggctaagggttttgtattgggtttgggtaatgggtaggtttagtttgggttcaaaattgttgagatttaatgtattgggctgagtaatttagggtggcccaaaattggcctttaacacatgggacccaagtaaactagtttataattttaaaatctttaagggactaaaataacaaattttcattttggtgctagggtccctgcctccccccttggtgccatccctgaatgtgcatgttagtccctggcctacgttatacatatgccttgtttgggttatgttcggttctttgtttgctatgcattatattagttttattctatattgtaacttgtcagacatatatttctacttgtaactttatgttctttattattagtgaaactttaataaaaaaatatttgtgttgaatcca

SEQ ID NO: 253 - DNA, 1439 bp, Setaria italica
acgccgccatctcccagaggaagctttctcccctattccatcgtccgctcgtacgccgcctcgctggctcgctcatccgcagattttggatcaccctttcgtttttggttttgtggggatgttcaagtttttatcctcccttttcttttcgtttggttttttcccctctccggtgggtgatttggtttgcctgttgggttgaggacagtgaagatcgtatctattggtctcgttcgtcgtaaccggcatctgtttgccttgccgaccatcctgatatatcaccacccatattccgagtcctcatctcagccacagtcaccagtcccatcgtgtgtttattttgttgcttcgcgcgtctattttaagatctgttatgttttgtggccgatgattaaatcaaaaaaatagacaagcatatgtctgaatctttctgtgtggaaaagcctaatcttctctatgaggtcaactgtatcttttttatttgtctttatttttttattattttggatctagacttggatcttggactttgactccattggggcctaggatgaaccatttggatgttctatttgtatgattttgatgattacaaaaccattactgccttccttctgaggcctcttcggattatttttttgttctttgtatttgtttttggtattttctgagatcgatatatggtgctttggtaaggtcgggtgatgagtaccagtgcatagttcagatgatataaccctcgtggttgtgattactttgaacaaatagtctttcgctcctaactgacgaccttatcaattcccaatctctgactgttgttccgtgttcttccaattccaataattttgttgtcttagttgctaactgtgatgttagattgtgacatttaattgttatgaacgttttccagacgatgtttgtatcttcaaatggagaattaaccattttctgcaattcttgcataacaatgtagtactttgcaatctaaaccttatttccgacgtgattttagcatttgtttcatatatgatggttctgcgactacgccattcagatcttaaatgtagacgttccaagctttgttagctggcaagcgacgtcggtctgaaactctgaatgaacagactctctggaattagctggaactcgaatgagaattgcaccattttatgtacgcacaaagcagtttctgattatggattcgaatcggaaagcagtatgagatggatggtggctgtaatttgttttagaatttagctggaatttcagtttccaaaattttaaccaaagtttgtttctgcggtaggattttagtatgatgaaggcaattgagatgcgtgttagtttgagatggcacaatctagaccggttggaatgtaatttgacctggtgatgtaccatgtttgacttggagtaatcataaaattggtttttgtgac

SEQ ID NO: 254 - DNA, 384 bp, Gossypium raimondii
acgaccttacttgaacaggatctgttctataggctcgtacctctgtgtccttaagctcaaaggagacaggattccaagtctggttgatgaaccaggactgtgtgacctgagcgtgattattggtctggtgattcccttgctggtttgacttcgaccgcagaggatcgttctcagcttgccttgggcggctgggaaggtcacgcagttgtctgacagactcttacgccttttttttctgctttttccatttgaatttgcaggcttattacagtctcttgttggttgctttgcagtgttgttcgaagcaaattttgggggattttagaagatagaaccaaatatgagtttcgaatttgcaatgctgccattcttggatgagcacac

SEQ ID NO: 255 - DNA, 451 bp, Zea mays
atcatcgtcctcaccagggtacagacgtgctcctccttctcccctccccttgtccacagcccccgtagaccatggaagatgcatggcttgagcatctgcatggttcttgagagttaaagctgcacgacgatggatagtggaaacagagcttctcaagaagcattcgttttcgtggtgcctttcctgacctccttggtggtcagctgaggtgcgcacaaaccggcaagtcacaatacggcaatggcggactccattaggagtcgtccttttttatttctttacccctttttacattctagttgtgtgattgtgtcaggcggaagctagaagacaaataacctaagtattcatgtgtgatggattatatacgtatacattggtgagacaatgtttgtctcatgtgtactccagtctccagaaacaagctgctataaatgaattgttgcttatc

SEQ ID NO: 256 - DNA, 228 bp, Zea mays
ccacgaccttacttgaacaggatctgttctataggatcgtaccgttgcatccttgattgataaggaggcaagcacttaaacctggttgatgaaccatgacctgtgggccagagcgtgattaacggccaggaatggctctgatgccctattccagtgctgtagatgatcgttcctcgccagttctaacctagctagggtggctcatgggttgtctgacaggttcttttt

SEQ ID NO: 257 - DNA, 165 bp, Zea mays
ctgcctgccaaattggatgatgtattcattccaaaaaaaaaaatggataagagccgagaagtcttatattatgaaccttcgattctaaaatgaaaattcttctacattgaatgtatagctgcagcaataaattttgatcagcctttctaccccctgcgcctacaa

SEQ ID NO: 258 - DNA, 216 bp, Zea mays
tgcgcagcctagcttgttgagaggaggagagcgcacgcctgcagctaaccgcctcacgcgaacaatgactgcacactgcagtgtgcaggcggaagtcgcagcaagcaagctcattcattgactaattaggggtgggggcgtaatcaatctacacaagcacactcgatcatcgtactcaatcagttaacggcggcggcggagcaggcgcggtggcgc

SEQ ID NO: 259 - DNA, 228 bp, Zea mays
tgcttgtgctaagatgatctcttttgcacttgtaataggggctcattcaagtactctactgatcgaaaatggatggcgtctatgatggttgattcttttgcacgtcttctacactggtacattgacggctgatggagatggatggtggtgtagctgttttgtttagcactctaggtgttggaccactgttttgttaatggatgctatgtaacagtagtatataactaa

SEQ ID NO: 260 - DNA, 877 bp, Sorghum bicolor
aaccctcgtgctctcgccgcagcgctcgccacttgccccgcaccactcgctcggccctcccaatcctcgcgcctccacttcgtgttccacaacgcgagccgcaaggtgcggctgtgccccctccattgatcgaggcggcggtggctcttcaaatccaaggagtacgaggctgcggcggtcaaggtgtggatctggtgagggaggcatcgatctgccatctgttcccgaaggcgtgttggatccggtgagggaggacgcattcaggatgaggcagctggagtggcaacgagctcgagcctaggagttggcggcagaagagggtgctcgaccattcctcccctgcatgacgtgcttcattccatggctggagctgcacccgtcaagcaagcacgagcccagcagttagcgccggccgtgaagcagcctggcaatgatagcgagcagtcagccaacttcaccagtgcggtgaagtccagggtgtctgatctgaatgatatatggatctgggtaccctagtcaacccatgcatattcgaagtggcgcttatgattctcactgcagaaatttccatgaagacaagactaatttgtaatgggctgagctacgtacaacaaactgctgctgggatgtaacctagatagtgcgaaggactccttttgtgtagtctgacatgctcctacaaactcaaatataagtaggtgctaaacttgctttgtagtcgactctgatcagtcaatggcacttgtatttagacggcttataaaaaagtgatcagttatatgtttattcagtgcaaatattttgatttctgggtggatgtataaatggtggcattgtgtataactgtattctgattatgagaggtatatgttcctgt

SEQ ID NO: 261 - DNA, 84 bp, Zea mays
tgcaatccttgatgcaagaattcccatttcctgaatcattatgattattacaacaaaaatcaccatctttcggctgagattgcg

SEQ ID NO: 262 - DNA, 2386 bp, Hordeum vulgare
cggaacatggtttcggagtgacaaagttgttaaagtaaaccacaagtggaagtgtggaacacgcacaatcgtgttcgtgcccgctacggaagctgactcatacacacccgagataagcataaaacctccggttgacacttactcccgtcgaaaggaaaagcccgcatcgtatagtcatccagattccgggctccagctaagccgccagaccgccgcatctccaccgcatctccaccgcttccccctaaacccacgccgccgaccatggcatcctcctccgctaaaccctactgctgctcctccctaaaccccgcccactccacccccgtcgccgggcgcaccaccctctccaccctccccgctgccaagccccgccgcttctcacatggcctcgccgccgtcgccgcgaaccctagggcctcccgcaccgccgtcctccgctctgtccacgcgtgcctggcggcgccgcgccggccggagtacgtcccggaccgaatcgacgaccccaactacgttcgcatcttcgacaccacgctccgcgacggggagcagtccccgggggccaccatgaccagcgcggagaagctcgtcgtcgcgcgccagctcgcccgcctcggcgtcgacatcatcgaggcgggcttcccggcgtcctcgccagacgaccttgatgccgtgcgatccatcgccatcgaggtggggaacacacccgtcggggaggatggccatgtgcccgtcatctgcggcctctcgcgatgcaacaagagggacattgacgccgcctgggaggctgtgcgccatgcccggaagccgcgcatccacaccttcattgctaccagcgagatccacatgcagcacaagctgcggaagacgcccgaccaggtggtggccatcgctagggagatggtggcttatgcgcgcagtcttggatgccccgatgtcgagttcagccccgaggacgccggcaggtcgaatcgagagttcctgtatcatattctagaggaagtaataaaagctggagcgacaactctcaacatcccagacaccgttgggtacactctccctcatgaatttgggaaattaattgctgacataaaagcaaatactcctgggattgaaaatgcaattatatctactcattgccaaaacgatcttggtcttgcaagtgccaacacattagcgggtgcttatgcaggagcacggcaattagaggtgactatcaatggtattggtgaaagagctggaaatgcttctttggaggaggttgttatggcaattaaatgtcgacgagaactcttagatggattatacactgggattaattcacaacatattaccatgacaagcaaaatggtacaagagcacagtggacttcatgtacagccgcataaagctattgttggtgccaatgcctttgctcatgaaagtggaattcatcaggatgggatgcttaaattcaaaggaacttatgagataatatcgcctgatgatattggtttaacacgtgcaaatgagttcggtattgttcttggaaagctcagtggaaggcatgccgtcagaactaaactagtggagcttggatatgaaatcaatgacagggaatttgaagatttctttaaacgctacaaagaggttgcagagaaaaagaagcgtgtaactgatgaagacatagaagctttactgtctgatgagatatttcagcctaaggttatttggtcccttggtgatgtacaggcaacatgtggaacacttggtttatctacagcaactgtcaaattgataactttagatggagaggaaaagataggttgttctgttggaactggcccagttgatgcagcatacaaggctgttgaccaaataatacagattccaactattcttagagaatatagcatgacttcggtcacagaaggcattgatgcaattgcaaccactcgagtagtcatcactggagatgtcagtgccaataaatatgctttgactggtcactccaatcgatccttcagtgggagtggtgcagccatggatgttgttgtatccagtgtccgagcttacctgagcgccctgaacaagatgtccagttttgttggcgctataaaagccagcagcgcagcacctgaaaccctaagtgctcagaccacagaatgagtgtttacatcacatttcttttctgttatttcatccccggagcaatgtgaatttacatgttagtaaagagctgtttggtagtgtaagggactgggttttctagctggtgtgcatctgaaggatattttgttctccttggtttattgcaacttttgcttgagcaatgagcaaatttacaacaatgtctagtgcataatttctactccctccgtcccaaaatataagaccattttttaca

SEQ ID NO: 263 - DNA, 2018 bp, Phaseolus vulgaris
ggaaaaacaacttcatataagaagcactagggggggcagtgggaggcacagcagatggagtatttcaacaaagccaaggccgtgaagctacggagccacctcgggaagtacctagtggccgacgacgaccaccacaaactgcgtcagagcaaaaacggctcaaccagaaattcaatatggttggtggagctggtgaaagggaagagccaccacgtgcgtctcagaaactccaacggccgttacctaaccgcgacggaggcgccctttctgttaggcgtgacggggaataaggtggtgcaggggagtttgggggatggttggaatgggaaattggagtgggaacccataacggaagggttgcacgtgaaactgagaagctggtgcgggaagtaccttagagggaatggtggaacgttaccgtggagaaactcgatcacgcacgatgacccttacgcttccaccacccacgattggatcttgtgggctgtggagcctctggagtttcccgacaaactgctttcttcgccggagactcattttccgtcgtcgttggagtcggaggatgagcttcgcggttcggaagaaccgggttcgtcactgttgcagagcacaagttccgacaccatgttccgctccggcatggagctcttccaccgcgcgaaggtggtgcggctgcgcagccaccacgacaagtacctcctggcggacgaggacgaggaatcggtgacccaggaccgaaacggatcctccaggaacgccaagtggacagtggagctcattccggagttcgacaacctcttacggctcaagagctgttacggcaagtatttgacggcctcgaaccagccgttgctactgggcgtgacggggcgcaaggtggtgcagagcgtgccgcggcagctggattcctccgtggagtgggagcccgtgcgggacggcgcgcaggtgaagctgaagacccgttacgggaactttctgagggccaatggggggctccctccttggaggaactccgtgacgcacgatatcccgcataggaccgccacacaggattggatcttgtgggatgttgatgtgttggagatccacgtcgagtctcctgctcctcctcctattcctcactctgattccctcgatttcgattcctatactccctctgctgtttccatcaaatccactgctttctccagacaagagtcgacggattcaaatgtgggttcgccaccgaagttggaggggaggactatatactaccatgttgcagaggataatggggacgtggatgatgagaatgtgcagggttattctttgactttcaaaggaaatggggttgagcagttgactcggaagtttgtggaagagacggggcttgagggagttattgtgtgcactcgaagtcctttgaatggaaaactctaccctcttcgcttgcagcttcctcccaacaatgtcaccatgcaggttgttttggttcttccctcgtctaaagtggcaagagactttgaggagcaaggtctactatgacaagctagattattgttggagtcttgaatctactgaaatgcaaggcctatttacgttgtgatccaaagcgtgtttcaaattttatgtgataacatttaagaatttgttgcaaaacttcacctatttcaagtgattccctgcattcagaaggaagaattcgtggaggtccaattgtaccttaaagttgccttgggaaactcatgtcagtcttatccactattaattggtgtccaatagtctgtagaatgtcgacgattcttatgtaaatggaagtctttgttgggcttcttatttattagtgctagctttaatcttagtctattgatgtggattcagatattttgttgtatctcatttttttgttatttttctctttttcatgtttttaagtccatttgtatagccaacttttcagaaaagtataggtaaattatttttagtcatataatttcaagaattagtaacattttttctcacatatacattttgcctca

SEQ ID NO: 264 - DNA, 2864 bp, Phaseolus vulgaris
ttgatgctcaataaagtcaaacaacagcaaagaacccagcttttttatttccaccatgcaataaagaattggagttaccaagaatcagttattctttcccttctcattcttctattcaattctcttcctctctcacaccccatcctctctctctctctctctctttctctcgactcctttggtttctgcaatggccacccttgcagacattggtgtctcagctaccatcaacattctctcagcctttgctttcttgctggcttttgctctgctgagaatccaacccgtcaatgatagggtctactttccaaagtggtatctcagtggagggagaagtagtcctaggagttctgggaattttgtgggcaagtttgtgaacctcaatttcaggacttaccttaccttcctgaattggatgcctcaggctctcagaatgagtgagtctgagattatcagccatgctggccttgactctgctgctttccttagaatctacactctgggcttaaagatttttgttccaatcacagttgtggcactcctcattcttataccagtcaacgtatcaagtgggacattatttttcctaaaaagggaattggtagtgagtgatattgataaactctcaatatcaaatgttcctcctgaatctataagattttttgttcacatagcattggaatacatgttcacattatggatttgttttctgctgtacaaagaatatgataatatcgcatcaatgagattgcacttcattgcatcacaacgcaggcgtgtggagcaattcacagtacttgtcaggaatatccctcgtatgcctgatcacgcagtatcagattctgtgaatggcttctttcaaacaaaccacccagatcattatattggacaccaggctgtctacaatgcaaataaatttgctaaattatcgaaaagaagagatagactccaaaattggctggactattaccagcttaagtttgaaagacatcctgacaaaaggtccaccgtcaagactggatttttaggcctttggggtgggaaagttgatgcgattgagtactacaaacatgcaattaaggaacttgataacctgatgacatcggaacgccagagagttataaaagatcccaaagctattttgccagttgcttttctttcattcaattcccgttggggagcatcggtttgtgcacaaacccaacaaagcaagaatccaacactctggctaactgattgggctcctgagccacgtgatgtatattggcgaaacttagccataccatttgtttctttaagcatccggaagcttgtaataacattgtctgtgtttgccttggtattcttctacatgattcccattgcttttgtgcaatcccttgccaatttggaaggtcttgaaaaagttgctcccttcctcagaccagttatagaattgaacttcatcaagtcctttctacaaggttttcttcctggtttggctcttaaagtatttttgtacattctaccatcagttctgatgatcatgtcaaaaattgagggatatactgcattgtcaactcttgagcggaagacagctgcaaaatattattactttatgctggtgaatgttttcttgggaagcatagtgactggaactgcatttcaacaactgcatgctttccttcaccagtcacctacacagattcctagaacaattggagtttccattccaatgaaggctaccttctttatgacatacataatggttgatggatgggctggaattgctagtgagattctcagattaaagccattggttatataccatctcaagaacatgttcatagttaaaacagaaagagataaaggaaaggccatggaccctgggagtgtggactttccagagactattccaagtcttcaactatacttccttcttggaattgtgtacgctgtggtcacaccgatccttcttcccttcatactagtcttctttgcctttgcatatttggtttatcgtcatcagataatcaatgtctacaaccaacagtatgaaagtgctgctgcattttggccacttgttcacagccgcatcattgcaagcatgctaatatcccagtttcttctattgggattgcttagcaccaaaaaggcagctaaatccacacctttgcttgttatattaccagtattgacatttgcattccacaagtactgccagagacgttttgagccagcatttcggaagtacccgattgaggaagcaatgtcaaaggatttattggagaagagcacagaacctgacttgaacataaaggcttatttggctgatgcttacttgcatccaatcttcaggtcatttgaggttgaagaggaattgattgaaatcgaagtagataaacaacaaactgctgctcctagttctccatcgactgagcctagttcaccctccccaccccatcatctggatcaacaactatcaccaccccatcatatcattgaacccgcactaccacctcaatataatgagtatccaccaggttattactaccaataccatcctccctcccctccccattatgtttatcagtactaagtttagccttgaactcaactcctgcataccaatcaaccagtttgcttgagacttgccgaaaatttagtatttccagtgaacttagatctgttttgggtttttatctatccatttcaagtgtaaatgatttttctccttacatgtaaatggtttggtttcatccaaatgtggggtagcaggattttactttgagcaagctcctaggaagatgtgaatgtttgtcaaaacaatttattctggttaataggttattattatcattacctagaattttgcttttatgaaa

SEQ ID NO: 265 - DNA, 4978 bp, Chlamydomonas reinhardtii
aagttgaattgctatcgttgtcatacattttaattaggtagcttccagtatgcaactttagccctgtgtcactggcgaatcgtcgagaatgcgcaactcgtcgaccttactgcgttcggcattcgcccgccggggcacgcacttacaacagcagagtgcgctgtgggagttgcatcgcgcccgatactcgacgaacgacgatagtaatcgcgaggaggggggcctgctcaacaagatctggcgggccgggctcggccagaagccgaaggacagcagcagtagcagcagcagcgctgccggaggcagcagcagtagcagcagtagctctcgcagcagcggcgccagcagcggcgatgcgctggtgcccagtggcccggagcggcggcaccacaaggtgtttgtggtggagctgtctcgcaagccgctgttcccgggcatttacacgccagtcatcattagtaagaacgaggcgctggtgaaggagatcatggacgtcaagaagcagggcgcccacgcctacgtgggtgcgttcctcaagcggccggagccgccgctgggcatgacggccgccgccgccgtggccgccgcgggggagacggaggtgcgggacgccgcctcccacctgtacgacatcggcacgtttgcgcaggtgcacacagtgctggcgggcgacagcgccgactcggcgcagctgctgctgctggggcaccgccgcatccgcaagaccggagtgatctctgcggaccccctgcgtgtgcatgtggaccacctgcgtgatgagtcctacaccagcgatgacatcctcaaggccaccagcatggagatcgtgaacaccatgcgcgacctgctgcagctcaaccccctgtacggcgagcagttcaggacgctgctgtcgctcaccggcagtatcgacctgcaggacatgagccgcctggtggacgccgccgcctcgctcaccagcgccgacgacaccacactgcagacggtgctggagacactcaacgtgccggagagggcccggctggtgctggggctgctgaagaaggaggtggagctgtgcaagctgcaggcggacatccgggagcaggttgagggcaagatcgtcaaggagcagcggcgcatgttgctgatggagcagctcaagagcatcaagaaggagctggggctggagcgggacgacaagagcgcgctgctgcagaggttccaggcccgctgggacgagcgcaaggcgctggcaccccccgacgtggcgcgggctgtgcaggaggagcttgacaagctgggcggcctggagccggtcagccccgagttcaacatcacgcgcacctacctggactggctcaccagcctgccctggggcgccaccacgcaggagctgttcgacctggtgcgggccaagaaggtcctggacgacgaccactacgggctggaggacgtcaaggaccgcatcctggagttcatcgcggtgtcgcacctgcgcggcagcgcccagggcaagatcctgtgcctggtggggccgcccggagtgggcaagaccagcatcggcaggtccatcgcgcacgcgctcaacaggaagtactaccgcttcagtgtgggcggactgcacgacgtggccgagatcaaggggcacaggcgcacctacgtgggcgccatgcccggcaagctggtgcagtgcctcaagagcacgcagagctccaacccgctggtgctcattgacgaggtggacaagctgggccgcggccacagcggcgaccccgcctcggcgctgctggagctgctggacccggagcagaacgccgccttcaccgaccactacctggacctgccgctggacctcagcaaggtgttgtttgtgtgtacggccaactcgctggacaccatccccggccccctgctggaccgcatggaggtcatacggctgtccggatacgcacaggatgagaagcgcgccatcgcgcggcgctacctggagccggccgccgccgccgacgccggcgtgccgcccgggtctgtgagcctggcggacgacgcgctggaggcgctgatcggcgagtactgccgcgaggcaggcgtgaggaacctgaagaagcacgtggacaaggtgtaccgcaagctcaaggactacgtggggcaggcgccctttgcaaaggacaagttctacgagtccacaccgcccggtgtggtgatgggtctggcctggacgcctctgggcggcgccacgctgtacgtggaggcggcgcgggtggcgggcagcgaggcgcgcggcagcctcaccaccaccggtcagctgggggacgtgttccgggagagcgccaccatcgcgcacacctacgcacgcaacttcctggcggcccgcatcgccgacggcaccattcccgccggcgccgccgccggcgcgctgcacgtgcacgtgccggcgggcgccacgcccaaggacggccccagcgcgggctgcacgctggtgacggcgctgctcagcctggcgctggaccggcccgtgcggccggacctggccatgacgggcgaggtgactctgacgggctgtgtgctgcccatcggcggcgtgaaggagaaggtgcttgcggcccggcgcagcggcgtcaaggtggtggtgttccccgagggcaacaggcccgagtacgaggagctggcggaggacatcaagcagggtctggagccgcacttcgtgagcagctacgaccaggtcttcaaactggcgctggagcacgacagcggcagcggcaacgcggacaaggccaagcaggaggcgccgctgtccacgagcgcatgaggtggtcggcggggggcaacaccgagcgagcgcgtgcgaggatacggagggggccacgtagtcagtgtcgagtcgtctgtcgctgcctagcctgacaccgatggacgttttgaattgggctgaaatgtgcattcatgtgtaattaattgtcgcttttccagtatttccacccttcgcaaccggttacggccgagcggatccaagccatacggaatgccgagacgagactcactgcgagcaactttgcgtactcgaaacttgctcaaggtgtgcgtacatgaaaatctgcatatgtactcagagcgtaggcgctaggttacggactcgcgtgctagccccgaaatgattcggactcgcgtagggttgagaggtacaaggtgaagcacagacgattaatgaggacaagatagcggaaaatgagtgaacccttgttagttttcgacccacagccggtccacatattgctgttagtgtttggcctcttcacaattgttttcgcgactttcgggcgcgtccttaaggagcggctcttcctcaccgagccgctatgcgccacctgcataggcatcttcatagcggccgcggcggtgggcattgagacgcggctggacccggtgcacaatgagagcacgcgcatcgtactgctggagttgacccggctcaccatcgtggtgcaggtcatgaccactgcgctggagctgcccacgggtctggtggtacggcaatggcaggcgctgctgctgctgctgggacccgtgctggcggcgggtgagcgagaggggcggcgggcgtgcttgattggcgcgtgtgtgacggccacagaccctgtgctggcgcacgctatcgtgcaaggcacctttgctgagacgctgctgccgggccggctgcgcgacctcatgtccgccgagtccgccgccaacgacggctttgcctaccccttcgtgatgctgcccgtgctgctgctcacacagcccgccacaccgcacctggcggcagagtacctggtgactgtgtggctgtgggagattatcaccggctgcgtcatctgcggcctcatcggcttcatcagcggcaccatcctcaaatgggcggaccgcaagggctttgtggagaatacctcgctcgtggggtacagcatcgtgctggcactcagcgtgctgggcgcgggccgctgccttaacatcaacgagatattgggctcctttgtggctggcgtcgccttcgcgtccgcactggacgcacgcgaccgcatcgccgagctgcagatccaggagactgcagacctgctgctgggcaacttgttcttcctggcgttcggcgcctccatcccctgggacagctggggcgacgtgggcttcggggcgggccagatggtgggcgtggcgctggcggtgctgggcctgaagcggctgcctgtgctgctggcggtgtacaggttgatgcccagcggcctccacacggtggcggaggcggcacacttcggctggttcggcccggtgggggtggcggctttcttttacgcgctggaggtcattgaaaaggtcggcggcgacacgggcgagcgctgctacgtgctgctcacagcagcgggcactgccggcggcgtgggcgggtcaagtcggtacgccatgtatgcgtcacccagcctgcgtgcagcaggtgcggccggcggcacggcacgcgtgtcgtttgcgccgcggcgttaccaccaactggcgaccgcgtcagtgccgctgccggctgctgctgctgcgggtggtgcggtggggaatgggagcatgcaccggaatgggagtcagcagcgagctacagggcggcaggcagcggtgccgcagcaggtcgttgcagatgccgaggcgccgccacctcgtcagccgctctgcggggaggcagagatggtctcagcccgcgcctaatggcgactatgtttactcgtgtttgttggttgctgtcacgcaagactagctagcaggttttagtggtgtggtgcatttagtcgttccgtataagcaggaagactcttgaagtaaatgagatgccttagcaggtgtgtgcatacggcaatgttgcgtgagtgactccctgttggctgacacggcgaaaggacgtacatataaggatacagatacagcactggggtggggttgaccttgggcggtggattggacacacacacaacgcgataag

SEQ ID NO: 266 - DNA, 1337 bp, Gossypium hirsutum
ggtttgatgatgcatgcatccttgacatggactactttgtgaagaccatctcaggcataaaggccaagggtgttcgtcccgacttagtaggctcaatcatagcacattatgcatcgaaatggctacctgatctatccggcaatgacaccgaaaagggtcctatgagcctccaagagtcatcgccggagagtgtcacggtttcacggatgaaaaagaggttctttgttgaaaccttggtgggaatcttgccacctgagagagattccatcccctgcaacttcctcctacgccttctccgaacggccaacatggttggggtggagccttcctacaaagcagagctggagaaaagaatttcgtggcagcttgaccaagcatcactgaaagaactcatgattccatcgtttagtcacacttgtggtactctgctagacgttgagcttgttataaggctggttaagagatttgctagccttgatgaaggcactagaagcggcattgcggtggttaaagtagctaagcttgtggatagctacttggcagaagcagctttggataccaatctgagtttggaggactttattgcacttggtgctgctcttcctagccatgcccgagccatggatgatggcctctaccgtgccattgacacttatctcaaagcacatccaggtgtttcaaagcaagataggaaggttctatgcagattgatagacagtcgaaagctgtcaccagaagcatccctacacgctgcacaaaacgaacgtttgccagttcgggcggtgattcaagtgttgttctgcgagcaaagcaagctcaaccgacatgttgattggagtgggtcgttcaacggaacccggagtccgaacccggcaggacttgaagccccggttcggtgcatgtcgaaacgtgaaatgaacgctcaacaaatggagataaagaagctgaaggaagagctgctcagggtccaaagccaatgcgtagcgatgcaaatgcaaatggagaaactagtggataagaagaaagggtttttcaggtggaagaagctggggataatgccgtcgctgaagagcagcgtgagtgtatttgagaagattgaagaagaaagagaggctaactttgggaggcaaacccccattgatatcaaatctaagcctgttcgtcctcccaagtggagaaaatccatgtcgtgaattcattatgtaggggttcctaattaatttgctgctaaatttaatgtttatatatatatatatattccttttctatgttccatgtcgcgataataatgtaacaataataagattcgtattaaataaatgtagtttttcgtttaa

SEQ ID NO: 267 - DNA, 1817 bp, Setaria italica
aggtgggaagggaaaaaataaaaataaaaaagccagcgccccggaacacggggagcgaaatcgcccggccaatccacccaccccaaccccgacatggaggccgccgccgcggcgcccgtgctcgacgccttcttcgccgggccgcgccaccaccaccaccagctccgccccaccgccgccgccggaggcggctgcagatccgcgcgcctccaggcccagccgtcccgcgccgccgccgccccctacgcccgcgccgactggcaggccgcctgcgccatcctcgccagcaactccagcggaggcaacggcggcagcaccagcagcgccgacgccagcaacagcaatagcagcagcaagcagccggcgccgcgggtcaacgggcaggagccgccgcggccgcccgcgctggaggcgacgccggcgccggtgcccgcggagctggatctggtgccggtctccaacctgccccggcccctcagcatcagcgacctgtccccggcgccgatgcacgggtcccagctccgcgtggcgtaccagggcgtcccgggcgcctacagcgaggcggcggccgccaaggcctacccgggctgcgacgccatcccctgcgaccagttcgaggtcgccttccaggccgtcgagctctggatcgccgaccgcgccgtgctccccgtcgagaactccctcggcggcagcatccaccgcaactacgacctcctcctccgccaccgcctccacatcgtcggcgaggtccagctccccgtccaccactgcctcctcgcgctcccgggggtgcgacgggagctcctcacccgggtcatctcgcacccgcaggcgctcgcgcagtgcgagctcacgctcaacgccatggggctcaacgtcgcccgcgaagccttcgacgacaccgccggcgccgccgagcacgtcgccgcgggcgggctccgcgacaccgccgccatcgcgtcggcgcgcgccgcggagctgtacgggctccaggtcctcgccgacggcatccaggacgacgccagcaacgtcacgcgcttcgtcatgctggcgcgggagcccatcatcccgcgcaccgacaggcccttcaagaccagcatcgtcttcgcgcacgacaacgacggcacctccatcctcttcaaggtgctctcggcgttcgccttccgcgacatctcgctcaccaagatcgagagcaggccgcaccgccaccgccccatccgcctcgtcgacgacgccaacgtcggcaccgccaagcacttcgagtacatgttctacatcgacttccaggcgtccatggccgacgtccgcgcgcagaacgcgctcgccgagatccaggagttcacatccttcctcagggtgctcggcagctaccccatggacatgacgccgtgggacgccgcgccgtcctcgtggtcctcgcgcgtcgacaatagcagcagccagcacttgtagagattgctgaatgctgatcaatcaatcagccaaggtagccacggatcgatcgatcaatcaatcaatggtgaattgccacttctttcaattaggaaggaaggacgcacgaaacgtttcttggttctttcattcgcttttgttttggaggagatcaaactgcatcgcgtttggtcgatgctttctcctcgatgctcctagctcccttttcgatttgtgttcatcaaatccagagaggcggtagaggggctcttgttgtacgctgctggtgtatgtaagtacagtatattcttatacttgtttaaacctttgaagaaatcaatcatgcgaaaccatggaattcaaaatgaaaaccaattctttagagc

SEQ ID NO: 268 - DNA, 2120 bp, Setaria italica
gcctttcggttagtagtttaatcgttttccacttttcctcctcgtcttctgggctctggctgccaactccaagagcggcctgccaatccgaggagtgagggagagggaggcgcgcaactggtgcgcaaatggcaatccgatggcaccgccgcggttcttctcctcgtcggccgggcgcgctggagctccgccggtcctccttgtccattggctgccaaccccaagagtaaccaccaatccaaggagtgagcaagggggtgcacgagtggcaaagcatcaatccgacggcaccactgctcttctcctcgctaacccccaatggtgataacatgatatcgatgtgaagttttgtggcacttgtatcccttacaagtaagtgttcgggtgatccttttgagcaaatggaaggcactaaccaaccccctggaagcaggatgcaaggggctccctttggcagtttagacttacatggcaactctatggaaacacatgctccaaacttaggaaagcagatctttatcaactctcaaatacctgggaccctcacaatgaacagggcttcagagcctgatgactttcctgggtttcagttcaaagaagatggaaggagtgataagaaccaccatcagcacagtcatcactcaaagaacggcttgattgatgacgagggacattatatgactgaagatgctaccaatacccccagtgtcaaaggcaagaaggcctctatgtggcatcgcatgaaatggacagattcaatggtaaagcttttgattacagcagtgtcttacactggagatgatcatggtgctgatttaggtggtggcaggaggaactctacaataatgcagaagaagggcaaatggaaggcgatatcgaaggtcatgggggagagagattgccatgtgtcaccacaacagtgcgaggataagttcaatgaccttaacaagaggtacaaaaggctgatagacatccttggtaggggtactgcttgcgatgttgtggaaaagccagaacttcttgatagcatgaatcatctttctgataagatgaaagatgatgtgaagaagctacttaactcaaaacaactgttctttgaagagatgtgttcctaccataacaacaaccgtaggaaattgcctgaagatcatgcacttcagcattcactactgcttgctctcagatgtaaagaggaccatgatcctctgagggatgcaagtggagatgctgatgaagatgatcaaagtgcggattctgatcatgaggagaatgatgatgaagagcaacatcctgtgcatacaaacatgagggagccctccatggacaaaagggctcgccacggcgatgcagctttgctcacctcaagctctcatgaaggtattaagaggtctgatccccatggcataacagtggacatcaacaaggctttcccagatggaaccaactgggctttgttgcaacaggacttggcttcacaatcactagaggtccggaaacgtctcttgcagattgaagaaaagaacctggaactcaaaaagcagtgtgttaagtgggagcgattcaggaagaagaaggatagggagatagaaaggatggcgatggagaatgagcatatgatgattgagaataagcaattggaacttgagctaagacagaaggagctagagttagagcttaagctaaaaggccaggccaatcatgcatgacctttggttgatcaaagcttctattctgaaggtcgcagatggcttctgattcagaacggagttgcgcttctggaagagttaaaggtggcgggttatcagagtactcggataaccatttctgtgcatattacttagttctgtgtggtgtactggttgggcctcctgcttgtaacattcccctcttgggcagtagcagtatcaggcttgatgtgctgtgtctgtaaggccgtaacttgaactatgtcgtggtaccttttcctcttcagcttttaatcttttatgtcagggtgttaaaagaacctgaagagtaacagttttagctgaaggaagaaatctggggttcaagaatggagtaaaaaggaggaataataataattaatcatgtgccattgcaaacggcttttcctcatttga

SEQ ID NO: 269 - DNA, 2862 bp, Setaria italica
gccctcgccacaagggtaaaccaaacccctcctcccgtcccactccccgcgcggccgccaccgccagcccgccgcgtcctcgagcgccccctccagttctccgcctctccttcctcccctcccctgcaatggcgtcggcgggagggccctccggggtcgtaggtaagtcgcggctcctatctcgccctcttctgttcgttccgacatatccccggcttgtcgtcgccttgttagcgaccaaacccccaatctccctcgccgggattggatgcggcgaacgctccaatccccgtcgagctgaccgcgaactcgctgtattctgtgcgccgtgctgatttatttgttatgacttatgagcagcagtagcagcctgttctccccaatcttctcagtctctaaacgtttttaggcttcgttatgtatatgtatttgttcggctgctctaatgaatatcttgctggccctgcagggattagtgtccgtccggactccagtgcggcctgcctctttcagaaggttggagcccgatcgaattccctccctggcgcagcccctgttcaggttcgccggtgccacaacaaggcccgcaatggccaagctatcaggtgtgcaatggcaactggaaaagagcagggtgcagtcaccactactagtagtgatcaacacaaaggtggtttgcgtggcaaattaaacaaagttgttttagcttatagtggtggcttggatacatcggttattgttccatggctcagggagaactatggttgtgaagtcgtttgtttcactgctgatgttggccagggcgccattgaattggaaggattggagaagaaggcaaaagctagtggagcatgccagcttgttgtgaaggacttgagagaagaatttgttagtgaatatatatacccctgcctgcgagctggtgcagtttatgaaagaaagtatcttcttgggacttcaatggctaggcctgttattgctaaggcaatggtcgatgttgccaaggaagttggtgcagatgcagttgctcatggatgcactgggaaaggcaatgatcaggttcgctttgagcttacattttatgctttaaatcctgaactcaaagtggttgcaccttggagggagtgggacatcacagggcgtgaagatgctattgagtacgcaaagaaacataatgtgccagttccagtttcaaagaaatcaatatacagccgagaccgaaacttgtggcaccttagccatgagggtgacatcttggaggacccagcaaatgagccaaaagaagatatgtacatgatgtctgttgctccagaaaatgcaccttcggaacctgagtatctggagattggcatcattgcaggtgttcctgtttccatcaacggacgggacctgtcgcctgcatccctccttgcggagctcaatgaaatcggtggaaagcatggaatcggacgcattgacatggtggagaaccgccttgtaggcatgaagtctcgtggtgtctacgagacccctggtggcaccatcatggcagctgcggtgcgcgagctggaggccctgaccttggacagggagaccatgcagtggaaggacatggtcgccctcaagtatgctgagctggtctacgcaggccgctggtttgacccgctccggcagtccttcgacgccttcatggagaacatcactgcgacgactactggttcggtgactctgaagctgtacaaggggtcggtgaacgttgcgtcccggaagagcccctacagcctctacagggaggacatctcttcgttcgagaacggggagatctacaaccaggctgatgccgaggggttcatcaggctctatggtctcccgaccagggtccgggcgatgctggagaagggcatctaagttcctctgtttgttctgaaaataaaagccatcattcggaaactgtcaaagcgtttccagcgattgcggaccggttgttttgtatacgttgtttgagtttcaacgaatgaactctgaatgcatttgggtgacagaatggacgtgaatcttattttgggtgatgtgctggctgccgatgtaggacgttagttcagacgcgcgaaataaaaggtggaaacaaaatttacattaaaaagcctctcaacatgccatctcaactgccggctagcagcgggcggcgtgaagcagagcagcgtcacttgtccccgcacaaacaccgactgccccttgggctccgaacaccgtcgatccacgcgcgctggattggatgcgagccaggaagaaggaagaggaggtaccaggtagccctgctagtggggcgggggcaaatggggattttgggtcgggttatttcgtggggattcgtttttatgggtagttgcgggtatagaggtccagcgggtcggggcgggttggggtgctgcatttgcgggtcagagcgggttagaacacccacgccaccgccgaagggatctatcctacggtcctacctcgcgcagcgtcgcagcagctcacggaggtggctttgcgggcgcaagaagtagcaccaccgccgccagcgccaccgcccctactgtcggccgtcgccgctcctaccgccgattgccgccgctcttgggggcacgcagatctcacggggggcgcaggtctcacggtgggcacgcagatctcacgggggcggggctccaccaaggaaggcggcactgccgccggccaccgccgctcccgcgcgaccaccttctctacggcaaggccacagatctgcggggaaggcgccaccggcaagcagcctgggagcaacggcaacggcgacgccccatccacgactctacggaattacttcgataaattgctgcgtccagctgtggggctgct

SEQ ID NO: 270 - DNA, 2691 bp, Setaria italica
gcgcccccgcccggatcccctgcgggcggctattaaagggcgatcccccctctctccgtgtcgcctcggggcggttgaaattaacgaggccgacgacggggacggcagggacggggccgggcgggcggacagcagcgaaacagccagcgtaacagccagtgtgacgcgcccgagaaagaaagcgagcaagcaaccgacgctgccctcgtcggtggccaagcgcccaagacaagagcaaccggacaagctagcccacagctagcgagcctgcgcgctgctgcggccggcggcgacgaaagcgaggaggaggatcggaggaggaagtggtggagaagggcgggcgccgtgcccgcgatggtggtggcgagggcgaagaaggcggcgcccgcgggcgccggcggcgccggagctggcgcgcggcggagcggcgtcagggtgggccccgcgaggctcgagggcctccccgcggcgtggccggcgggcgccgctgccgtcaaggtcaagtggcccgcgccggggggcgcgctctcgcagatgctcacgggccgctgggcgcgcggggtcaccgccgtcgagcccgtcgccgcggggggcaccgtgaggtgggagccgcgagacggcaaccgcttcagcctccacgtcgagcccgccggcgcgcgcggccgcaccgagcgcggcgtcttcttctccctcctctatggattccaagaacagggccggggcaaggacctggtgaggctggaggagatcgggacagccatgataagcctggaggagtgctgctgggagatgcaactgcagcagcagcgccagcagctggtggttgtccccatcagggtgaggaaggatggatgggcaagtgatgccatgctttatgtgaacgtggagctcgtggacatgatgaacacacgctccgacattgaaagggctgtctcgttcagggagaagccgagaacgacgagcaagccgccgccgcatgcaatgcgagaccaccggaagagcttggaggcagcggcgtaccatgacgttcttgatctgaagcagctgctcgacctggctgagaaggaaggccgggtggctgtgtacgggagcaagaggaactctgacaccagcagcgtgagcagcttcagtagcagcagcagcagcagcacgatcagcatcagtagtgccagctccagcggcggcgcgagcccggagctcgcctcgacgtcgaagcgccggttcttgccatggatgcggaggagcagggacttcgacaagaggagcaccgagtcgctctcccaagaactgccgatcaagtgcatggacgacgatccggccggcagctgggagacgcgcgagttcacgagcagggacgcggagacgaagctgaggacgccggtgttcttcgcgtccatcgaccagcgcgacggcagcgccggcggggagagcgcgtgcacggcgctcgttgcggtgctcgccgcggcgctccacgccaaccacccggcgatgccgacgcggccggagctggacgcgctgatccgtgacggctcgtcggagtggcggagactctgcgacgacgaagcccacatggcgcggttcccgaaccggcacttcgacctcgagaccgtcctcgccgcccggacgcggcccatcgccgtgcagcacgacaggaccttcgtcggcttcttccagccggagagcttcgcgtcgctctccggcgccatgtcgttcgacgacgtctggcgcgagatcgccggcggcgagcgcgagccggggcgcgcggacgtgtacatcgtcagctggaacgaccacttcttcgtgctcaaggtggagagcgactgctactacatcatcgacacgctcggcgagcggctgcacgagggctgcgacagggcctacatgctcaggttcgacggctcgtcggagatgcacgcgctgtcgacgccggcagtggacgacggcaaggaggaggaggtgatcgtcaccgggaaggagtgctgcagggagttcatcaagaggttcttggccgccatcccgctccgggaggagcttgagatcgagaagaagggcgccggcagcgttggcgcgccgcaccagcggctgcagatcgagttccacttcacggtcctgcaggacgacgagagatgaccacttggtgtggtgatctgatggcagtgaggggatgcttcttccctgattgcaatgtacactaacataatgtaaattcatctacactgtaaaggaacaggaagtgcagcacgtactacaaattacaggctaggattgttggttctctttgtaccagtttagataggacacaggcagaggaaaatacaggaaggatacagggtgctggttgggtatttttcacaggggttttggatccatctctggatcccttcacttgtgacataccattttgcaagcgagctcagagttacatgaagtttactttgcccatctcccacttgtgatccgagccatttgcaacaccttttattgaaagattcagggggaataaaaccttctccctaacacacagagagatagcactggttccctcattttaacatgtaaatttcctatcacgatttctatagaatcaagatagcattctgtcacattacattcaagaatcatgactccagacatacatcattatttgactacattgtcagatgtcagctatcctgaatctgtatttcaacc

SEQ ID NO: 271 - DNA, 2279 bp, Setaria italica
cccttcgcctgttcgccaccaccgtcttaatggtcgctccggtggttgcacccacccaacccattcaccccggcgtcgcccccggccgtgcccgccaggtcttcctcttcctcatccatcctccaccgccggcgacccctatatattcgcgcccaacctccccgccccaccttccaagcccacccacacccactctccctctcctcaactccgagttctcgacgccgcgcagcaccccgccgctcagctagtagcctcgcccatcacccttgctacctcgccgcgccacgccgccaggcaccatgagcgccgcccagcaagcagaaccgaccacctctcccgcctcccccacccccgccggcgccggcagcaccacggtaatcaagaacgcccggcaccgcccgagcgcgctcaaactctgctaccacgttgccatctccaacctcccgtacctcctcctggcccccttcgcggcggccctcttcgtccgcctctcccggcactcccccgccgacctcgccgccgcgctcacctccaacccacccctcaccgccgccctcgccgcgctcgccgccgtcctcgtcaccatctacctcgcgcgccgcccgcgggccgtctacctcctcgacttcgcgtgctacaaacccggcccggagcacgtggtgacccgggagacgttcatgcggcagtcgacggcggcgggggtgttcacgggcgacaacctggcgttccagcggaagatcctggagcggtcggggctcgggcaggagacctacttcccccgggccgtgctcaacgcgccgcccaacccgtgcatggcggaggcgcgagcggaggccgaggccgtcatgttcggcgccatcgaccaggtgctggcaaagacgggcgtccgggcgcgcgacatcggggtcgtggtcgtcaactgcagcctcttcaacccgacgccgtcgctgtcggcgatgatcgtcaaccattacaagctgcgcgggaacgtcgccagctataacctcggcggcatggggtgcagcgccgggctcatctccatcgacctcgccaagcagctgctccaggtgcaccggaacacgtacgcgctggtggtgagcatggagaacatcacgctcaactggtactggggcaacaaccgctccatgctcatgtccaactgcctcttccggatgggcggcgccgccgtgctcctcacgaaccgcggcggcgcggaccggcgccgcgccaagtaccagctgatgcacacggtccgcacccaccacggcgccgacgaccgcgcctaccgctgcgtgttccaggaggaggacgagaccggtcgcgtcggcgtggcgctctccaaggacctcatggccgtcgccggcgaggccctcaagaccaacatcaccacgctggggcccctcgtcctccccatgtcggagcagatcctcttcctcgcctccctcgtggggcgcaaggtgttcgggctccggtcactcaagccctacatcccggacttcaagatggcgttcgagcacttctgcatccacgccgggggccgggccgtgctcgacaccatcgagaagaacctcgagctcagcgcgtggcacatggagccgtcgcggatgacgctgtaccggtgggggaacacctccagcagctcgctgtggtacgagctcgcgtacacggaggcgcaggggcgggtgcggcggggacaccgggcgtggcagatcgcgttcgggtccgggttcaagtgcaacagcgccgtgtggagggcgctgcggaccatcgacccggcgaaggagaaggttgggaacccgtgggtggaggagatacacaggttccccgtcgaggtgcccaaggtggagagcgtcgtcgtcgcgccggcggcggcggcggcggcggcggcggcggccgaatcgtgaggagcgtggagcatgcggctcttgtatttgaatttggaaaaaaacatgtggaattataaaagtgtatgttgatttgagttgagcgtggggttaggtttgtaaacatacaagaacgaaatttggtggttggttggttggagatgtatgtagctgacatgtatgtgttggagcttcgataggaagcaaaaaagtaaacctgatgttgattctttgcgttgggtcgggttaatttggcgttgggggaaataaggaatgcaaaattgtataaaaactcgaaactgattgtgtaccattagcactcagcgttgtaacgttcatgcttctatcttaatataaagatgtgcaatcctgttacatatttcattaaaaaaa

SEQ ID NO: 272 - DNA, 1270 bp, Setaria italica
ggcgtgttcagggtggagcttgcgtcgtcgtcggagtggcgcgacgggaagcccgtgctgctccaccatggctgggctggcatcggcaagggtgcggcggaggccaggccggagctccacctcagggtgaagatggaggccgacccccggtacatcttccagttcgacgacgaggtcgcgctcaacccgcaggtcgtccagctccatggcagctcccggcagcccatcttcagctgcaagttcatccgcgaccgccgcaggccgtctcagggtgacgggcagtactggtcgagctccggcggtagcgaggagacggacatggagatggcgatgagaagggagaggaaggggtggaaggtggtgatccacgacctgtcggggtcggccgtggcggcggcgttcatggccactccgttcgtgccggcgccgggcggcgacacggtggcgcggtccaacccgggcgcgtggctcatcgtgcgcgccggcaccacggggtcgtcggacagttggcagccgtggggccggctcgaggcgtggcgggagtcgtcgtcgtcggcgccggcggcgagcagcagggacacggtgcggctgcggctgcacctgctcccggacgggcaggacgactgcgtgctggtgtcggaggcgccactgggcagcgacaagggcggcgagttctccatcgacatggacaggcaggcgccggcgccggtgccggccgcggcggcggcggcggggcactgcgcggtgagcctgggcgccgcgtgcgcggggggcgggttcgtgatgagctgcaaggttgagggggaggcgcggagcagcagaccgttcgtgcagctcgccatgcgccacgtcacgtgcatggaggacgccgccatgttcgtcgcgctcgccgccgccgtcgacctcagcgtcaaggcgtgccggccgttccgacggaagcccggcaagaaggccgcctcgccgtcgcccgaccctctcgagctcgacacgtagaggcacatgcagctcaggacacactgtaaattgaccacgacgtacgtagcatccatccatggccatgggatccaaatccatctaactctgtaaattcacttgttttcaaaaactggacagcatcgcttgcaggaatcaaaactctcttgttgtttgaaaggctccgtttggatcattgcaattgaattccattctaataatcataatttagacacaaattaattaaactaatatagttgtatgtggaatatatttgtatattattgttggccacatg

SEQ ID NO: 273 - DNA, 2070 bp, Setaria italica
caaccagccaaggcaagcgagcagagctcacggggcgcgcgcaaaggcagagccgccgcgagagctaacggccagcccggcccgttggccacttggcctccgcggcgcccgtcctgccgatggcggcggctctgcagccacggcgggcgcggctcctccttttcctcgggctgctgctccacgccctggcgcgtggggccgtcgaggcggcggcgccgttccgggcgagggacgtgctgccgctgctaccgcggcggctggcgtggcagctcatgggcgccacggcgcacagcgccgtcgacctgctcccgtccttcgtcggcgccgtcgcgcccggcggggcaccggcggcctggcgtggcgcgtgcttcgcggagaacgaggccgtcctcagcctcacccccggcgccggcgccggcgcggttggccgcaacgggaccggcgggggactccacggcaacaccagctccggcctcggcggcgccgtcctccacctcaagactgcttcacctgagagctggacatgtatggatctgtatgtgtttgcaactccatacaggatagcctgggattactatatgagatcaaatgaaaatcacacctttgagattaaggcatgggaggaagcagcagaactggaatatgtaaagcagcatggcattgccgtctttctcatgccatctggaatgcttgggacgttgttatccttgattgatgtcgtacccctgttttcaaacaccggttggggtcaggatgcaaacttggcatttctccagaagcatatgggaacttcatttcagaaacgttctcagccctggtctgcgaatataagaaaagaagatgtacattcgggtgactttttggccctttcaaaaatccgaggacgatggggtggatttcagacattggagaaatgggtgaccggtgcatttgctgggcacactgcagttttcttgaaagatgagaatggcaccctctgggttgcagaatccggctatgaaaacaaaaagggtgatgaaatcattagtatgactccatgggatgaatggtggggaatggcacttaaagacgattcaaatcctcagatagcacttctgccattgcatccagatgtacgggccagattcaacgaaagtgctgcgtgggattttgccagaagcatgtacggaaaaccctatggatatcataatatgatatttagttggattgacacaatgtcagacaattatccgcctccccttgatgctaacctggtaatggctattatgtcaatgtggaccagattgcaaccacactatgcttctaacatgtggaacgaagcccttaataaacgacttgggaccgagaaattggaccttcacgggatcattacagagaccgaaagacgtggcttgtctttcaaccagctgctcaccatacccgagcgagacgactgggaatacagcgatggcaaatcgacgacgtgcgtggccttcatcctttcgatgtacaaggcggctggcgtgttcgctcctttcacggagtcgatccaggtgacagaattcactatccgggacgcgtacatgctgaaggtcttcgaggacaaccagacgcggctgccggggtggtgcaacgcggcggcggacaggctccccttctgccagatcctgggggagtacaagatggacctgccggagtacaacaccatcgagccctacgccaacatgaacgagaactgcccgtccgcgccgcccacctacagccgcccggcgcgatgctgacggccgccgtgcaaaccgtgtactaagtgtaaatagactacgcacgctgcgtgtgctgtgcggtggtctcgctgtatgtgcggctttgtccacagttcctttctctcacaagtgattgctctgtgactctgagcagagcatatagtattatgcagaggtagttctcgttcatgctggctgttgttcaggcgccgattctgtcgttcttggccgctgtaaagtaattatctggacgtacagatcatgtgaataattggaatgacgatagtactgaagagctttattttttccaacacaaaaggagctttgc

SEQ ID NO: 274 - DNA, 1738 bp, Setaria italica
ggccgccgccaccccccaccccaccccaaatcgcctgccgccgccgcccgctcagctcctgctccacgcctgcggcctcctcctccaatcctccgaacgggcgctccacggccgactcagcgcctcgacctccgatccagcggccggcagagagaggtgggagcagcgagcgcatttgcaaacaattcgactggcccaatggagcaagaagacgaatcagaaggtgctgcagcggagcaaccggcggacgaagcagaggagcagctcgccgacgatctcctcctgcacttcgagcgagtcctccactccgaccccctcattgacgaggtggggttcttgcatccgacgcagttcggctcgctaggctgcggccaagatggcgattctgcatcccaggctccggagttccagcacaggtacttctggtgcagagaccacaagcttgccatctgctctgagatcctgcccaagctctaccgcgccgcccgcgatgcgtactacaacacgagaaatgctccatcacaagcagttcatctgatgagcctcaccaaggtgctactcatactttgccctgacatgcttaccgcatggaactccaggaagatggttctgtcggagaaatatgatctcacaaagctcaaggatgagctgcaattgtgtgcgctgatcctttcctactcgccaaagaacgagagcacatggagccacaggagatgggtgttaaaacaagttgcagagcaaaaccaagatatggcacagcttgtagagaaggaatctgtactagtgaaagagatagcagagaggtcaaagatgaactaccgtgcatggaggcatcgatgctggcttattccttacatgacaagaaaacaggtgctggatgaactgaagaagtcaacaagatggagtgaactacatgttgctgacaactgctgctttcactaccgcaggtccctgcttcttgcactgctagacagttgtctagggaatggagaggattctgtcagttgggagtcagaaacttgcatgctctggaaggatgagctgaggtggaatgaaatgcttatcagacgctaccaagggagagagtccttgtggaaccaccggaggttcctttcacaatggtggattcggcagttgttttctgttgaagaaacctgcccctcaacgacatcccaggtggatctgttcatcacccaggagataggcctgctgtcagagtgcctgaatgaccctgcggatgagtttggggagtcatgcgtccaagcagagctttcagcactctacattctgtggatatcgaagcaagtcccagctgtgaaagggaagctggaagagaggctgcattctgtttccattgtggggttgaaggatgttctagtaagagcctgccgaccggagaagaggtggctgtggatgaatctgcttggcctgcctgatcgatcacagtgacgacatagcattgcttattgaaattgagggtgtctgcttcgattgcagttgtgacgaaacacaatggattgcattttgtaaccaaacaaacggcaaggagacctttttaattaagcgtttgcttcaggtcctctgtaattgcaaaccagactatacagggggttgggattgccggcgaccccccccccccccccccccccccccattacagcccaaagaggtgtagatagctgagaacaatgctgcatgttttcccttacttttgacttcactttggaggaagaaaatg

SEQ ID NO: 275 - DNA, 2713 bp, Setaria italica
cttatatccgtccacctcaccccgttgctccgagtgacgacacgcccttcgccgcttccgctgctctgcaggctcatgtccactgctggtgcggcatcatcaacggccaagctcgccggcgagctccaccgccatgtcaagtgacccctccgcgcgctcgtcgccttcctcctccgccgcgtcgcctcccaatgacgcgcggcggagagaccaagcaggacaggcgacgccgccgccagggggagaggcgatcgacaccagcggcaagagccgccggggccggcggcggcgcgtgccctggtgcccccccggcctcggcgcggcgtggccgctggacccgcgggcgaggtgggtccggcagtggaaccgcgcctacctcctggcctgcgcggcggggctcatggtggacccgctcttcctgtacaccgtgtccgtgagcggcccgctcatgtgcctcttcctcgacggctggctcgccgccgctgtcaccgcgctgcgctgcgcggtggacgccatgcacgtgtggaacatcgcgacgcagctccgcttgacgcggggcacggcggggagcaagcgcgcggaggggagctcgggcgacgaggagcagcaggcggcggcggccgcgggggaggaggaggacgacgacgaggagggcgccgacgaggtcgcgcgcaagctcccggcgggcgcgaggtccaagaaggcctcggtgctggacttgttcgtcatcctccccgtgatgcaggttgtggtgtgggttgcggcgccggcaatgatccgcgcggggctgacgacgccggtgatgacggtgctgctggtggcgttcctgctcgagtacctgcccaagatctaccacgccgtgcgcttcctccgccggatgcagggccactccggctacgtcttcggcaccatctggtggggcatcgtgctcaacctcatggcctacttcgtcgccgcccacgccgtgggcgcgtgctggtacctgctcggggtccagcgtgccagcaaatgcctcaaggagcagtgccagctccaggcggcggccggggggtgcgcgcgcagcggcgcggtggtggcctgcgcagcgccgctctactacggcggctccccctccgccgccgcggcggggcacctcggcgccggcaggctcgcgtgggcccgaaacgcgccggcccgtgccacgtgcctcgccagcagcagcggcgacggcagcggtggctaccagtacggcgcgtacaagtggacggtgatgctggtggcgaacccgagccgggtggagcggatgctgctccccatcttctggggcctgatgacactcagcacgttcggcaatctggagagcacgacggagtggctggagatcgtgttcaacatcctgaccatcacgggcggtctgatcctcgtcaccatgctcatcggcaacatcaaggtgttcctgaacgcgaccacctccaagaagcaggcgatgcacacgcggctccgcgccgtggagtggtggatgcgtcgcaagggcctgccccgcgggttccggcaccgtgtgcgccagttcgagcggcagcgctgggctgccacccgcggcgtcgacgagtgccagatcgtgcgcgacctccccgagggcctccgccgggacatcaagtaccacctgtgcctcgacctcgtccggcaggtcccgctcttccagcacatggacgacctcgtcctggagaacatctgcgacagggtcaagtccctcatcttccccaagggggagacgatcgtgagggagggcgacgtggtgcggcggatgctgttcatcgtgcgtggccacctggcgtgcagccaggcgctgcggaacggcgcgacgagcagctgcacgctggggcccggcaacttcagcggcgacgagctgctgtcgtggtgcctgcgccggccgttccgggaccggctgccgacggcgtcggcgacgctggtgacgctggagagcacggaggcgttcgggctcgacgccgccgacgtcaagtacgtgacgcagcacttccggtacaccttcgccaacgaaaaggtgcggcgcagcgccaggtactactcgcccgggtggcgcacctgggctgccgtcgccgtgcagctggcgtggaggaggtacaagcaccgcaagacgctcgcgtcgctctccttcatccgcccgcggaggccgctgtcgaggtgctcctcgctcggggaggagaagctacggctctacaccgccatcctcacctcgcccaagcccaaccaagacgacgacttctaggcttctagcctctaggccggtcgaggctggatggctggctggctggcttcatcatgcaaattagtacacgacattgatgcccgatgccctctgctggtgggcggggttgtacagtaatatggttggacggtccaagcatgttccgatcatcacggaattcctcggcagagagaaatattggctagtaccccctcatttcaatttttctagatacatagtcttagacatgaacctagatatatattatatctagatacatagcaaaaattataaattaaaaaatcaaaaatcaaaatgaatagtaatttaggacggaggaagtacctgtgaacctcaattcatcacagtccctcggtcccttttggtaggatcagccctgtccgcgctcgatctctttccctgtgaatacatgcatatcatctagggatgaacaaaacattactatag

SEQ ID NO: 276 - DNA, 2140 bp, Setaria italica
cccagtcccgccccgccgcccggacgccctgcacaaaaggggggccgaggacgcgcgcccactcgatgtcccgcacggcaccgccaccgcttctccaccaccggccccgcgcacgcacgtacgcgccccgtgccgggctttctcatcctttccacgctgtcgcgggcgccttctctctctctcccccctcccctgctccgttcccccttccggcgttcacaccgcctgctcagcctcgcgtcttacaagaggcgtaggcgcgtagcctccgatcccctgagaagcggaacggcacgcgcgcgctgttgccccgatcccctgagagagggcggcggcgcgagagctgctcgcgtcggcgactcgagccgccggcgtttgcgaagttgctgcagctgcagcttgcgcccgggtgcgtgggacatgagctgcttcggctggttcaagcggcggtcgaggagcgtcggcgggtcggcggggaagcgtggggcgtcggcgccgccgtcgggcccggcgaccacgacgacggtgtcgggggtgagcacgagccggtcggacgactccggtgcggtgcggccggtgagcaagtcggcggggtcggccgcctcgtcgcagtcgcagcggagcatctcgtcgctgtacgaggagcggggccacggccagctgcgggtgttcgactacgaggagctcgaggccgccacggccgagttcagccgcgcgcagaagctcggcgagggcggcttcggcagcgtgtacaagggcttcgtccgcgccgccgacggaaagggggaccgcatccccgtcgcagtcaagaagctcaaccagcgcggcctgcagggacataagcaatggttggcagaagtacagtttcttggtgttctggagcacccaaatcttgtaaagctacttggatattgcgctgttgatagtgaaagagggccacaaagattgttggtgtacgagtttatgccgaacaagagcttggaagaccatttgttcaggcgagctaatcctcctctgtcgtggaacggaaggcttcaggttatcctgggtgctgcagaaggattggcttaccttcatgaaggcgtagaagttcaggtaatctaccgggacttcaagacctcgaacattttactggacaaggacttcagagcaaagctgtcagacttcgggctagccagggagggaccaactggagcaaacactcacgtctcaaccgcggtcgtcgggacgcacgggtacgcggcgccggagtacatcgattcggggcacctgacggcgaagagcgacgtgtggagcttcggcgtggtgctgtacgagatcctgacggggcggcggtcgctggaccggaacaagccggtggcggagcagaagttgctggagtgggtggcccagttcccgccggacagccgcaacttccggatgatcatggaccccaggctccgcggcgagtactcggtgaaggccgcgcgggagatcgccaagctggccgacagctgcctgctcaagaacgccaaggagcggcccaccatgagcgaggtggtcgaggtgctcaggcgggccgtgcaggcggccgagccggatggccgggcacccggtgccggcgccgtcaaggggaagagagccgacgcggccgcgccgtccaggaggtgattgctacagagtcgtcggcgcgcgaaggctctggttggcagagccaaagttagacagggaggggagactgatatgctgtcatcggacgtgacagcacagcacacaaaagagtgttagttttggggtgtatggtgtgggttagtggcggggggcttacaaatattttttgggcacattacttagataacttgtgtacatagagacggctttggcggattgaagttttcctttccctttcgaaagtgagaattttgaaagaattttgcactggctctaagaaatagattcgcactcaagttgttctcttgtatactgactgactgagttgtgacaatcaggttaaaaagtcgagcacatcccatatcaaatgcactttctctgagttgatttgaatgtaccagcaactgatggcctctgatctccatcttgtaacgttgcgagctgtgctttccaatctaatcacagacgacgacgacgaggaatagacagc

SEQ ID NO: 277 - DNA, 1612 bp, Setaria italica
tctcctcgctttccctccaaacagtctctctctttctctctcgtgcgcgacaaggcgtcctcgggcggcgtgagggcgcgatggcgagtggctgcggcgggcggcgggggcggaagccgagggcgagggcgcggggcaaggggaagaagaccaggtacctcagcctcagcgatgtcctgattaaggtggaggcggaggcggggacgccgccgcggtcgcaggaggatgagcccgcgccggtgtgggaggaggcggaggtgaagcaggaggacgccggggatggaggcggccagcagcagccgccgcagcaggtggagccgttcgcgctgcacaacgaggcatccaccctgttcgcggcgctgccggcgccgtcgctctccgacatcctcggcgcctccgctggcggcggcgacggcgacgagtcgccctcgccgtccgcgtcgccggacgggggttccggggggtcggagttgccgtgcgcccaagaggaggacctggcgcggcgcgcgctaaggggcagggagcgttgggtgtactgcagcagcggctcctcgccgacggccaccaccgccaccacgtcgtcgtcgtcgccgtgctcctccgcggcgagcacgggcgcctcggtgcggtcgctgctgctcaagctggactacggggagatcctcgccgcatgggcggaccgggggtcgctctacatcggcggcggcggcggaggcgcggacagcgacgccgcgccggagctggagctcaacgccgtgttggtggaggtggagccgcctgagcatgccgcgagtgcgccgccaccgccggcgccggcggcgttcgcgtggaccgcggcggagacggaggcggcggggcgcgagagggcggagaaggtgaggcgatacaaggagaagcggcggaaccggctgttcgcgaagcggatccggtacgaggttcgccgggtcaatgccgtcaagcggccgcggttcaagggccgtttcataaaggaacatgaggatatcaagctccagcccacatagcccccctggcttcttccatcaccacaaggatagcccgtgtatatacggttagttgccttgttgtcttatcccagttattctgtatcctctaccctgggcaagttgcaagcttcaggtgtagatcagtagaggcaaagtcatatttcgtaggatgaaaataacagaacttaaaagattgacccatgaggtcagtgatccaaggcgatctgttcgtcgtttcttgatctatcgtttggattactcgtttgcaaactgtgaacaagggcaatgttcagttggctacaattagactttcctctcaggaagggtttgagaatttgatgtctgagccatctgattagaacaaaaatggtctgtgtttctcatatcgatatcacagcatacgggtacttagcacccagattaaatggtttataccaacagtcgctgaatcatgtagtgtcttgcaaaatactggtgcctgttaccgctgggtattttctagagctacttctggttttgcatgaagagtctgttcatcgttgcatcttgcatttccaaaggatcaggctatcagttctgatttgtcgaaaatgacaagtgaaattctg

SEQ ID NO: 278 - DNA, 2094 bp, Gossypium raimondii
gggatttaggagccgctgacccgtaatccgcggctgtatcccgagttactgagctggtccagttgtgagtcgtaacgactgaccacgactttaatttacccgctaaacgggttccccttttcccagtgagtcaaactcgaaagccagggttttacactctaatttatcagcatctttctcccccgccgcccatctttttttatttccctctgtttatcttctcatttcttcactgtgtatagagaataagctaaaaagcaaatcaaaccatcttccaccattctttgttgaacatatggctggaggggagcagaaaaagggtggaggggagcagaaaaaggctggcggtggagggaaaaagaaggaagtgaagaaggaaactggtttgggtctctcctttaccaaggatgagaattttggtgaatggtactctgaggttgttgtcaatggtgaaatgattgagtactatgacatttctggatgttatattcttaggccatgggcaatgtcaatatgggagaacatgcaaacgttcttcgatgcggaaatcaagaaaatgaaagtcaagaattgttatttccctctttttgtatctccgggtgttttgcaaaaggagaaggatcacatagagggttttgctcccgaggttgcttgggtgacaaaatctggtgagtctgatttggaggtgccaattgctatccgcccaactagtgagacagttatgtatccctactattctaagtggataagaggacaccgtgacttgcctttgaagcttaaccagtggtgcaatgttgttcgatgggagtttagcaaccccacaccatttatcaggagtcgtgaatttctatggcaggaagggcatactgccttcgcaaccaaggaagaggcagacactgaggttcttcaaatattggagctataccgacgtatatatgaagaattcttggcaattcctgttacgaaaggcaggaagagtgaactggagaagtttgctggtggactttacacaaccagcgttgaggcatttattccaaacactggccgtggtattcaaggtgcaacctcccattgtttgggccaaaacttcgcaaaaatgtttgagataaactttgaaaatgaaaagggggaaaagtctatggtctggcagaattcctgggcatatagcactcgaacgattggggtaatggtgatggttcatggggataacaaaggcttagtgctgcctccaaaagtagcagctttgcaagttattgtgattcctgtgccttacaaagatgcagatactcaaggtatctttgatgcctgtgctgccactgtggcaatcctctctgatgctggtattcgtgctgaagctgatcttagagagaactactcacctggttggaagtactcaaactgggaaatgaaaggtgttccactaaggattgaaataggacctcgagacttggcaaataatcaggtgcgtgcagttcgccgtgacaatggagaaaagactgatatctctagagtctttttggttgaacaagtaaaaggaatgttggaaaagattcaacagaacctatttgatgtggcaaaacaaaaaagagatgcctgcattgaagttgtaaaaacttgggatgagtttataaaagctctcgggcaaaagaaactgatcttagctccttggtgtgatgaggaggaggtggagaaagatgttaaagctcgaacaaagggtgagatgggagcagctaagtctctatgtaccccatttgaacagcctgaacttccagaaggtactaaatgctttgcttctgggaagcctgcaacaaagtggacctattggggcagaagttactaggtttattcactttttaaaaccatctccttttcatggttctttgcctgatgtcaacggttctggtcattggggccattgtaaacggggaaattttcaatttaaaattgttatatgaaactgatgagaggattcagtttttaatcatgttaaaacttctgtgatctttctttttcctttttgtctgaattttgctttgctataatagatatactgtgttttatctgatgtttattacaatttgcatacttagaata

SEQ ID NO: 279 - DNA, 3045 bp, Gossypium raimondii
cttcaatcttcccggtacaatcatcatcatcttcttaacacattaatttctttcattccaaaacaaaacaaagcatactttcctatcatttaactctaaaaagttaaagtctttctctttctgagtcagctcaggtctttaggttgggaatttgatagtcatggatggttggctgaagggatctaatagttttgtggatagggtaggactaaatgacggtacggtcttagctttatccggtcgggatttcgataaccggtttaagaatgagaaatgtgtcgatattccttcttcggaacctgttatgattccgggaaattcagggaacgtagtgtcttccttgggaacttgttctgatagagttggactaaatgatggtacagtgttggccttatccggtcgggattttgctagccagtttaagaatgagaattatgttgatgttcttcctttggaacatgttatggttccgggaaatttagtgccttcctttggaacctgttctgatatagtaggactaaatgttgatagccaacctgttccgattccgggaaattcagtgccttcctcgagtgtgaacgagggagatttgcatgaggattttgacttcagcgatgaagttcttaagtacataagtcagatgcttatggaagaagatatggaagataagacttgtatgtttaaagagtcatcggcagcacttcaggctgccgagaaagcattttatgaggttctcggagagaggtatccaccttctcctgaatatgatggtgatcaaaaccaagaaagctccgatgaaagtcatggtcaaaattgttggagatgtagtagtgcaagcattagtagtggtagcgtagttgatcccgggcacaaccacgatttcagtgagcaaagggctctgaacttcccatcccaggctagttcatctcatagctcgggaaacagtactggtagtgtggtagatggatatgcagattctccggtaagtactgttaggcttcctgaaatatttaacaatagtgagtctgccatacaatttagaaaaggcttcgaggaagcgagtaagttcctcccgaatggtggaagcttgtttgttcacggggagaatgacggattgtttctcaaagagctaaaggaagagactaaagatgtggcagtagataaggtggagaaggatgagatttcccaggatggatcaaggggaaagaaaaatccttatcctgaggatctgagtctagagtgtgggaggagtaccaagcaatctttagtttatactgagtctgctgtaagccctgaaatgtttgatatggtgctactaaattgtcaaagtgtaaccgagcttcaaaaagttttgcaagatgaaacgagcaagaatgtgcaacagaacggacaattgaaagggtctaatggtggaaaggcacgtgggaagaaacatggtggtaaaaggaacatggtggatttgagaactctcttaaccctttgtgcacaagccgttgcagctgatgatcggaggagtgctaatgagctaatcaagcaaatcaggcagcattcttcacctatgggtgatgggatgcagaggatagctcactatttcattgatggcctagaggcacgcttagctggttccgggacccaaatttacactgcgcttatcacaaagccgacttcagctgctgatgtgttgaaagcccaccatctgtttcttgctgcttgtccttttaagaagctctcaaatttcttctcgaataagactataatgaatctagctgaaaatgctgctaggcttcatattattgattttggtattctatatggtttccaatggccttgccttatacgacgtctctcgtctagacctggtggaccgcctaagttaaggattacagggattgatcttccacaaccgggttttcggccggcagaaagggtggaagagacagggcgccgtcttgcaaactatgcggaaacattcaaagttccgtttgagttccatgctattgctcagaagtgggacaccattcaaattgaggaccttgggattgatcgtgatgaagtacttgttgtgaactgtatgtacaggcttagaaatctactagatgagaccgtgattgtggagagtccaaggaataaggttcttaacttgatcaggaagatgaatcctgatgttttcatactggggattgtgaatggtgcttatagtgctccgttctttatcacgagatttagagaggctctcttccacttttctactttattcgatatgctcgagactaatgtccctcgcgaaattccggaacggatgctgattgaaagagagatatttggatgggaggcaatgaatgtcattgcatgcgagggtgctgaaaggattgagaggcctgagacttacaagcagtggcagatgaggaacatgagggccggtctcagacagttgcctctgaataaggagatcatgaagatagcaaaggagagggtagatacaggctaccataaggactttgtaatcgatgaggataatcgctggttgctccaaggatggaaaggacgaattgtttatgcactctcaacttgggttcctgccccttagaaggtaaagtcttgcgaagtactttatggtcggattgcaaccattgatggattcacatatatggagacaagtttcccaacaggttacataaataagaaaccgggggctgcttactggtatttatcgaaaaggtgaatccatcatgtaccgaattgctaacatgtaccagagaataatatcggtggtaagatgtattagatcgaagttagcagtttaggtgaacgttaagtaggtctgaccgtcttgagtttcttgttgtattggctatacgaggtaatgttaagtaggtctgaccatctgagtttcaaatcccgacatcattatcctcttattctcatattcaaatgcaatgaagttcattaatgtattttcttttaaagctataagtacttacaaatatcaaaaaaatgaaaaaacaaataaaaatctccgttgttgctttctgcagaagtgtcttc

SEQ ID NO: 280 - DNA, 2120 bp, Zea mays
acccaacccgcctccaactccaaagccgtcatggcggcgccgtccccgaccactaccgccgccgccgccgccgccgccacgacccaccaccgcgtgctcctcccatccgcgcgcccccgcgccgcgccctcttctctccgcctcccgctccgcgcgcagccccacgcccacgcccacgcccagcgcgcgcgcctcgccgcccccgtcgcggccgcggccccggccccggcggcgtcgacggcctcccccgagtcccccgcgtcgggcgccgtcgcggggaagcccacggtgctcgtggccgagaagctcggcgccgcggggctcgcgctgctgcgggagttcgccaacgtcgactgctcctacggcctctcccccgaggacctccgcgccaagatctcgctctgcgacgcgctcatcgtcaggtccgggaccaaggtcggccgcgacgtcttcgaggcgtccgggggcaggctccgcgtcgtcggccgcgccggcgtcgggatcgacaacgtcgacctcgccgccgccaccgagcacggctgcctcgtcgtcaacgcgcccaccgccaacaccgtcgccgctgccgagcatggcatcgcgctgctcaccgccatggccaggaacatcgcgcaggccgacgcgtcactcaaggctggtaaatggcagcgcaacaagtatgttggtgtatctcttgtgggaaaaactctcgctattctcggatttggaaaggtcggatctgaagttgctcgtcgtgctaaaggcttaggaatgcatgtgattgcacatgatccatatgcttctgctgaccgggctcgtgcaatcggggttgaactagttagcatggaggaggccatgacaactgctgactttatctcgttacacatgcctcttacgcctgcaacggacaagatgctcaatgatgaggccttcgctaagatgaagaagggtgttcgcattataaatgttgcacgtggtggcgtaattgatgaagaagctctagtcagggcacttgattcaggggtagtagcacaggctgctcttgatgttttcactaaagaacccccagcagctgacaacaagttggtactgcacgagaatgttactgtcacacctcaccttggtgccagcacagtggaggcacaggaaggggtggctattgagatagctgaagctgtcattggagctctgaaaggggagcttgcagcttctgcagtgaacgcgccgatggttcctgctgaggtgctgtcagagcttgcaccttttgttgtgctcgcagaaaagcttgggcgcttggctgtgcaactagttgctggtggtggtggtatcaagtctgtgaaagtgacctatgcatctgcgcgggcccctgatgatcttgacacgagacttctccgtgcaatgatcaccaagggattgattgaaccaatctccagcgtttttgtcaatctggtaaatgccgacttcaccgcaaagcagaggggagttcgcatcacggaggagaggatcctgctggacggctcacctgaaacacctatcgattacattcaagttcagattgccaatgtcgagtccaaatttcccagtgcgatatctgagactggagaaatcactgtggagggcagagtgaaggatggtgttcctcatctaacaaaggttggagcattccaggtggatgtgagcttggaaggaagcctcatcctctgcaggcaggttgatcaaccgggtatgattgggtcagttggaagcgtcttgggtgaggagaacgttaatgtcagtttcatgagtgtcggaagaattgctcctcgcaagcatgctgtcatggcaattggtgttgatgaggaaccaagcaagggcacactgacgaagatcggggagattccagcgatcgaagagtttgttttcctcaagctctaggcgcgaatgtatgtttgaagttgcaagcatggtgtgcaattttgatgtagctagcaatccggaggacggatggttctccttgaaataagcttttaggagtatttttgtagtggcgctcttgaatatggtctggtatcgatgcctacttttgaacggggtgtttattaataaaaacttatatatcaatgcttggctcattggttgattca

SEQ ID NO: 281 - DNA, 1540 bp, Solanum tuberosum
gctccgccattgcagctattagttttctctgttttcctccgccaccattaacagtaacaccgccgactgaatcgcctcgctcctccattaactcgttctctgtaactcaacaatgagctgttcatcttctttgattcttccttccatttcttcgaatggatttcgaagatttagtccattgaaattggataagtctagggttttcatgagtagcatttccgttggatcacgaattgccgccgtcgatgatgctctgttcactgattacaagcctaccaatgcttttctcttccctggacagggggcacaagctgttggaatgggtgcagaggctcagaaggtgcctgctgcagctgaattatacaagagagcaaatgaaatcatggggtttgaccttttggatatttgtattaatggtccaaaagagaagttagactccactgttctaagccagccagctatctatgtcactagcttagctgcggtagagatactccgtgctcgtgaggggggtcaacaaataattgattcggttgatgtcacatgtggtctgagcttgggcgaatacactgctctggcatttacaggagctttcagttttgaggatgggcttaagctggttaagcttagaggagaagctatgcaggatgctgctgatgctgcaaaaagtgcaatggttagtataattggactggattctgacaaggttcagaaactgtgtgatgcagctaatgaggaagttgatgaagccaacaaagttcagattgcaaatttcttatgccccggaaattatgcagtctctggaggtgttaaaggaattgaagcagtagaagcaaaagcaaaatcattcaaagcacgaatgacggtacgtctagctgttgctggagctttccacacaagttttatgaatccagctgtctcaagattagaagctgctttgggtgcaacggagatcagaactcccagaataccagtaatatcaaatgttgacgcgcaaccacatgcagatccagatacaattaagaaaatattagctagccaggtgacttcaccagttcaatgggagaccacaatgaaaactctcctatcaaaagggctaaagaagagctacgaattaggacctggaaaggttattgccggtattgtcaagaggatggacagaggtgctgaaattgagaacattggcgcctaagctttgtattgagagacatcatcggtggttattctttgagtgagttcaagcttaagtttttgaatgttaacgtcattatgatctttgttcaagtagcataatgaactcggattaaaatataactttctgaatctcagtagatattaatgtgatgaaaccacacacactatcagtacttatggtttggtttctgatagtttcactttcactaaatgtgaaaatgggcagagaaataagctcagcagaccatgagatagtgttgccttttccagcgattgtgctttcttgttgatgactaatatcatgtttggttgttttgtcacttcaatgataccaaatatttggtct

SEQ ID NO: 282 - DNA, 1430 bp, Oryza sativa
gtgcgtcgcggcctccgctacccgacgacgccgccgcggcccgcgtcgtctccttggctcgccgcctgcgccgtcgtcgcgccggtctccgtcgccgggcgccctgctgcttccatcgcatactctcgcctctgaccccgagtccatctccccgtcccggcgtcgcctcggcctcgactcccgtctcctcgaggagttcgccccgtcgcctgcggccgatctccatccatcccgcgagcggcggtgcggtgttcctgctgcttccgcctccgggcgggagagggaggagcgggtgaccatggtgagcatggaggtcaccgatgagatgttcaagtgcatggaggttgggctggccttccgggactataatggaagaatcagttctatggatttccacagcaaggctacaaattacctcgtgacagcatgtgatgatgaatcaattcgcctatatgacattcaaaatgctgtgtgtttgaagacgattaatagcaaaaaatatggggttgagcttgtgtgcttcactgaaaacccaacttatgtcttgcattcttcaaaaaatggatgggatgattctctccgtctactctcactggtcaataactgttttttgagatatttcaaaggccatctagacagggttgtttctatctcattgtgctctgagaacgggaacattctctctggttcacttgatcgaacagttctcctatgggattcaagggttgaaaaagcacagggtttgctgcgtgttcaggggaggcctgcagtttcttatgatgatcagggtttggtttttgcaattgcatatggtggctacataaggatgtttgatgctcgaaattttgagaaggggccttttgatattttctctgtcggtaatgatgattcagaagccaatgtcataaagttcagcagtgatggcaggcggcttcttttaaccaccaaagctgggcgtgttcatgtgctagattcatttcatggcaataatatagcaacatacaatgtgaagccagtggtaagcaattcgacgctggaagcatcattcagccctgatggaaaccatataatatctggctctggtgatggcagtgtatatgcttggaatgttaggagtggaaaggttgctcgctggggaagcacagatagtgagccaccgctaattagatgggctccaggatctttgatgttcttgactgcatcttcggaactgtcttgttgggtccctgatctatctaagctgggatcctttactgttagtaagtaattcgaatggtacgagttgttgtttgtgtatgctcaggcctttgttctagctgtttgcaaaatgacaatgttaggtaaaaatctgagctgcagtgggtcaagcctcgggtcaacctagtccgggccatctgcatatcttgatcttgccaaattttggctttacc

SEQ ID NO: 283 - DNA, 3333 bp, Oryza sativa
ctaccaccttctccttctcctcaacctaaaccccccaaacctctctcctcccaccaagacgaactcgaagccgcgtggaggagagagagagaaaggggaggaccggaggaggactcctcgtctacattgcggtctccggcggcggcggcggggttgccgccatctcgctctttagcctgtagcggcggcggcgcgggggagatggagagcgtggcggcggcggcgcggtcgctgcgtgccggggtggagaagtcgcgggcgctggggcaggcgctggcgcgggcggggccgcgggtggaggagatccagctcgcgctgccggcgctggaggccgccgtgcgcccgatccgtgcgccgcgggccgagctggccgcggcggggccccacatcgaccgcgccgtcggccccgccgcggccgtgctcaaggtgttcgacgccgtgcacggcctcgagccgccgctcctcgccgcgggcgccgtcgccggggacctcgcgggttacctcgccgtgctcggccgcctcgaggaggccctcaggttcctctccgataactccggcctcgccgcgcagtggcttgcggacatcgtcgagtacctcggcgaccatgacctcgctgacccaaggttcctcgccgacctcgccgtcaccctcgaggggctcaagaaaccttccggtgacctcgacggtggcctcctggcggccgctctggacatgctcgaggcagagttccgccgccttctcgccgaccactctgcaccgctcccgctcgcgatgcagcagctgaacacaacctctgcatctactgccgcgccgtctctcatcccggccgcgaccgttcacaagctcagcctgattcttgaccgcctcattgccaatggcaggcaggaccgttgtttgtccgtgtatgctgatgcccgcggaggcgtggtgagtgccagcctccgtgcccttggcctcgattacttgcgaaacccggtcgacgtcgcgcaggcgttgggccctggagttgagttgtgggggcggcatttggagtttgtggtgcgctgccttcttgagtccgagcgacagctctgcaacaaggtgtttgggcagcgcaaggatgacgcatcagcgtgcttcgctgatgttgcagcgcacgccggcattcttgatttcttgagctttggtcgtgcggctgctgatgcgaagaaggaccccattaagctcctgcgtttgctggaggtgtttgattctttgaataagctaaggttggacttcaaccggttgtttggtggaaagaaggcgtgtgtagagattcagaaccaaacaagggaccttgtgaagttgttagtggatggtgctgttgagatctttgaggagttgcttgtgcaggtggagctgcagcggcacatgcctcccccacctgatgggggtgtgccgcgactagttagctttgtggttgagtactgcaatcgcctccttagtgagaagtacaggcctgtgcttgcgcaagttctcaccatccatcgcagttggcgcaaagagacattcagtgacaagatgcttgttaacgctgtgcttaacatcgtcaaggcccttgaagctaattttgatgtctggtcaaaggcatatgacaatgtgacactgtcatatctcttcatgatgaacacacactggcatttctttaagaacttgaaggctactaggttaggcgagcttttgggtgatgcgtggctgcaagagcatgaacagtttaaggactactatctgacggtgtttatgagggatagttggggggtggtttcaccgctgctcaaccgggaggggctaatcttgttctccaagggccgggccacggcaaaggacctggtgaagcagcgccttaaaacattcaatgcgagctttgatgagatgttccgtaaacaatctgcatgggttataccagagaaggacttgagggagaagacatgtggtcttgtggttcaggcaattgttcctgcttaccggagttatatgcagaactatgggccactggtggagcaggatgttagtgctagcaagtatgtaaagtacacagttgatggtttggagaagatgctcagtgcgctcttcattccccggcccaggagggctgggagcttccaaatcaggcacacaaatgacaagattaccagtgcgatgacaggcttttatcggagtgcttctacagtgaaatagctttggttgaagaaccaaatggttggttctactatttatgcaataatgggatatgtaacaatgattcattttcggccagtcagcaaattgctccacactggacgtgaggcccaatagtgaacctgtgatgagaatattggtggcatatgaacataggctcttctatagttctcatggtgaaggtgaacagaagatggtgggggacaatgtgcgtaattgggacatttcctacttatcaaatgtcttcccttctgttattatgttattgtccctatcaccataaccatacatatagaaacttctgtggggacatgttgatatttaatcagctgtgtagtgtatgtaaaaattggtttcattttaggtgggctgtagacatttattttatatgttcaatgtgctacaaactgagcttcgatatgcaatgtattatatgaaaagctagagtttgaagaatcactggcagcttactggttcatatcggtccctggatttctcagtgtgcagaagttctgtgagatggcaaaacggagcatatatacacctgaacatactctagttacatgatagttatgcaatctgagagccctatcgcaatactttttttcccctgatgttactgtaaaataattgaagaggccagaatgccgcacttctcctgttcttgctgaaaattgacttgttccagccaagtcagatatgggggtgttaggttcaattgccaaagcaagcaataacttgtactatgatctggtatgatttgttagtactggggttgtatctatgtcagttcagaatgaattgaagatcctatggagtctgcatcttcggcatgctgatgagttattaagcccctgcagtttgtgtttcctccaactactgatcaaggacataagggaaacctgtccctcatcctgaaaaataacaaggaaggtttaatgggctgcaataccgcagaaagttgggcccaaggcacgtcagctccaatccaggccgtatatcctaaggtccatcacaactaagaaaagcccatcatccaatgtgggcccatcttcataagcaagtgaagtgaattccattctacttatttaatgcaaccaattctactactatgtgatatataaactatgtgatata

SEQ ID NO: 284 - DNA, 2108 bp, Sorghum bicolor
atggagctgcactttgacctatttgcccttgacgctttggatgcccacgcccaagaaattaattgcggcatgtgcaggtaaaaaaaatgtacacatgtggggatttgaactctgtccacaaggcttaaaacacaaccacctaactagtgaagccataaacacctatttaataagggcaaatatggaagaatatccgctaaataatgactctttggtaagcacaatgatgttctaaacgacaactaatatggttatagagggagtatatattgagtctagacttgacagtggtctatggagctatactaatgtgtgtgaaaaacataccggaagttgcgaatcctagtgctactgcatgcatgcttctatgtacgaaggatgcgggggaaaaaagtaggaagcaacatttggctgatttgatttcttgaggaggtggacaaagtatttagcttttatatgtgttgtggagaagttgacaaagtattgatttgtactatgtatgtaccaagacaagaaagtaggaagcagtttgatggtgtggatcggaactgtggatgaagcgtgcgtgtgaagtggtggactagtgtgttacaatagattaatttgtggataacacgtcaagaagcaccgttaattataataacaatatttcttgggtgctttgagggcttgtttagttcacccaaaaatctaattttttttcaagattcttcgtcatattgaatgttacggcacatgcatggagcactaaatatagatgaaaataaaaactaattatatagtttgtctgtaaattgcaatatgaattttttaagtctagttacgaacaatgcttgtcaaataaaaacgaaagtgttacgatgttgtttcgcctaaaaaaaatttgaacgaagagtcggcagaggtaggtaggaatagcaagacgcctggtctggtcggcgcgtgagctccgtcctgcgcctgagacagggtggagtgcaggtgcaggtgcaggtgcaggtgcagtgtcccgtcccgtattgcgggttccggagtcggaaggttgcgggttccggaagttccggcagaagaagcgtgtccgtgtccgtgcggtgtgcctataaaaggcacctgcctgcctctgcctcctccctctgccctctgccttgtgccttgtttatctatacacccaatccaatccaatccaatcctcgagttggtccaagtccaacccaaccaccgtcgtctcgtctgtcctcgtcgcgtaattcagggagctggcggcgtctactgcttctaagctggagagagctgcaccagtgcgcggcgccaccgccggagagggcgacgagataggcatcgatccggggaacgagactccggagcagcgcaacaagttcctcgtcctccgcctctacgaggcgctcaacgcccgggaccacgccgccgtgcagtcgctcctcgcccccgacctcgagtggtggttccatggcccgcccaagcaccagcacatgatgcgcctcctcaccggcggcggcggcagctctggaggcttccgcttcgtcccgcgctccgtcgacgcgctcgtcgcccccacccccaccacctccaccaccgtcatcgccgagggccacgaggggcggtgctactgggtgcacgcctggaccgtgggcgccgatggggtgatcacccagctccgcgagtacttcaacaccgacctcaccgtcacacgcctcgccgccgtcgccgtcgccgcctccgccaagtgcgtgtggcagagccgccgccccgacagcgccaccaactcgctgccgggcctcctcctcgccctctgatctccaatccatatcagatcagatcagatcagatccatcacccaaagtcgtcgtcgtcgtcgtatattattggagtattttggtttgcgcctttttctttttctttcactttaatttcgtcctactatatactagtgagtcgtgagtatccatccacctacgtattgtacgccgccgtcgatctatggccacgtcgacgcgttgcttctcgtgtcctcctgctttgttctactgcaacctactactagtattgttctactccaataaaacattatcatcactattgtgttctgt

SEQ ID NO: 285 - DNA, 1505 bp, Sorghum bicolor
cggagatactcattcgaggcaaccacctatccgattcccggagcccctccccggactcatctcgacgcggtagcgccacgccggcgtcgccgcgatgctcctcctcccggggcgtccagtcctcccctctccggcgctgccatactgcccctcgccgtctccatcccgtttccgtcccctcccctgcaccagcaacgcccccacctctgcttccaccgccgcgtccgccgacgccaccgcctcctcgtccttctccgtcgaagaatacctcgtgaacaggtgcaacctctaccccaacgtggccgcgcgcgtggctccggagctctccgccatcaggtctccctcgaagcccgacgccgtgcttgccttcctcgccgacgcgctcgagctctccccgccgctcattgccgtcgcagtggcccgcgacccgacgatactcacctgcagcgtgccaaggacgctcgcgccgcgcgcggacgagctccgcgcgctcgggttcaccacgtaccagatgggccttatcgtcgtgcgctgcggcgcggccgcgttccgctcacgcgcgctcgtctccagtgtccagttctggctcccgtacctgcgtggtcgcgtcgacaagctcgtcgccgcgctcaagggcaacccgggcctcctcaccgccgatctccggacggtcaagtctaccatcgcgctgctccaagaggaaggcaccctcaccgatggcgacgtcggctggttcgccctctcctactgctccaagctgcttgtcgcgagcccggacgaggtcgacaccgtcctggcccgcgccgacgagttcggcgtgccgcgtaagacgcgggcgttcaaggacgccatcatcgcggcgttcagcgccactccggagcggctcgcctggaaggccgcgttcttcagggacaagctcgggtggacggaggcgcaggtgaagacggcggctgcgaagatgccgacgctgatgacggtctccgcggagcggatccggaggaactgggagttcctgaccacggaggtcgggatggacgcggagcgcgtcgccagcttcccggcgctgctgaggtacgacctggaggggcggctcgtgccgcggttccaggtgatgagggtgctgcaggcgcggcggctgtggcgcggcagggacttcaacaacattgctgccatcacggaggaggatttcgtggccaagttcatcaggccgtttctggtccaagtcccagacctggccaagatctacgaggccgccgtcgtggagaaggaagaacagtagcggatagtgtataattagggatgaaaacggtacggatattttccgaccgtattagatctgtccgtgtccgagtccgaatattcaacatccgataccgtatccgtatccgaatacttgaatcgtatatttatgatgtcgacatccaattgtatcttatccgacatgatggacattatccgtattcgaatagaaatataaaaacaaatatgatatcagtaatatccgt

SEQ ID NO: 286 - DNA, 1689 bp, Sorghum bicolor
actcgctgccagtgacccagccaccacaacccctctcatcgccatgggaaccaagaatcttacacggaaccgccccgcttccatggcgacggcgtccaccacgctgctcctctccctcgccctcctcgccttcgcctgggcggcatcgccgtcgccggatgcggaggcgatctcccggttccaggagtacctccgcatcgacacggcgcagccggcgcccgactacgccgcggccgtggccttcctccggaaccaggcctccgaggccgggctcgaggcgcgcacgctcgagctcgtcgccgggaagcccctgcttctgctgcggtggcccgggcggcggccgtcgctcccctccgtactcctcaactcccacactgacgtcgtgccgtcggagccgagcaagtgggaccacccgcccttttccgccgccctcgatgaggcgtccggtcgcatctatgcgcgaggctcccaggacatgaagtgcgtggggatgcagtaccttgaagccatccgccgactccgttcttcaggatttattccagatcgaactattcatgtaatatttgttcctgatgaggagattggtgggcatgatggtgttgagctgtttgtttcatctaaggagttcaaagatatgaatgtggggttagtgcttgacgaagggcttccatctcctggggaggagtatcgggtgttctatgcagagcgtagcccctggtggcttaccataaaagcaaagggtgcaccagggcatggtgcaaagttgtatgatggcagtgcaatggagaatttaatgaaaagcgtggaggctatcaggagattcagaacatcgcagtttgatttagtgaagtctgggcagaaggctgaaggggatgttgtgtcagtgaattttgcatacctgaaggctggcacaccgacaccaacgggttttgtcatgaatctccaaccatctgaagcacaggtaggtcttgacatccggatgcctcctgatgttcatactgaagcactggagaggcgccttattgaagaatgggcaccttcctcacgcaacatgaccttcgagtttaaacagaggggttctgtcctggacaactttgggaagccagccttcacacctgctgacagctcgaacccatggtggccagtgcttggagaagctgttaagaaagctggcggtaaactcggtaaaccggaggtatttcctgcctctacagatgctcgctacttccggaagattggtttaccagcattcggtttctctcctatggcaaacacaccagtattgctccacgatcacaacgagttcctaagcaaagacgagtatatcaaaggaattggggtatacgagtcgatcatcagggagctggccactcacaacgatgaagccagagacgaagaatcgagggcagagctatgagatgaccttaccctcgatgcaattcttgaagctcaaatggagcactgaaatcatgtttgggcaaagctgctgattacgtgtctgctccaacggcaaaactgaaacagtgaacacgattacatgaaccttgtacattttcagtaaaattaaacactctgaataatccatactgcagctgcggtttcgccgttgcataaacctagcactatgcactgaactttttctgctaatatcctgttctgttttatgcttgtgatatttgtgtcccctgc

SEQ ID NO: 287 - DNA, 1557 bp, Sorghum bicolor
gcctcacataaacacatcaacacacaaagcacagctctctgagaagccactcgtttcctgctcgaatcaagcacagctctctgcgtttcgatcgatacagcagaaacggccacacgaatctgatcaagctaggcattagcattatcggcaatgggcgagttgatccctgggttgccggaggaggtggcgagggagtgcctcgtccgagtgggcttcgaccagctgccggtggtccgccgcatctcgcgccagtggaagtccgaggtggagtcgcctgactaccaccgccagcgccgggcggaggggctggcgcgcccggtgctcgcgctggtccaggcgcagccgacagctccaccggctgacgacgctggtccggtggcggacaagcactcgacggcagcagcagcaggctcgggaggaggcccagcgaactcgtaccggatggtgttgctggacccggtggaaggacggtgggcgccgctgccgcccctgccagggccaagcgagagcctgcccctcttctgccaggtggccgccgtggacggcgggcaggggaggaggaagcggctggtggtggtcggcggctggcacccggagacgtgggcgccgacagacgcggtgttcgtgtacgacttcctgacgggcgcgtggcggcgcggcgcgcccatgccgggcccacgccggtccttcttcgcgtgcgcggccgtcggcggcgccgtgtacgtggccggcggccacgacgacgagaagaacgcgctccggtcggcgctggcctacgacccggaggccgacgcgtgggcgcagctcccggacatggcggaggagcgcgacgagccccgcgggctctgcgtcgccggaaggttcttcctcgtcgtcggcgggtacccgacgcaggcgcagggccggttcgttggctccgcggagtgcttcgacccggcgacgtccgcctgggcgcccgtcgacgacctagtcgaggacggcgtgtgcccgaggacctgctgcgccgcgccgccagggtctggctctgagcgcatgtacatgctaagtcgcgatgggcacctcgtggcgcgcgacggcggcgcggcgtggcgaccggtggcgcaggtgcccgaggacgcgcgcaccgcggcgaccgtctccgtcatcccggacgaccgcgtcgtggtcattgggtccgggtgccacggcggggatcagaccgtgtacgtgctccgcgaggaggccgggaaaggcgcgtcctggacgcgcgccgccgcaccgccggagttttccgggcacgtgcaggcctcctgcttccttgaaatctgaggtggaatgtacatgtacgtacatagtagacactacgtacttctgccactactactcatggctgtacatagcaaatcaagcagaggagcagtagtaggatctgtactgcaccgcactgtactagtgaagcatcaatggcagctctggatgccttcgttcgatcgcattttgttcggtccgatttgcaacttgggacgagctagaaactactactacctgataaggagataagtggtaccagtttcttgt

SEQ ID NO: 288 - DNA, 2236 bp, Sorghum bicolor
gaaagctgtaagcgaaaggtttctgtcggctgctgaaaagttgattcatcagtcaatttccaaggtggttctgcatacgcagtatcttttgcagtaatcttgatctgcgagcggccagaactggatgatggctacttattactcgagccagggcagtgaaagggactcacagaacatgtattctagagaacccagcaatgcatcctatcctatgtcgtcggctctagggaacttgctttatctgaacaatcctgcttctggaccatacacagagttcagtggcattctacagtcccagcagaattgcatggagatgcctgaacctggccatccttcagtgatgtcccaagactcatctgcaagggagtccgacatgcttggttcccaccagggtcagcgctctttcggcctagtcaaagatatgaagaacgagatgttgatgcatatgatggatgggtcacagagcagtacagctgatctcatccatgatgatgcccaaaatggtatccagcttgattttggtgttctgaacaaccacggctcgtcgaacattccctcagtgcaaggccaaggtttatctctcagcctcaacacacaaatcctggcaccttccttgccatactggtctgtcaaaccagatatgttgtcgccacactcttaccatgacagtcttcgagtcgatgacatccgaatgaagagtatgcagtctgagtcctcacgagcaatccggaactcaaggtatctgaaagcagcacaagagctgcttgatgaagttgtgaacgtttggaagaacattaagcagaaagcccagaaagaacaggtagaagcaggaaagacggatggcaaagagaccgagggagggccgaaaagtgagggtgtgtcctctaatccgcaggaatctggtgccaatgcagcaccggagctttctactgctgagaagcaagagcttcagaacaagatggcaaagctgatggcaatgttggatgaggtggaccggaaatacaagcactactaccatcaaatgcagagtgttgtttcgtcttttgatatggtagctgggcctggagctgccaagccttacactgcagttgctctccagacaatctcacgacacttccggtgcctgaaggatgctatcaatgatcagatcaatgtcatcaggaagaagctcggggaggaggaaagttcatctggcaaggagggcaaactaactcgtctccggtacatcgatcaacagctcaggcaacaacgagctttccaacagtatggcatgatcccacaaaatgcttggaggccacagagagggcttcctgaaaactctgttaccattcttcgtgcttggctctttgagcatttccttcacccgtaccctaaagattctgaaaaattgatgctagcaaggcaaacaggcttgacaaggagccagatttcaaactggttcatcaacgcccgtgtccgtctctggaaaccgatgatcgaggacatgtacaaagaagagattggagatatcgagcaagactccaactcttcctccgacaacacgccaagaagcaagggcaagatggtatcttctgaagacaaggaagacccgaggagttgtacgcctcgggtctgcgagagcagtcagctgagcgagtcaagaggcagcatgaggaccatgaacgccgtcggcggtggagcagccatgggattccagaacgagcccaaccctgacgacaccttcatgaacctgatgctgaaggaccaacgatcaaacggagaagaagatggcggcctcctcctccacaatgccgtggcgcagcatcaagatgagaacgcccggttcatggcgtaccacctggcggaacttgggaggtacgggaacggcaatgtgtcgctcaccctggggctgcagcactccagcagcagcagcctctcggttcccaacgcccagcagagctttcctggtgtcggtgtcggtgtcggagacgatgacatctacaacgccgccgccgctcccctcggtgtcagcgtggcgtcgtcggactacgagacgatgaaccagatggatcaacggcaacggttcgagcagtcaccccttctgcatgattttgtggcctgaagaatgctcatttgctcatacatcagatgatttgtatttagcacctgccggccggccgcccgcccaggtgaataacatatatatgtgcctgaaaaggagcattgttgggttgtagcctgtagtttcaattggata

SEQ ID NO: 289 - DNA, 1569 bp, Sorghum bicolor
gcagaagcccagtatacctgcatagtagaattcattcatttccagcccactccacctgtcgacggtcgagcagacttttcgtcttccagatctcggcaatctcgatccctcgccgcgccatggctgctgcctcctccccaacctccccgcccccgccgccggcgaccgacgtcgccgctccaggcctccccgatctctcgatcccctacgacctggccactcgcgggcagtggcaggcgctcttctcccacctctcccacccggcccacacgccgcatccgcaccaccgcctcctcctctccgctctctccgccctctccctggccaagctccgacgcttccccgacgccgccgcgctgctcgcctccctccacccggacccggcctgcccgccgccgcccttcctcatccgcctcctccatgccctcctcccactcttcctccccgaccgccccctcgcgctcgaccgcctctacacgctcctctcctccgtccgcgcccgccccgacgccgggcaccccgagtggcgccgccgcgacgcgctcgtcgcgtccgtcctcgccgccgaccacctctcccaccgcgagttcgacgtcgcgctcgcgctcctcgccgacatcgccgcccgcgagccgggcaacccggtgctcctctcgcgcctcgcctacgcgcacctccagatcggcaacctcggcgcggcctcagccgcgttccgccacgtggagtccgtggccgccgcgtccgaggaccccacgcggcatgccaacctcctagcccgcaaccgcgcgctggagtgcatcgtggccaaggactacgcggcggcggtgcgggagtacgagcgctgcatcgaggcggaccccgcggatgccgtggcgctcaacaacaaggcgctgtgcctcatgtactcgcgggacctcggcgacgccatcaaggtgctggagggcgcgctcgagagggttcccacggcggcgctgaacgagacggtggtggtcaacctgtgcagcatgtacgagctcgccttcgtcaaccacggcgaggtcaagaggagccttgctgagtggatcgccagggttgcgcccgacgacttcgacacctcctgcacgcgcatgtaggagggatagtagcgaactatatggacctgccagaatgccagattagcgagaggcaggtaaggttcccatgccatggcaatagtcgagaggttgacatctttggcaggcctggctaaatgtttactaggagcacaagcatactcgagtgggacgaggtccgagatcaggaagtgaaagaagcatactcgagtgagacgaggtcggagatcacgaaccgaaagaacccatgctcaagccttttcgccgctttgaaaagccatagctgaaagtattgtttgttgatttgttatgagagaaaaacattgttgactgataaaaaaagtacgacttataagataagtgaatgagcttttataattaattagtttttttttcaaatgaatttgaaaaggtttgtaatcatttgtccacccaatcaattaagggggtgtttagttcccctcaaattctaaaaaaa

SEQ ID NO: 290 - DNA, 988 bp, Helianthus annuus
tccgatcatcaaatttcatctttctcaagcatccgatcatggccaagattagggcttttttcatcctcgctcttcttcttctctcttcttctttcttccttcaagttgctaggtctcagtctgatccagacgcagaagcggatgccgaacttgtggcggaaactgtcgaggaaggaagtcatgttggtgacgatgttgaggatatcggtattgggaattataatccggctcctggtgtggaaaccgtgtcggttttccctaaaaactttgcgaaattggtagtagcaggacaagaaactgaacttttgattggattgaaaaacgaaggagaacaaaacgttaaggtttttgctgttcacgctagtattcatcttcctttcgatcatcggatgttggttcaaaacctctctacagtggctttcaacgatgcatcggtccctgcttcagttcaagctacatttccctatacatttgctgtcagcaaattcttgcagcctggaacatttgatcttgttgggacaatagtgtacgagatcaaccaactaccataccagaacgtattctataatggcaccattgaagttaccgaagccggtggtcttgttagcgttgagaccgtgttcttggtgtcacttggacttgctcttctcgtgctcttcggcttgtgggtccgcactcagctacagtctctttccaagaaaactaagaagataactaaggtggaagttggaacccgaactgttgatgcatcaatggacgagtggctgcagggaactgcttatactcaatcacagtcgaacaaactgaagaagaagaagtagagatgtagttttcgatgttgagcaaaggtagtcggttgtagagcgaccaacattctcgttttctgttgagttttaactagcaattacaggcatttgttttctttttagagtgttttatatacctgcaattttagttttggcaaattttcaacgactttccaatcgtt

SEQ ID NO: 291 - DNA, 2478 bp, Helianthus annuus
ggcggaacgatgatcagaacatgccgatcaagagttcttccattgtttcgttgattaatccgactgattctaacgccaatgcttctgccaaaggaatccaaattctcacaagggctcaaactagccatcctttggatcccttatcagctgctgaaatcaaagttgctgtggcaactgtaagggcagccggagcaacccctgaggtgagagatggtatgcggtttgtggaagtagttctatcagaaccagataaaaccgttgtcgcactcgcagatgcatactttttcccacctttccagccttctttattaccccgaaaaggtggagctattatacctagcaagcttccgccaaggcgagccaggcttgttgtttacaataaaaagtcaaatgagacaagtatatggattgttgaactgtctgaggtacacgcaacaactcgaggtgggcatcatagagggaaagttatttcatcgaaaactattcgggatgttcagcctccaatggatgctgtggaatatgctgaatgtgaagaagttgtgaaagattaccctccctttcaagaggctatgaagaagaggggcattgaagatatggatctggtgatggttgatgcttggtgtgttggctatcatagtgaagctgatgctcctagccgcagattagcaaaaccccttatattctgtaggacagaaagtgacagtccgatggagaacggatatgcacgtccagttgaaggcatctatattctcgttgacatgcaaaatatggttgtactagaattcgaagaccgtaagcttgttcccctaccacctgctgatccgttgagaaattacactcctggtcatactcgaggtggagttgacagaagtgacgttaagactctacaaattatccagcctgatggaccaagtttccgtgttaatggacaatacgtcgagtggcaaaagtggaattttcgtattgggttcactccaagggagggtttagtaattcattctgttgcatatgttgatggtagtcgaggccgaagacccatagctcatagattgagctttgttgagatggttgtgccgtatggtgatccaaacgatcctcattatagaaagaatgcatttgatgcaggcgaagatggcctcgggaaaaatgcccactctcttaaaaagggatgtgattgcttgggttatatcaagtactttgatgcacattttacaaacttcactgggggcgttgaaactatagaaaattgtgtatgtatgcatgaggaggatcatggaatcctttggaagcaccaagactggagaactggtttagctgaagtaagaagatctcggcgactcacagtgtcttttatatgcaccgtggctaactatgaatatggtttctattggcacttttaccaggatggaaagattgaagctgaagttaaacttacagggattctcagcttaggagcactgcagcccggggaagttcgaaaatatggtacaactattgccccgggtttgtatgcaccagttcatcaacatttttttgttgctcgtatggacatggcagttgattgcaagcctggagaagcatacaaccaggttgttgaagttaatgtcaaagttgaagaatctgggaaaaataatgtccacaataatgcattctacaccgaggaaacattgcttaaaactgaatctcaagcaatgcgtgattgcaatcagttatctgcccgtcattggataattcggaacacgaggaccgtgaacagaactggacagctgactggctataagctcgtaccaggttcaaactgcttgcctctggctcgtccagaggccaaatttctaagacgggctgaatttttgaaacataatctttgggttactccttgtgcacttgatgaaaactttcctggaggtgaattcccaaaccaaaatccacgtgtcggtgaagggctcgcctcgtgggtcaaacaaaaccgttctcttgaagaaactgatatcgtcctttggtatgtgtttgggatcactcatgttcccaggttagaagattggccagttatgccggtggagcacattggctttatgcttcagccgcatgggttcttcaactgctcgcctgcagttgatgttcctccaggagcctgcgagtcggatgtgaaagacaccgagcataaagaaaccattgcttccaagcctgtttcaaacggtttgattgccaagctttaatgtaatcatcatcaacaaagtcgacttttttatcgccccttatctatttaccatgtcgtttaaacctttttaatttgtatgattttagacgctagactttggttgtgtaatcatcatcaggctctggttcggtttcagttgctatcctcgtttaaacctttttaatttgtatgttttatgtttgtactttctcaaggatcatagatgatgaaagttggtttgtaaggtatcatgcgtctgagtggactcttttggtcttatt

SEQ ID NO: 292 - DNA, 1528 bp, Helianthus annuus
ctctccgggctacgactacgactccccgacaccttatcatcatcatctccaccaccaccatgccgacggcaacggcgatttctctctcaatcctcttcctcctctccctcaccaccaccatccacgcccacaacatcacccgaatcctcgcaaaacaccccgaattctccaccttcaaccactacctcaccatcacacacctcgccaacgaaatcaaccgccggcaaaccatcaccgtctgcgccgtcgacaatgccgcaatgtccgacctcctctctaaaggcttatcaatccaaaccatcaaaaacgtcctctccctccacgtcttcgccgactacttcggctccaaaaaactccaccaagtcacaaagggttcaacctccaccgccactatgtaccaagccaccggcgaagcccctggcactgccggttacgtacatataaccgatgtcaaaggtggcaaggtccgtttcacacctgaagataatctctcccaaacagactcagtgtacgtcaaatctatactagaaatgccgtacaacatttctgttatacaaataagttctatattacaatctccagaggctgaagcgcctactgccgcaccagatctgaacctaacctcgttgttagaccgagatgggtgtcagtcatttcataacctgttaactacttcaggtgcaattgggacattcttaagcagtgtagaagccggtgtaaccgttttctgccctgatgatgacgctataacagcttttgctccaaaatataaaaatctaactgctgcagaaaagacatccttgttgctgtaccacggaattcctgtgtataattccatggggatgctacggtcgagtaatgggttgatgaacactttggctactgaaggagctaaaaagaagtatgattttactgttcaaaatgatgggaatgatgttaagttgaagacgaaagttgtgacggcgacggttactggaacggtggtggatgacgagccgattgcgatttatactcttgataaggttttgcagcccagagagttgtttaaaggcgcggttgaggaagcggatgaaccggcgcctgcccccaagggggcgaagaagaagaagaaggcagcaaagaaaggagatgaggcggaggaggatgccgaggcgcctggaccgggttcggatgaggattatagtgatgatgatgcggcggatcagacggcgagtagtggtgaaagggttgtggcgatggtgtcggtggtggttatggcggtggtgttgaatttgttttaatttgttttttcattttttttttttgatgtgtgtcggtgtgataaagtgacagcgggtatcatgggtctcccacgagagttgctcatgcaggaatagaattctctttttatttttttgtttttaatttatgatttaaagatttttatcttgttttatttatcataaacgaaaaataatgagtcttttttttgagttcctatgcattgtaattaattgttttgtttataaaatggaaaatgtttgtatga

SEQ ID NO: 293 - DNA, 891 bp, Helianthus annuus
ggaaacatgatgtcccctggaatttaacttggtgatgactgtaattcggttttacagtgagtacttatgtttatagtgttcgtgtgtacgagacttatatgtgctcgtattcattacatatcttccagaagatcctttcgtatgtcttctagatctgatctcaacgctatggagcggggcatgcgtggtgctgaaacttttgttgcagcaagcttccctacaaagaaatatagcgatccgtttttttcgtgctcaaaagatgctcaatgtatagtttgtctttcagaataccacgcagatgacacccttcgtattctgccctcgtgtggacactttttccactcatcatgtatcgacatctggctgcagcagcactgcacgtgtcccgtatgtcgagtctcattgcgtgaagtttttgacaaaaggtgcttaatgcaaccgatgttcagttcggctgtcagattcccatcaagcgcggatgacagccgtaggatggacccaaccactaatggtcaaccaaggtcaactggcaacgtacaagaagcgggactacacaactcaaacgtcagcgagaacgttcctgctggctcaaaaagtcccgggaacaaacaatttgaaagcccgtcggatgtttaattaagatcacatatgtgtgatcaaagtttgtagcttttgagtgatggtaaagtgtgaaagatgttgggggtgttattgtctttttaggaatttgtttgttttggctttaccagtagtatttgtatatatttgaagatcagaaaagtttgatgagtagattgttgtcatagttgtatacgtatatagaaagttacctttggtaaggaagtttctttagtgttttactaaagtcgcttacactttctttcaaactac

SEQ ID NO: 294 - DNA, 1140 bp, Triticum aestivum
agatggccgaatccgacacggcggccggcaagatggccgaacccgacgcggcggacggcaagatggccaacggcgaggtctccgacgacggccgcgccgtcgaggtctccggcggcggcgacgacaccctccccgcggtgctccgcggcttcgtggacggcgtctggccgcccggcgacggcggagatccgctcctgcggcgcctccgcgcggcgacctgcgaggccgcgccgcggctgcgggacgcctccaggaactcggcccgcgacctgctcgcctggaccaagcagggcagcggcctccgcgccatcctcgtcatctcggtcggaacaatcacgatgatatcactgactggcctgctgattttcatgtccttccttctggttgcgaccgctaatgccattatcgtttcagttcttatgtccttggcagctgctggaggattcctggccttgttctttgcttgcttagttgcagtgtatgtcggagcagtatcaattgccatattcgtcatttcggccactgttatctctgcaattgtgggagtcctgattgccaccggttggatcggattcttttggatgatttggtttgccgcaaggaagagcctggaccttaccaagcactcaatcggcatgacgacctctgctatgcagtcgtattcagcttctcggagtgtggggcagaagcccacagactgactgagatagcagcaagtggtttagctacagtgcgctgtctgttatcgcgtgatgttgccgcctcgctgccctgctgttgttgtgttatatgtgctgcctaaagcgtgccgtatgtgtatcacttatttcgagtagaggacatgaatccgtgtatagttatcccggtttagcgtaaggtaccaccactcgcccctgaactttcggcaccctgtgttgtagtatactcatagtaacgaataaggcaataatgccggctgtgttggcgagtgcgggctaggttgtggttttgtgctgtaaatgaagctattctgtctggctctgttgttgaggcatagaggaatgaataaaacgtactgtagttgtcaatttcatttctggtaacatgaacatactgatcagtagccatagcattcagtcctggcttcttggccacttgaat

SEQ ID NO: 295 - DNA, 2682 bp, Zea mays
cgtgaggtcgtgaaccaaagtgaaagcgccgcgaacccaccgaaacacagcagacaggagcaacattcacggacggaaacccctcaaccccgaccccctcgaggcctcgacccgacccgacccgcctccaactccaagccaagccgccatggcggctccgcccgcgaccaccgccacgactcaccaccgcgcgctcctcccgcccacgcgcacccacgccgccgctacgcactccgcgctccgcctcccgctccgcgcgcatccccacgcccacgcccagcgcgcgcgcctcaccgccgccgctgccccggcccccgcggcgtcgacggcctccctcgagtcctccgccgcggggaagcctacggtgctcgtggccgagaagctcggcgccgcggggcttgcgctgctgcgggaattcgccaacgtcgactgctcctacggcctctcccccgaggacctccgtgccaagatctcgctctgcgacgcgctcatcgtcaggtccgggaccaaggtcggccgcgacgtcttcgaggcgtccgggggcaggctccgcgtcgtcggccgcgccggcgtcggcatcgacaacgtcgaccttgccgccgccaccgagcacggatgcctcgtcgtcaacgcgcccactgccaacaccgtcgccgccgccgagcatggcatcgcgctgctcaccgccatggccaggaacatcgcgcaggcggacgcgtcactcaaggctggtaaatggcagcgcaacaagtatgttggtgtatctcttgtgggcaaaactctcgcgattcttgggttcgggaaggttggttcagaagttgctcgtcgcgctaaaggtttaggaatgcatgtgattgcacatgatccatacgcttctgctgatcgggcccgtgcaattggagttgagctagttagtatggaggaggccatgacaactgctgacttcatctcattgcacatgcctcttacccctgcaacaaacaagatgctcaacgatgaggcctttgctaagatgaagtatggtgttcgcattataaatgttgcacgcggtggtgtgattgatgaagatgctctagtcagggctcttgattcaggaatagtagcacaggctgctcttgatgtgttcactaaagaacctccagctcctgataacaagttggtgctgcacgagaatgttactgtcacacctcaccttggtgccagcacagtggaggcacaggaaggagtggctattgagatagctgaagctgtcattggagctctgaaaggggaacttgcagcttctgcagtcaacgctccaatggttcctgctgaggtgctgtcagagcttgcaccttttgttgtgcttgcagaaaagcttgggcatttagctgtgcaactagttgctggtggtggtggcatcaagtctgtgaaagtgacctatgcatctgcacgggcccctgatgatcttgacacgagacttctccgtgcaatgatcaccaagggattgattgagccaatctccagcgtttttgtcaatcttgttaatgctgacttcaccgcaaagcagaggggagttcgcatcactgaggagaggatcatcttggacggctcacctgagacgcctatcgactacattcaagttcagattgccaatgtcaagtccaaatttcctagtgcgatatctgagactggagagatcacagtggaggggagagtgaaggatggcgttcctcatctaacaaaggttggagcattccaggtggatgtgagcttggaaggaagcctgatcctttgcaggcaggttgatcagccaggtatgattgggtcggtaggaagtgtcttgggtgaggagaacattaatgtcagtttcatgagtgtcggaaggattgctcctcgcaagcatgctgtcatggcaatcggtgttgatgaggaaccaagcaaggtcacactgagaaagattggggagattccagcaatcgaagagtttgttttcctcaagctttaggcaactaagcgcaaatgtatgtttcaagttgcaagcatgctgtgcaattttgatgtagcttagcaatatagaggacggatggttctccttaaataagcttttaggattatttttgtagtggcgctcttgaatttggtgcaatattgatgccatcttttgaacggggtgttattctcagctactgtttcccaggttataaaaaataatatgtactccacgttccaatttataattcgtttgactttttttatctaatttataattcgtttgatttttttatctgaagcttgaccacctcgttttattcaaaaaaatatctaattattaatattttttattatgatattgttttgcatataatatactttaagtatgtctttaattttttttttaaaattttgcagtcgatcaaatttgataaaaaagtcaaacgaattataaattaggacgaatggagtacctactaaaatatttatttatccctactacactctaacgtagatcgtccaccgtggttctgcccacctccgatctgacagatggacctgatgtcgtgcaattccttcctcgcccaccgctatgtcacgcatgcagcaaccactccccctccacatctccatcgtcagtccgccctacgaatcctttgccgcacccttccgcacgcagttcacgcctaggcctccgcctctgcgcag

SEQ ID NO: 296 - DNA, 3891 bp, Sorghum bicolor
acgaggcagggcagtaattgaaagcaggcgacccggtgaacccggtgaaccgtgctgacgtccaatccgccgcgcgacgggacccaccccctagtccctcactggctgcacctctgtcccactcccacgcccacccctctctctctctgtctcgactcgctttttgttctcttttttctttcgccgccccgcctcctctagtcttctccgcccttcccttcgctcgctcgtctcatttctcagctcgaactgctccccccactcctctcagacgccatccccatttctcgccggcggagcgcgcctgcgccccgggtgagagggagccaggatggccaagcccgctgccgccgagccattctccatacggggttacgccatgaggatgcgggccgtcgacgcggccgagtgctacccgttcgtcggcggcggctgcagcgaaggggagggggagccgccgccgccgccgcggttcccgccgatggacccgaagccgctgtcacggtggtggaagcacgagctcgcggcggggcaggcccggcttttggctggcgccaagggcggagaggctgcggcagccggggtccgcggcagtgcgctgcggaaggggaccaagaggaagggatctcgctcgaactccacgggcgagagggccaggaaacggcggcgtgtgcttcagtttaggtcctttctgtcgaacaaggagagaactgctaagcctcagtcaacatttcgtttacatgaacagaagttgcatatggcaatgctgagaaagcataaaagttctactgtccatacaagtacagtacttgaaccaaggaagaaactggaagaggcatgtgatcgcatgccaactcatgaaaacagcgtgaaaaagcgacacagagagagaacggacccttctagtgaaatgaatagtgacctctacgggataaaggaagtgacctcctctgtaaataagcaagtcatagaagtcaatggttcaactaataagcctacaaacactggccacgaaatggtgaaaacttccacagggcccaaagatgatatctttggagatctccctctccttgaattagagagctccaaggttatgtttcggactggtgttcatgaacttccaactgttatagaagaatcatttataacaaatcaaaccgaagcagattctataccagaagttgtacccttggagctgatagatgcatctgacatcactgctcagacgccatctcctcttgaagacttggtgaaaagtgaagacagtgagccagcatgcatctcccacaatgatgtggcagggagtcacccttccactgttgggattgatggtctgccgaatcataagaacatcaatatggtgaaaccaggtcttggtgatatgcagttgaaatttactgacgtgtctgctttaggttctcattctgttctgaggtcaaaatctggttctggttaccctctgcagggttgttttgatgtgaacaagaactgctctcaggaaataaaaaaacatggtactaattctactagcagtccacctgccatgagaacaagaactgaagaaactaaatataaagatgcaccagttaagggcaagaagagtactgatatcactagtgcagcggttgcactacccgtgcctgccaaccaactttcatatcaagctagcgcgttgccctctgcagtatcacattcagttttcagcacaagagttgattcaaatgacatgtcttcattcagaagtatgcctgccaaggaatgcatcccaactaccagacctggtaacttaagaactaatgtgtgccatggaagtaggaaacatgtggatccatgtgtggcactatctacagataaccagggtagctcgcactcaaaacttcatccaatttgcagtcctgctaacattggaatgacttttatgaagctaccgggcctcgaacggatggagatctcaaactgcaatgtaaagataggcgaaaacaggtttagtaatgcagagtcaatgaacgcagtaagatatcagaaacaaccgtggttgagtggcatgacctatgtaatgcaaggtcagaaacagataggtctaagcagctctcaagttgggaaaccagctcttgatggttatgggggcgaaggtgatcatcatctgcagcaacccacagttcgtttgatgggtaagaccgtctcagtttgctcacatagcaaggatcataatgtatcgaccatggatcaagtgagtcctgacaatgttgccattgaagcaagccgcctatccacaatctcatgtcagttaccccaaaagagatcattcccttgtcaggattctgtgacaccaagagtgcatctaaacaactcttcagattttttggcaaggattcccaacaatagcatgcaagggcaaaatactgctttcagtggcctccataaccaaaggccacaaccaataaatagtgctccaaccgtgaaagattgcacttggaattttggtaatcagtttgttcgtcaagctgaactcaataaggcagctatagtcagcaccaactctcagactaggcatctagagctacatcaaccacctcaattgataagcattcctcagaatcaacagtctcatttgtggactccggcagcacagatgagtaggaaagatcagtgttttgtgggtccagcagtgaaccaatcttccctggttccaaaatcattgctaactgcaagtatgaaggaaaagtatcagaaatccactttgttgtcttacgatgatcctagttctatgcctatttgccaaccctaccagatacctggtgcaaactcatcttctgcatctgtcacatccttttttgagtatggtgcggataattcgttgtccagaagctcttctcctggactgagtctttctcttgcaactggtttggctaatgagtctgtttccacaggtagagtagcttgtgcaggcagtcttacaaatgcagatggtaggaaggctgctagctttgccgaaccaataagcaatagttcagcttatgcagataatgtttcacagcaacctgcaaagccaataagcaacagaacagcttatgcaacagataatgtttcacaacaacctgcaaagagacaacttgttacagatacacaggatttaatgtctatgggcccaaacattgtgaaccattcacctggctggtcacttagtgatgcagttggtcctcaggtacttgattttagtaaaagaatagcaagggatgctgttcaaacgtcaagaaatgaaagcaacaatccaagggccagttccggtccagttccgcctattgaaacatggtctaggcctgggttggttgcaggggctaataccatgttgaagccagtaagaatctcaaaacgaggagatcaagaaaccttagagcaatctggtcgacaacagatcatgggtgttcttggtacccttgctagaaatctggacgcccttgtcgggccagggatcatgctgctttatcctctgtacgcgtccatgcgcgccatagagagcccttcttccctggacgatcagcagtggctcacctactgggtcctgtactccctgatcaccctcttcgagctctcatgctggaaagtgctgcagtggtttcccctgtggccgtacatgaagctgctcttctgctgctggctggtgctgcccatcttcaacggtgcggcctacatctacgaagcgcacgtccggcgctacttcaagatcggcaactacgtgagccccatctacaacgagcgccagcgccgggtgctgcagatgatgagcctcgacgcgcgcaagtccgtcgagcgcttcatcgagacccacgggcccgacgcccttgacaagatcatccgagctgctgaagaggaagccaagaggacctagct

SEQ ID NO: 297 - DNA, 1864 bp, Oryza sativa
ggaaaaactagaagttgccgagagccgcgtggtgttcgtccggtctccggtccagagcgggaggcggccggcaatccgcgacctccacctcctcctcctcctcctctcgtcaccaccaccacggcgaccccgtcctcctcgcccctctaaaagcctctcccttcctttctctctccccttctcgtgggatcttgtattcttgcgtcgtcttgggactcttgtggtggtcaagaacgaggacgagagaggtcggagagcgaggcggcggctgtgccgttgcgcgtgcggtgcgggtgaggtagctagcgagcgagaggggagatggaggcggtggcggttgcgggcggtggcgcggggctgacaaggtggcaggcggcggcgctgtcggcggtggcggggtgggtgtgggcggcctcctccttcgacctcacgcggcggtcgcgcgcgctggtgcagccgtgggtcacccgccgcgtgctcgccgagacgccgtccatcgtcagattccagaaggtgcatcacaagttgctggacagtttcttctctgtgctgtcatgcgttgtctctgtccctttctacaccggattcctccctctcctcttctggagcggacactccaagctggctaggcagatgacgctgctcatggcattctgcgattaccttggcaattctgtgaaggacgcggtgtcagcccctcggccaagctctcctccggtgagaagagtgacagctactgaagacgagaaggaaaatgccatggaatatggattgccttcatcgcacgctcttaataccgtttgtttgatgggatatctgctgcattatgtcctaacatatggatcacacgacaatgttatggttgtcacgggcttatctctagctttcttgcttgttatgttagttggcattggacggatatatttgggcatgcacagcttgattgatgttattgctggcatctgttttggcgttgtaatcctggcattctggttggctgtccataatcatgtcgatgcttttgttgtctccggtcaaaatgttacaaccttctgggcgagcctttctctgttgctgtgcttcgcatatccaaaaccagaattcccaactcctagctttgaataccacacagcattcaatggggtggcttttggaattgtctatggaatccaacaaacctacttccatttccacaatcctgatgtccccctcattttcagcccacaattaccgcttattgtatttgtcgggagggttctcgtggggatcccaaccatcctagttgtgaaattctgcagtaaagctctctcgaaatggcttctaccggtgatgtgcaacaccctgggcattcctattgtatcaacctgctatgttccagcgctgaaggcttccgaaaagtgcaaggtcaagtccgacgcgaagcagggcggttatctccagaaggtgttctccctctttccacagaaggcgtacgatgtggacaccggcataaggttcgttcagtacgccagccttgcatggtcagtggtcgacctggtgccggccatattcactcatttaagtttgtagtgaacactgcaagatgcattctacttggagacttgcaaaatcccaaatgggctattcctactcatgagagagagataatcttatgggactgtaaatccgatgatctccactttatttttatttttgcgtggtgtgtgtagaggtgttttgtccatagtagcaaccaggaagtattaacatgctgtgaaattttgtttcatgatgaagacagcgaccaccacgaactctgaaacttaactgcaaagaaatgccattccttttcttgcattgtattgatgcaggttctttgtatcca

SEQ ID NO: 298 - DNA, 3496 bp, Zea mays
caacaccaagatttttcataccaccactgtctgcagcaggcatcactgacatctttgccccgcggtctgcgaccccgcatgtcggtcgagggtgtcgttatcaaaatagtggctgcaaccgccggttagtgatacagttcctctcagaaagattgggcctgatgcgagacgttggatcggcatccaacgactgcgttccgctacggttcgccgcccacggcgacatgcggtgcagatctcggcttggcccgtacgccgcccccacactcctccacgcaaacacgtcacgcaggcagtggtggtagccccgctccgctcacagcactgttcggtggaatgcctcactagtcactcactactcactagtagggctcctgctgcctccaggtccagcccacgctaccccacaccgccgttcctccactgagcaaaccccgccgccgacgagatgaagggagcaatgccgccgcgccagttcatggtgccgggccctggggggccgatgctgccaccgcagcagcagttcgggctggtggagacgcgccccccgctggcggccgtgctgcggccgcgcttcaacatcccgggcctccacccgtcagcggcggccgccgccgcggcctcgggcgcgggcaagatcgcctccacctatgacctcgtcgagccgatgcggttcctctacgtgcacgtcgtcaaggcgcgagacctccccgcggtgtccgccacgggcgccatcgaccccttcgtcgaggtcaagctcggcaacttcaagggcaccacgcccgtcagggcggccagccacaacccgtcctggcagcaggtcttcgccttctccgccacgcacctccagtcccatctgctcgaggtcgccctcaaggccaaggatctcgccggcgacgacctcgtcggccgcgtcgccttcgacatcgcggaggtgccggtccgcgtgcccccggactcgccgctcgcgccgcagtggtaccgcctcgagaccaagcgcggcgagaagctgccgcacggcgagatcatgctctccgtctggctcgggacccaggccgacgaggcgttcccggacgcctggcactccgacgcgcacgccgccgcgggcccggcggccgtcgcgtccacgcgcgccaaggtatacttctcgcccaagctcgtctacctccgagtcgcggccatcgccgcgcaggacctcatcccgcatgacacctcgcgcccgatgagcgcctgcgtcaagctgcagctcgccggccagctccgccgcacgcgccccggcgcaccgccggggacgcccaacccgatttggaacgaggagttcatgttcgtcgcgtcggagcccttcgacgagccgctcgtcgtcaccgtcgaggaccgtgtcgcgccaggccgcgacgagatgctaggccgcattttcctgcccctcgcagcagcaatgccgcggcacgaccacttcggcaaacccgtggagccgcggtggtacagcctcatgcgcccctctgatgatcctgataagaaggaagtcaagttcgcaagcaagatacagattcggatgtcgcttgattttgggtaccatgtccttgacgagtccacctactacagcagtgatctgcagccatcatcaaaacctgcaaggaaaccaagcattgggatgcttgagctgggagttctgggtgcgcgaaacttggtaccgatgaagcccaaggatggacgcaccacggacgcctactgtgtggccaaatatggaccaaagtgggtgcgcaccaggactattcttgacacgctgaatccacaatggaatgagcagtatacctgggaggtctttgatccttgcaccgtgatcacagtggtggtgtttgacaatggtcaaattgggagcaagaatggcggtggcccagatcagcggattgggaaggtcaggatccggctctcaacactggagacggacagagtgtacacgcatttctaccctctgctggttttaaatccgagtggactcaagaagaccggcgagcttcatttggctgtgcggtttacctgcacagcttgggtgaacatgatggcgctgtatggtcgtccgctgcttccaaagatgcactacacgcagccgatcgctgtgatgcaactggactacctgaggcaccaggcaatgcagattgttgcagccagactcagccgcgctgagccgccgctgcgcagggaggttgtggaatatatgctcgatgtggattcacatatgtttagtctccggcgcagcaaggctaatttccatcgtatcacctcactgttctttggttttctggcaatgctcaagtggtacgacggcatcaggagctggtggaactcgatcacgacggtgctagtgcacatgctgttcctgatactgatctgctacccggagctcatcctgcctaccatcttcctctacatgttcatgatcgggctctggaactatcgtttcaggccaaggcatccgtcgcacatggacactaagctgtcccatgctgagctgacacaccctgatgagcttgacgaggagttcgacacattcccttcctccagaccagctgaaatcgtaaggatgcgctacgacaggctgaggagcatcggaggccgtgtgcagaccgtggttggggacctggcgacacaaggcgagagagcccatgctttgctgagctggagggaccctcgggccaccgccatcttcgttttcttgtccctggtggtcgccgttgttctgtacgtgacgccgttccaggttctgatggtgataggcatgctttacctgcttcgacatccccggttccgcagcaggatgccctccgtgcctttcaacttctacagaagactgcctgccaggtccgatatgctcctttgagatcacagtattcggcgtgagagaatcgggtgcaagtctttacttatttatgtctgttctgctcggttccttctgattagtatcagatcagatgtgaatataccagatgagttcgtatattagaggtcatttagtgtcccaggaataaggtgttggtttaatggttcatttccttttgagtttttgggatagtgaggggaggtttttgggtgcagaaatgtaatgttaactccgggctattagcatagaactaaaggcaggaacaatattatcccccgtgtattatgtttgtactatttgtgtcaattttgtttgtgtttcagtgatcttttccttgctgtttgtatttacgtgtgaccatgtcgtgttcgaaccactgaatgttttggttcactggatatgtcctgcttgctgcagttgtagggtctgtttggttcagtgtctaacttaggcacactttgcctaatttttttgtctaagattagttctttagtttgaacgaccgaccttagataagtgtgacacagttagtcacgaaccaaacatgcccgtactctcgtaataggctgttttgatatgttgtttgttggtgacaaattttgttcgttgccagggttc

SEQ ID NO: 299 - DNA, 4528 bp, Glycine max
atgaacatatcaggttatattggggtcctctatgattcattgggattttctaggcaattccaccggcgagaaggagctttagaccttagaagaaacgaaatggaaaaagctgcacaagaaaagtgatcccgtttgctttcagccaaacacgtcgttaggcgcgtacttgagttgcgtcctaaaatctaattgaaaagtcccctgtttgttcttcttctcctcattcctcaacgatatggacaaactcggcgaagaagagcaactcagaaccagcaccttccaacgcttaaaatcacacactttgcaccttctcgaccttttgcagaaccctcacattcagtatcagaagcattgttctctcaccgtaatcccccaactccttcgtttccttcagagttcttcgccctctacgttacaacccttcttcgactacactctgtttccgttacttctgctcctcgatgcagcgatccagtgcaggtctactcagaaagttgattctcaggaaaattataacatgcctggtgttctgaaaacacctgttaatgtgagtgatggcgttgctgaaggtgtggttaattgtttggaggagcttcttaggaagtgtcgtttgaattctgtggatcagatggttgtgctgctaaaaaagttaacatatggggccatgttatcaccctccgaagcttcagaggagtttcgtgaaggaattttgttgtgcgtcaaggcactgcttttgagcttatattcctgttccgatgtgtcttgcttgtgtgaacaaattcctggtttgcctgcactttcggatgacatttataatgatgaacttcataaaactttcaagtatggttcggaatcagacaaatgtttacttgcatttctccagtctcaatttgcatcagctgctgttggacactggctatcacttcttctcaaaattgcagatacagaggctgctaggggacaaaaaggttctgcaagacttcgaattgaagcattcaaaactctgagggtgcttgttgcaaaggttggttatgcagacgcattagccttctttttgcctggcattgttagtcagttagctaaagttttgcacagtgcaaaaacaatgataagtggggctgctggaaatgtggaatctattgaccaagcaatcagaggtttggcagaatttcttatgatagtcctccaggatgatgctaatgcacctgccctagatattgaagcgtcttcagacttttattcaaatgagtgtaattcaacactttctcttttggatgagcttcgccacttgcaagttaaaaattgtgttaaaacaaaagctgctgaagatacagatgttgagtcagaaaaaatctcttgctcccaaactcaactccaagaaatggggaatactgatcctggcagagagaacatgtctttgcatgtgaaccgaacaaaagattggatgcagaagacatcagcacatgtaaataagctgttgagtgcaacatttccacatatctgtattcacccttcacaaaaggtgagaaagggacttgttgatgctataaaaggactcttgtcagagtgcttctacacactgggggaaagtagactgatgcttttggagtgcttatgtgccttggtcgttgatgtatctaatgatgtgtcttcaactgcacaagatttccttgagtgtttgttctcacaaaatttgaaacatgttataaaacacaatgctgctgagatatttatcaggaaccttgaaaagcttcccagagtggtgcttggccatgaggagtcacatgctgtgttacatgctcagcaattactaacaataatattttattctggtcctcgtctgttagtggatcatcttcagtctcctgtagaagctgctagattcctagatttgtttgctgcatgtctaagccataatacagtgttttctggtttgctcggcataatcactaaaacagatcgatcatcaactctgggatatcttccctccattgctgagttgaaatctggagctaatttcttcaattatggcccccttcttataaattctgctttatctgaagtccctaagtgcaggcttattgaggaaaaaagtatagatgaacctgtgaaaactgctcaaaacaactatgagcttcctcgcatgcccccttggtttagttatgttggtagtattaaattataccagcctcttgcagggattctccgatttgtgggtttatctttagtggcagataatataagtgaagggcttctgtcgcatgtgattgatattctactcggttacttccgtagattggtttctgagcttcgtttaaaagaatacaataaagaaagctggcagtcttggtatgacaggaatggttctggacagttattgcggcaagctagcacagctgcatgcatgctgaatgagatgatatttggtctatcagatcaagcaactaatgattttgctaggatatttcataggtctactctaagcagaggagttcaggttcagtcttacaaacatgatagtgcatttcatgaattttcctggaagaagtccaaggataaaggtgtaaggagttgtttagttgagtgcattggtgggatcttacacgagtatttatctactgaggtatggaatgttccaattgatggcagaattgctgacttgcagcttaatgctgcagttgaagaagatattagcctatactttttccaagatgctgcaatgctacgtgaggttattattgatggagtaggaatctttaatctgtgccttggaagagattttgtttcaagtggttttcttcattcttcactttatttattgctggagaaccttagttcttcaaattaccgagttagaaatgcagcagattctgtcttgcatatacttaccaccacatctagctatacaacagttggacagttagttttggaaaatgcagactatgtgattgattcaatatgtcaacaattacgccatttggatctaaatcatcatgtgccaaatgtgctggcatccatgctctcctacattggagtggctcacaagatattgcctcttcttgaggaaccgatgcgctctgtgtcaacagaacttgaaatactgggtagacaccaacatcctgatctaactgttccattcctaaaggcagtagtagaaattgtgaaggcatcaaaacgtgaagcttgcctgttgcccactcaggcagagtcgtttgccagatatgtcaggtctatggtctctaattcagaagaaacaacacaagacctgtgggaggacattttattcaagttaaatgattctagaagatatagacgaacagttggttctattgctggttcatgtattactgctgcaatcccacttctagcatcattcaagcaagaaatatgcttggccgctctggatataattgagggtggcacgttggcaatagcaaaagtagaagcagcttataaacttgaaagagaaattaaagaagcaacagaagaagcgctacaatcactatcattgtatcaactgaaggatactttggaagctaatgaagaagcggctgatgaaaacaggctgcttccggcaatgaataaaatatggccattcctggttacttgtattcagaacaggaacccagtggctgtccggagatgcttgaatgtgatcagcattgtagtgccagtttgcggaggagatttcttcacacggcgtttccacactgatgggacacacatttggaaacttctgatcacgtccccatttcataaaaagtcaaatttcaaagatgagaagacccctttacaactaccttatagaagcagttccgtgtgttcagaggattcattcgctgagacttcctatcttaaaattcagattgcagtgcttaacatgatagctgatttatgccgtaataagagcagttcctctgcactagaactcgttctgaagaaggtaagtggtctggttgtggggatagcttgtagcagtgttgttggacttcgagatgcttctctgaatgccctccatggacttgcatctattgatcctgatcttgtgtggattctcttggctgatatatactacactgctaagacagaaaattttcctccacctacaccagatttacctgaaatctctgaaattctccctcttcccatatcacccaaagaatatctatatgtgcagtatggaggacagagttatggttttgacatagatttggcttctctggatattattttcacaaaaattgattctcaatatcaaatgtatagctaaaatccgaattagcttatataatgttatttgtagcttttctatcccatttactcatcaacttccgatcttcccccacgcaacacccacatacaaatccttctaatcttatgttgatttctgacgagtgatatctgaaacagggaaaggatcatatcatgtacagaatatctggttcgccttcgacctttggaataaaatagagtaactttttctcaagaattctaattcaactgactccatttgtattttggaattttg

SEQ ID NO: 300 - DNA, 1452 bp, Triticum aestivum
acgcccactgcttgccgtgaggaagccacaagcccactcaactcaagctcgagcttcacttcagccccacaaatggcgagcagctcactggtagtactggccgccatggccaccgtggccgcgctgctgctctccccggccacatccctgcccgtcttcaccggcgatgcctccccgggcttccacgccgcgtcgtgcccgcagctggacggcatcgtgtggtcgtccgtcgaggcggcgctgcggcaggaggtggcggtggcggcgggcctgctccgcctctacttccacgactgcttcccgcagggctgcgacgcctccatcctcctcaacaacaccgccgcccgcgagacggcgctgggccccaacctcaccatccagccgcgcgccatgcagctcatcgagtccatccgcgcccgggcgcacgccgtctgcgggcccgtcgtctcctgcgccgacatcaccctgctcgccacccgcgacatcatcgtcatctccggcgggccctggttcaacgtgccgcaggggaacctcgacagcctcgcccctgcggcacaggagaaggtgttcgacctcccggcgcccaaaacggccagcgtggcgacgctagtggagtccttcgccaccaggggcctcggcgacgtcgccgacctcgtggcgctctccggcgcgcacaccatcgggcggtcgcagtgcggcagcttcgaagaccggtcgcagcgcgccgacgataccttctcgcgcaagctggccgccaactgcagcaagcacccggagcggctgcagaacctggacgtgatcaccccggacctgttcgacaacgcgtactacaaggcgttggggttcaaccagggcgtgttcacctccgacatggcgctggtcaagaacaagacgacggcggccatcgtgaagcggttcgccgagagcaaggacgccttcttcgggcagttcgccaggtccatggagaagctcgccagggtgcccaagccggccggcaacgtcggcgagatccggcgcttcagctgcttcaggagcaacgcccagcgtgccgacgctgccgtcgacgccgccggtgaggaggaggaggagggcttctccgcctccgcttgatctgatggttcggtcaagtactaccgtgagtaagatggtcgtcggcaggcaggctagctaccagtgcgttgtgttagcgtgcatgcacggcatggccgtaggccgtagccaatcgtgtttgagttctcggcatgcttcgttttcttgcgtgcagcagtgttggtgtgtgtagcaataaagagacagaggtttcgatcgtcgttgcatctcatcttgatgaactatgtcatacgtgttttctgcttcttgggcaccaaaggatcctcttgcgtgcttggagactttggaaccccgatctgtttcgtcaactaatctggatacctatgtacgtattgatagcga

SEQ ID NO: 301 - DNA, 1885 bp, Zea mays
atggccccaccgatatccgccgatgccttggtggaggctgcctcggccgtcgccgcgtacccagccatcgcgccgaacagaatgctttgcaaggacgcgccggcgccggccatctctgtcgtctcgaagcagacggtccggcccgccggcgcgtcggcggcggtcggcagtggagacctcaggctctcggtgtcggacatgccgatgctatcgtgccactacatccagaaggggctgttcttcccgccgcctcctcccggcgtgctggcggcctcgctggtgtcgtcgctcgtggcggcgctctcccgcgcgctcggcgtcttccccgcgctcgccggccgcctcgtcacgctccacgacgacagcatcgtgatacggtgcggcggcgacgacgccgccgtcgagttctaccacgcggtggcgccgtctctgtcgctcggcgacttcctggtgcccggcgccgacgtgccgacccgtttgacgaacggcctgttccccatggaccggacggtgagctacggcggccacggccgcccgctcacggcgttccagctcaccgtgctcggcgacggcgccgtgttcgtcggcttcgtcgccaaccacgccgtcgtggacggcacctccttctggcacttcttcaacacgtgggcggggctgtgccgcggcgcgccggtccgggagcccgacttccgccgcaacttcttcggcgactccaccgccgtcctacgcttccccggaggcgcgagccccgccgtgacgttcgacgccgacgcgccgctccgcgagcggatcctccacttcagtgctgccgcaatcagcgagctgaaggcgacggccaaccgctcgaaaagagcaggtcaggaagccgaggctaacggcaagctcgcgcacgacgactccagacttgaagggcgttccggtgaaatctcgtcgtttcagtcgctgtgcgcgcacatctggagggcggtgacgcgcgcgcgccggctgctggctgccgacaagacgacgacgttccgcatggccgtgaactgccggcaccgtctgcgcccggcgatctccccgctctacttcggcaacgcgatccagagcgtggcgacgacggccaccgtagccgagctggcgtccaacgacctgggctgggcggccgcccggctgaacgccaccgtggcgtcgcacaaggacggcgcgatccggcgcgccgcggcggagtgggaggccgcgccccgttgcttcccgctaggcaaccccgacggggcggccctcacgatggggagctcgcctcggttcccgatgtacgacgggaacgacttcgggtggggccgcgcgctcgccgtgcggagcggccgcgcgaacaaattcgacggcaagatgtcttcgttccccggacaggctggggacggtagcatcgacgtggaggtgtgcctcgcgccagacaccatggcgcatctcctcctcgacaaggagttcttgcagtacgtgtcctcccctgcaccgtgaggcggtgacagagtgaatgtgtggcttgttgctgcgcagctacatatagtaactggatttgtaccctttcagcagatatcaagtgcttgccaactttaatgagtttgagtgaccatgtagatgtagagaggctgttctgctgtttccttcgtgatgccgttgtaggctagcagcactagttatggcttccgagcaggtgtggcaaaacggttatgacttatgatagacggatatggtttttaggctcctttgtgttaagtaaccctagttagggttatgtgcacaaatacttgctttgtccctgaggggtctcacctctctatataaggaacctatacaccccctcataatacagagaagagaaagaggccagaggtccaaccctata

SEQ ID NO: 302 - DNA, 2007 bp, Zea mays
cggctgaccgcagcgacggcaggagaataggagatacgattgtgccgacctaatccagcggcagccaggcactcaccaaggaaacctttttaaatctggccccttgacgcgcagcgggagaggctcatcaccccgtgtgccctcgcctcgcctcgccccgccgcccgccccaatcgaccaatcccgtccatatcaaaaaaatgggaattgtcgccgccgccaccaccgccgccgccacgtgcacgtcccgactcctccaccaccacgcaacctatcaccggcaccagctcaggtactctgcgagtccgtttcctctctcgctgcactgtggctccggccggcgtgaggcggcggcccgggcgctcctgcccgaccgcgtcaccccgttctcttacggcgtggatgaggacgcggatgaccacccgcgcgaggagtgcggtttagtcggggtcgtgggcgacccggacgcgtcgtcgctgtgctatctggggctgcagaagctgcagcaccgcggggaggagggggccgggatcgtcgccgtgggcggggacggcaagctcaagtccgttaccgggctgggtctcgtggccgacgtgttcggggacccgtcccggctcgcctcgctcccgggtcccgccgccatcggacacgtgcgctactccacggccggcgccgccgcttcgctgcgcaacgtgcagccgttcctggccgggtaccggttcgggcaggtcgccgtggcgcataacggcaacctcgtcaactaccaggcgctacggaacaagctcgaggccagggggtccatcttcaacacgtcctcggacacggaggtcatcctccacctcatcgcgacgtcgctgtcgcggcccctgctcgcccgggtctgcgacgcctgcgagcgcctcgcggggtcctactcgctcctgttcctcacggccgacaagctcttcgccgtgcgcgacccacatgggttccgcccgctggtgatgggccgccgccggaacggcgctgtcgtcttcgcgtcggagacctgcgcgctggacctcatcgacgccacctacgagcgcgaggtggagcccggggaggtggtcatggtcgaccgccgcgacatgtcggtcgcctcggcctgcctcctcccgcaccgcccccggcgcgcctgcgtgttcgagcacatctacttctcgctgcccaactcggtggtgttctcgcacgccgttcacgagcgccgtaccgccttcggacaggcgctggccgaggagtcccctgccccgggcgccgacgtcgtcatcccggtgcctgactcgggcttctacgccgcgctcgggttcgcacgcgcgtcggggctcgagttccagcagggtctcatccgttggcattacagcggccgcagcttcatccagccgacgcaagcgatccgggacctcgccgtgaagctgaagctcgcccccgtgcgcggcgtcatcaccggcaagagcgtcgttgtcgtggacgactccctggtgcgcggcaccacctcgagcaagatcgtgcggctgctccgagacgccggcgcgcgggaggtgcatatgcggatcgcgagcccaccagttgtgggctcctgcctctatggcatcgacacgccgagcgagggcgagctcatctccaatcggatggacatggatggcgtgcgccgggagatcggcagcgactcactcgccttcctctcgctgggcaagctgcacagcatctacggcgaagagtcgagggactactgcgacgcgtgcttctcgcgcaagtaccctgtgctgcccacactagccgacccggccgccgagccggaggagtgagccgggagcagatgagctctgctctgctctgcttcgtctgccatacttctaggttgctgtcgctggattcagccctgttccgagtgttggacaattgtgcgcggctgtagttttatatgacgataaagcgctatgtcatggtactctaataaaaaaaataacaaaagccaaaaatttagtacgg

SEQ ID NO: 303 - DNA, 2090 bp, Hordeum vulgare
ccccctcggattccccccgccccatttattcccctcccggcccgccaacaacagcgtcccgtcatcctcctcgtccgcgccacccccgccccctctcgcctatttaaggccgccccagcgatatgctctccaggaggccgctcgccgccgcgctacgcctcgcgcccctctcgcctcccctcctcctcttcttcgcatcctcctcctcctcctcccccgccgcgtcggcttcggggcccagaggctgcagtgctctaaggatggatagcggtgctgcggaacctgcttcaacaggggcaatctggtcaacaccgtcggtggagccgagaagcatttctattgggaagcagatattctgcaataggtcactcaacatgaggaacatcaccgcagtaggatttgatatggactacactctcgcgcagtacaagcccgagacattcgaggcccttgcttaccatggcactattgagaagcttgtgaaggatctgaactaccctgtggagctgttgacatggcaatttgactggaaatacatggtcagaggactagttcttgataagaaaagaggaaatatcttgaagatggaccggcacaagtatgtaaaagttgcataccatggatttagggagatgtcgaaggaagaaaaagttgctgcttatggaagtacattgataagggattcctttgatgaacctgattatgcccttatagatacacttttctcactgggtgaagcctatctgtttgctcagcttgttgatttcatggacagcaatcctgcaaaagtaccttcaggcactgactatgcgcttatgtataaagatgtgaggtctgccgttgatctgtgtcatcgtgatggaactttaaaacgaatggttgcaaaggaacctagcaggtatatcaatgaagacttggcaattgtaccaatgcttgaaatgcttagaaaatctggacgctcaacattcttggtgacaaacagtttatgggactacactgatgttgtcatgaactacctatgtgggccatatatgtcagatgtaagctcaagtcacaaccgcaagtggcttgagtattttgatgttgttataacaggcagttcgaagccaagcttttttcatgatgataatcgagcaggattgtttgaagttgagcctgattctgggaaacttctaaatgctgatcttcagattggaagcccaagatcaagtcaacatcagccaaaaccaattcacaaagtttaccagggaggcaatgttggtcatcttcacagactactttctgttgcatctagttcacagatcctttatgttggcgatcacatatatggagacatactccgcagcaagaaagttctaggttggcggactatgcttgtaatacctgagctggagcaagaggtgaagcttctttcagaatcaaaatctactcgaaaggaacttagacaccttagaatggagcgtgattcagttgaagacacaatccatcgccttgaatggtctcttcaatttgaagatcttacagagaatgagaaggggaagttgttatctgagcatgacaatctactgcaaaagctgaagggtatccgctgccttctccgagatgctcagatgcaacatcatcagaagtttcacaaggtgtggggacagcttatgaagactgggtaccaaaattctcggtttgctcatcaggtcgagagatttgcgtgcctatactgcagccaagttacagactttgggttgtattctcccaacaagtactaccgtccgagcgaagattacatgccccatgagttcgatgtgcttggcctgtagtactagtttgtgctcatgcagaatcggagttctccattgaggtgtaggcaagcaagataggggcacaattttagcatggtactgaataacttgtttacatcctcacacaatggatgaggtttatacttggtgaaactgcacccatttccacatgtttatatactagagttgctcataggaaattacacaggtttcccattttgtacataacatgttctaacatggggcgaatgaaaccaatgttcaatgttgatcattccaactttcaaagtaaat

SEQ ID NO: 304 - DNA, 4704 bp, Setaria italica
cgagtgaccagtgtgagcggtggcagcagcagtagtagataagcaagctgcgtgcgccgcccagatgggaatccgattccggcccgcagcgcatctctcccgtcccgcgacgcgatggctgctgcggctgcggctgcggcttcgccctcggccgctcctccctccgcggcggcggcggtcttcgcggtcaacggcgagcgcgtggagctccgcggcggcgaggtggaccccggcgccaccctcctcgagttcctccgcacccgcacccgcttcaccggccccaagctcggctgcggcgaaggcgggtgcggcgcgtgcgtggtgctgctctccacctacgacgcggcgtcgggcgcggtgtcgcacgcggcggcgagctcctgcctgacgctggtgcacgggctccaccaccgtgccgtcaccaccaccgaggggctcgggggccgcggccgcggcctccacgccgtgcacgagcgcctcgcggggttccacgcctcgcagtgcggcttctgcacgcccggggtgtgcatgtccctcgccgccgcgctcgcggccgccgacgccaagaagggtgacgggaggccggctccgcccgaggggtccgccaggctcacggcggccgaggcggagcgggcggtggcgggcaacctctgccgctgcacggggtaccgcccgatcgccgacgcctgcaagagcttcgcggccgacgtggatttggaggacctgggcctcaactcattctggaggaagggtggcgcccatgcttccaagctcccgcggtatgaggaggggagcattggtgtctttccggagttcctgaaggctgagatcagagcctctgctgggattgaagggtgcacgccgccggcattgctcggaagtgggagcacttggcactggcctcggagtgtggaggagtactataagcttgtaggctctgagttgtttggcaaaagtggaacaaaggtggttgtgggcaacactgctgcaggcgtttacagagaggcagaggtgtatgataggtacattgacctgagatgcatcccggaactgaatttggttagtaaggaggccaagagtgtcgaaattggagctgcggtatcgatttctaaggcaattgaggctttaagagaagatggtggctgcaatgatgtgatcttttgtaagattgctgatcacatggagaaggtggcttctccttttgtccggaacacagcgagcttgggtggaaatctgataatggcgcagagggaccagtttgcctctgacatcgcaacgatccttcttgctgccggttcatcgttacgcatccaggtatcatcagaaaggttgaccatcacgttggaggaattcctgcagatgccaccttgtgattacaagacgctgctattaagcatttacattcctcgttggactcccattggtgacttatctggggatggaaccatggataggacagtaagtacaagaggaaattctgttctatttgagacataccgagctgctccacgtcctctgggcaacgcagttgcatatcttaatgctgctttcttggctcatgttgcttcagatggaacttcaggcagcataatattgagagagctatgtctggcttttggtgcatatggaacccagcatgccatcagggctagcaatgttgagaaactgttagtgggtaaacccattactgcatcggtattgcttgaagcatgtacacttctcaagaaaacaattgttcctaaagaaggcacaagacatgctgcgtatagatcaagcttggcagttgcatttctgtttagttttctttgtccagtgaccaaagaaactttgaagcctgtaaaggcagttcatcttaacggctctgtgccttctggcaccaatggaaatccaaattgtggacctgatgcgcgtgttgatgcttcactgaagaagataaataatgtgaaacccggttcatatggcaatgattgcatacttgaatattcaaaacagaaaattgaaatcaataaagactatctcccagttggcataccagccaagaaagttggagcagcactccaagcctctggtgaggctgtgtttgtggatgacatcccctctcctaaggattgtctttatggtgcctttatctatagcacaaaacctttagcccatgtgaggagcatagaactcaacccgtctctcaagaaacttaatacattgggcatcgtcactgttaaggatatcccagaaggtggcagcaatgttggagccaacactatctttggacctgaacctctgtttggtgatccagttactcagtgtgctggggaacctcttgggattgtgattgcagaaacacaaagatttgccaatatagccgcaaaacaagctgttatcgactacaatactgagaacttaggtgctccaattttatcgatagaggatgctgtaagaagatgcagttattttgaaaccccaccatttcttcttccccaaaagattggtgatttctcacaagggatggcagaagcagatcagaaaatctactcagcagaggtgaagcttaattctcagtactacttttacatggaaacacaaactgctctggccgtacccgatgaggatgactgcatggtagtgtatagctcaagccaatgccctgagacaacacaaaatgtcattgcaaagtgccttggtttaccttgtcacaatgtccgtattatcacccgaagagttggaggtggctttggaggaaaagctgttagatcattgcctgtggcgacggcttgtgcacttgcagcatttaagttgcatcgtcctgttcgaatgtatcttgaccgcaagactgacatgatagtgagtggaggtcggcatcccatgaaaatatgctattcagtgggattcaaatcagatggaaagatcactgctttgcatctagatttgttcataaatgcaggaatgacaacagatgttagcctgataattcctcacaatttcattgaagcactgaaaaaatataactggggtgccttttcttatgaagcaaaggtctgtaaaacaaacactgcaacgaaatctgcgatgcgtgggcctggggaagttcagggctcttatgttgctgaagctatagttgagcatgttgcttccgcactctccactgatgctaatttggttaggcagagaaatcttcacacaattgagagccttgctttgtttcacagtgagtgcactgaagatgacatgggttatacacttccctctatatgtggtcaattgactgcatcagaaaatttccagcaccgtcttgaagtagtcaagtctttcaacaaaaataacagatggaaaaagcgaggcctctcttttgtgccaattgtgcacaaagtattatctcgaccgacacctggaaaagtgtcaatccttaatgatggttctattgctgttgaagttggaggcattgagttaggccaggggctttggacaaaagtgaagcagatggcagcgtttggtcttggacaactgtgggctgatcgaagtcaagagcttttggaaagaataagagttattcaagcggatacattgagtaatgtacagggagggtggaccacagggagtacaacatcagaatctagctgtgaagctgttcgtcttgcctgcaatatcttggttgacaggctgaaattagtcaaggagcaatttcaagaaaaacaaagcaatctttcatgggatgaacttatttccaaggcaaaaatggctggtgtggacttatcagcacgagaatactacattcctgggccttctggttcttatctaaactacggagctgctgctagtgaggtggagattgatcttctcactggggccaccacgattgtgcgaagtgatcttatatatgactgtggccagagcttaaaccctgccgtggacttggggcaggttgaaggggcatttgttcaaggaattggctattttatgaccgaggaatatgtcaccaactcggatgggttggttatatctgacgggacttggacatataagatcccaactgtggacactatcccaaaacaattcaatgttaagttgcttaacagtggattccacaagaaacgggtgctctcttcaaaagcatctggggagccgcctttgcttcttgccgcttcagtgcactgcgcgacaagagaagccatcagagcagcaaggagggaaccccactgctctgcttctggaccttcttcaccttcccatttcgatctggaggttcctgccatcatgcccgtggtgaaggaactctgtggcttggacaatgtggagaggtacttggagagcctgctgagctccaaatgaagaaccaatccaagtcggcacctgtttttcccaactttacttagctgtgtaatacgattaggttattgcgcggttcggcatgttccaaagttcaaagagaggagaggttcatagctgtagtctgtagatggtgggtgttgtgttttaaggactagcaaagtttggcttatctggggctgggggagcacattttgtcttgggagcatgaaatagactttgttgtttgctcgagtgtagatctttgaggatatccatctccactaggtgaatggtgtccacaagcaatatagttcagagtcagacacggctatagaggataacatacttgcagtgttaatttatgtttctttttacttcgaatgtgtatcagttgaaatttaa

SEQ ID NO: 305 - DNA, 618 bp, Gossypium hirsutum
ttctcagcctgggggccggtcaccggccgatcgtcggccactgtctgtcgccggcgccagccacagcgcacggtggccggagaaggtactggggcggtggagcagagagtgggtgaacggtgggtggctgaatgttagaggattcggcgtcacaagctaggattagggtttaggtattttttgtttctgatttgtggtattgggcttagtgtttagttgggctaagggttttgtattgggtttgggtaatgggtaggtttagtttgggttcaaaattgttgagatttaatgtattgggctgagtaatttagggtggcccaaaattggcctttaacacatgggacccaagtaaactagtttataattttaaaatctttaagggactaaaataacaaattttcattttggtgctagggtccctgcctccccccttggtgccatccctgaatgtgcatgttagtccctggcctacgttatacatatgccttgtttgggttatgttcggttctttgtttgctatgcattatattagttttattctatattgtaacttgtcagacatatatttctacttgtaactttatgttctttattattagtgaaactttaataaaaaaa

SEQ ID NO: 306 - DNA, 895 bp, Setaria italica
ggggcctaggatgaaccatttggatgttctatttgtatgattttgatgattacaaaaccattactgccttccttctgaggcctcttcggattatttttttgttctttgtatttgtttttggtattttctgagatcgatatatggtgctttggtaaggtcgggtgatgagtaccagtgcatagttcagatgatataaccctcgtggttgtgattactttgaacaaatagtctttcgctcctaactgacgaccttatcaattcccaatctctgactgttgttccgtgttcttccaattccaataattttgttgtcttagttgctaactgtgatgttagattgtgacatttaattgttatgaacgttttccagacgatgtttgtatcttcaaatggagaattaaccattttctgcaattcttgcataacaatgtagtactttgcaatctaaaccttatttccgacgtgattttagcatttgtttcatatatgatggttctgcgactacgccattcagatcttaaatgtagacgttccaagctttgttagctggcaagcgacgtcggtctgaaactctgaatgaacagactctctggaattagctggaactcgaatgagaattgcaccattttatgtacgcacaaagcagtttctgattatggattcgaatcggaaagcagtatgagatggatggtggctgtaatttgttttagaatttagctggaatttcagtttccaaaattttaaccaaagtttgtttctgcggtaggattttagtatgatgaaggcaattgagatgcgtgttagtttgagatggcacaatctagaccggttggaatgtaatttgacctggtgatgtaccatgtttgacttggagtaatcataaaattggtttttg

SEQ ID NO: 307 - DNA, 271 bp, Gossypium raimondii
acgaccttacttgaacaggatctgttctataggctcgtacctctgtgtccttaagctcaaaggagacaggattccaagtctggttgatgaaccaggactgtgtgacctgagcgtgattattggtctggtgattcccttgctggtttgacttcgaccgcagaggatcgttctcagcttgccttgggcggctgggaaggtcacgcagttgtctgacagactcttacgccttttttttctgctttttccatttgaatttgcaggcttattacag

SEQ ID NO: 308 - DNA, 431 bp, Zea mays
tacagacgtgctcctccttctcccctccccttgtccacagcccccgtagaccatggaagatgcatggcttgagcatctgcatggttcttgagagttaaagctgcacgacgatggatagtggaaacagagcttctcaagaagcattcgttttcgtggtgcctttcctgacctccttggtggtcagctgaggtgcgcacaaaccggcaagtcacaatacggcaatggcggactccattaggagtcgtccttttttatttctttacccctttttacattctagttgtgtgattgtgtcaggcggaagctagaagacaaataacctaagtattcatgtgtgatggattatatacgtatacattggtgagacaatgtttgtctcatgtgtactccagtctccagaaacaagctgctataaatgaattgttgcttat

SEQ ID NO: 309 - DNA, 225 bp, Zea mays
ccacgaccttacttgaacaggatctgttctataggatcgtaccgttgcatccttgattgataaggaggcaagcacttaaacctggttgatgaaccatgacctgtgggccagagcgtgattaacggccaggaatggctctgatgccctattccagtgctgtagatgatcgttcctcgccagttctaacctagctagggtggctcatgggttgtctgacaggttctt

SEQ ID NO: 310 - DNA, 1227 bp, Sorghum bicolor
tcaaccctcgtgctctcgccgcagcgctcgccacttgccccgcaccactcgctcggccctcccaatcctcgcgcctccacttcgtgttccacaacgcgagccgcaaggtgcggctgtgccccctccattgatcgaggcggcggtggctcttcaaatccaaggagtacgaggctgcggcggtcaaggtgtggatctggtgagggaggcatcgatctgccatctgttcccgaaggcgtgcagcgctcgccacttgccccgcaccactcgctcggccctcccaatcctcgcgcctccactttgtgttccacaacgcgagccgcaaggtgcggctgtgccccctccattgatcgaggcggcggtggctcttcaaatccaaggagtacgaggctgcggcggtcaaggtgtggatctggtgagggaggcatcgatctgccatctgttcccgaaggcgtgttggatccggtgagggaggacgcattcaggatgaggcagctggagtggcaacgagctcgagcctaggagttggcggcagaagagggtgctcgaccattcctcccctgcatgacgtgcttcattccatggctggagctgcacccgtcaagcaagcacgagcccagcagttagcgccggccgtgaagcagcctggcaatgatagcgagcagtcagccaacttcaccagtgcggtgaagtccagggtgtctgatctgaatgatatatggatctgggtaccctagtcaacccatgcatattcgaagtggcgcttatgattctcactgcagaaatttccatgaagacaagactaatttgtaatgggctgagctacgtacaacaaactgctgctgggatgtaacctagatagtgcgaaggactccttttgtgtagtctgacatgctcctacaaactcaaatataagtaggtgctaaacttgctttgtagtcgactctgatcagtcaatggcacttgtatttagacggcttataaaaaagtgatcagttatatgtttattcagtgcaaatattttgatttctgggtggatgtataaatggtggcattgtgtataactgtattctgattatgagaggtatatgttcctgtacacatggattttctaacgtcattatttcctgacagttcattgtcagggaacctagtttgatggatcagtcctaagccgtggcatgtatctggtagtgtgagggaatccaatagtgtgagctggctctgctg

SEQ ID NO: 311 - DNA, 1156 bp, Arabidopsis thaliana
cgtcaagaggttgaagcaagacaaaaatggtgaaaacaaagaaagaagatctaaatcaatttctgattcctcgtctcaacaccatctacgaaaccctccagttgttcgatggaacagcttctcctacagtggaaagagttaattggaacgatgttcttcagatgtctgatcacctctctaaacaagccaccatagtgggaatgctatggactggagaatctccaaaagctgattcacttaaagagactatggagtcttacttcaatgcccttcaagggtttttactctgttgccatggaagcactcttggtgctggacctacgctttcttcaatcatacatgtttctgttaagcaaattgttgattctagcttcagattgttgcagggttctgtttctctatacgagggatcgtatgagaaggataagaagccgtctattccgcagctctcgggagtggtttgggaagcatgttccagtttcaagaaggttcctgcaacaaacattactgcgattggtagagctattacacaggttgcggtttccatgaaggatgttcttagggagatgaaagaagtgaagccagcgtgtcctttatctgaatgtgaggcatctggtgataatatgtctagtgatgatgatgatgatgacgatttaggcgatgatttgtctcctgaagaaatggaagttgctacaatggttactgagattgtctctgaaactatcatggtgataaaagaactcattcgagttatcactggtatgattaagatggagaatccaaaggataatagtgggtttgtggagtcgcttgagaagctactgaagctgtgtcaaggaactggtgtacaaatcgatgagcttggtgcttgtgtctatccaccgcaggagatgaacaagatgaagcaaacagtgaaggttatacagggaaatctagacgaatttgaaactgaagttgagcgtttgaagagttcttcagacggcttttcgggagcttgcgggaagctgcgaaactccttgaaacatatggaaactgaattggataaaagatgtgaagctgagctagtagttgaaatgcagaatgttactcttgacagttagtttggattttgcaattgagttttttttcggtttgtttcagtggcttgtgtcttgta

SEQ ID NO: 312 - DNA, 1939 bp, Arabidopsis thaliana
acgatctgcttcatttctcctcatctacgagtgagagaatttgtcaatttagcttctttagttcggtctgatctgaattaattgcaatcttctcggttgtgtgagagaatcaatcaccatgtatcggcttgtctccaacgttgcttccaaagctaggattgccagaaagtgtacaagccagattggaagcaggctcaattctactaggaattatgcagcaaaagacataaggttcggtgttgaagctcgggctttaatgcttaggggtgttgaggatcttgctgatgcagttaaagtcactatgggacccaagggtcgtaatgtcatcatcgaacaaagctggggtgcaccaaaggtgacaaaggatggtgtgactgttgccaagagcattgagttcaaggatagaattaagaacgttggtgccagtcttgtgaaacaggttgctaacgccacaaatgacgtagctggtgatggaacaacgtgtgccacagtccttactagagctatcttcacggaaggttgtaaatcagttgccgctggaatgaatgcaatggacctaagacgtggtatcaaattggcagttgatactgttgtgacgaacttgcagagccgagcacgcatgattagcacctctgaagaaatcgcccaagttggaacaatatcagctaatggagatagggaaattggtgaactgattgcaaaggctatggaaactgtcggcaaagagggagtgatcacaattcaagatggcaagaccttgtttaatgagctggaagttgttgagggtatgaagattgacaggggatacatctccccgtacttcataactaacccgaaaacacaaaaatgtgaactagaagatcctctcattcttatccacgagaagaaaatttccaatataaacgcaatggtgaaagtattagaactggccctcaagaagcaaaggccgctgctgatcgttgctgaggatgtggagagcgatgctcttgccaccctaattctgaacaaacttcgtgctaatatcaaggtctgtgctgtgaaggcccctggttttggagagaaccgaaaggccaatttacatgatctagctgccctcactggagcccaggtaataacagaagagttgggtatgaatctagacaacattgacctcagtatgtttggaaactgcaagaaggtaacggtatccaaagatgatactgttgttctcgatggggctggtgacaagcaagcaattggggaacgatgtgaacagatacgatccatggttgaagcaagcacttctgattatgacaaggagaagttgcaagaaaggttggctaagctttcgggtggtgttgctgtactaaagattggaggagcaagtgagacagaagttagtgaaaagaaagatagagtaacggatgctctaaatgccactaaagcagccgtagaggagggtattgttccaggtggtggtgttgctcttttgtatgcttcgaaagaacttgagaagctttccacagctaactttgatcagaaaattggtgttcaaatcattcaaaacgcactcaagacacctgtttacacgattgcttccaatgctggagtcgagggtgcagttgtcgtaggcaagcttttggaacaagataatcctgaccttggttatgatgctgctaaaggagaatatgtggacatgataaaggctggtattatcgatcctttgaaagtgatcagaaccgcattagttgatgctgcaagtgtttcgtctttgttgacaacgacggaagcagttgtgactgagattccaacgaaagaggtagcatctccgggtatgggcggtggtggcatgggcggcatgggtggcatgggcggtatgggaggaatgggtttctgaggagaactataaaccctgagtagggttctttggaatctgttgtgagagatgctacggttggtt

SEQ ID NO: 313 - DNA, 362 bp, Hordeum vulgare
tcgtcatgtccggcgtgtgggtgttccgcaacggggtggtgaagctggtggagaaccacccggcgtcggcggcgggaccgccgggcggcggcgcggtccggcgcaaggcgctgctccacacgcccacgggggaggtggtcgcctcctacgcctcgctggagcgcaagctcgtcgcgctcggctgggagcgctactacgccggcgggggcggcgccgccggcgactgcatgctcaggttccacaagcgctcctccgtcgacctcatctccctccccaaggacttcggccagttcagctccgtccacatgtacgacgtcgtcatcaagaaccgcgacgccttccgcgtcatcgacgtctagtag

SEQ ID NO: 314 - DNA, 2082 bp, Hordeum vulgare
ccgcatcgtatagtcatccagattccgggctccagctaagccgccagaccgccgcatctccaccgcatctccaccgcttccccctaaacccacgccgccgaccatggcatcctcctccgctaaaccctactgctgctcctccctaaaccccgcccactccacccccgtcgccgggcgcaccgccctctccaccctccccgctgccaagccccgccgcttctcacatggcctcgccgccgtcgccgcgaaccctagggcctcccgcaccgccgtcctccgctctgtccacgcgtgcctggcggcgccgcgccggccggagtacgtcccggaccgaatcgacgaccccaactacgttcgcatcttcgacaccacgctccgcgacggggagcagtccccgggggccaccatgaccagcgcggagaagctcgtcgtcgcgcgccagctcgcccgcctcggcgtcgacatcatcgaggcgggcttcccggtgtcctcgccagacgaccttgatgccgtgcgatccatcgccatcgaggtggggaacacacccgtcggggaggatggccatgtgcccgtcatctgcggcctctcgcgatgcaacaagagggacattgacgccgcctgggaggctgtgcgccatgcccggaagccgcgcatccacaccttcattgctaccagcgagatccacatgcagcacaagctgcggaagacgcccgaccaggtggtggccatcgctagggagatggtggcttatgcgcgcagtcttggatgccccgatgtcgagttcagccccgaggacgccggcaggtcgaatcgagagttcctgtatcatattctagaggaagtaataaaagctggagcgacaactctcaacatcccagacaccgttgggtacactctccctcatgaatttgggaaattaattgctgacataaaagcaaatactcctgggattgaaaatgcaattatatctactcattgccaaaacgatcttggtcttgcaagtgccaacacattagcgggtgcttatgcaggagcacggcaattagaggtgactatcaatggtattggtgaaagagctggaaatgcttctttggaggaggttgttatggcaattaaatgtcgacgagaactcttagatggattatacactgggattaattcacaacatattaccatgacaagcaaaatggtacaagagcacagtggacttcatgtacagccgcataaagctattgttggtgccaatgcctttgctcatgaaagtggaattcatcaggatgggatgcttaaattcaaaggaacttatgagataatatcgcctgatgatattggtttaacacgtgcaaatgagttcggtattgttcttggaaagctcagtggaaggcatgccgtcagaactaaactagtggagcttggatatgaaatcaatgacagggaatttgaagatttctttaaacgctacaaagaggttgcagagaaaaagaagcgtgtaactgatgaagacatagaagctttactgtctgatgagatatttcagcctaaggttatttggtcccttggtgatgtacaggcaacatgtggaacacttggtttatctacagcaactgtcaaattgataactttagatggagaggaaaagataggttgttctgttggaactggcccagttgatgcagcatacaaggctgttgaccaaataatacagattccaactattcttagagaatatagcatgacttcggtcacagaaggcattgatgcaattgcaaccactcgagtagtcatcactggagatgtcagtgccaataaatatgctttgactggtcactccaatcgatccttcagtgggagtggtgcagccatggatgttgttgtatccagtgtccgagcttacctgagcgccctgaacaagatgtccagttttgttggcgctataaaagccagcagcgcagcacctgaaaccctaagtgctcagaccacagaatgagtgtttacatcacatttcttttctgttatttcatccccggagcaatgtgaatttacatgttagtaaagagctgtttggtagtgtaagggactggg

SEQ ID NO: 315 - DNA, 755 bp, Hordeum vulgare
gctacgcaaacccttctccccgcgccgcgccgccacccccaagaacctcatcggctccggcctttgatctcctcctccggccggcagaggcatcgaatcccccacgccacatcctccaatggctaccaagtcccaaaagaagaagaagccctccgcccccaacccctcaatcgacgccaagaagcccgaccctcaggaacccgcggagacgcgagagacggcggcggcggcggccaagaagaagacgccgaagaagcagaaggagagcaaggaggtctccgccaagaaggcgaagcagcagaaggagggcaaggaggtctctgccaagaagccgaagccgaagaagcagaaggagagcaacgagatcgacgagatcttcgaggccactaagtccgacaagaagcgcaagttgcaggaggaggaggaagaggagtccgagggggctagcaagaaggccaagaagggcaaggccgaggggggcagcaagaagaagagcaagaaggaggccgggggcagaggctgggagcccggccacgacgaggtcgaggagaagcggccgcggcggcgcaccaacgacgggctcaccatatactccgccgacgagcttgggttcggcaaggccgacgccggcggcaccgccctctgccccttcgactgcgactgctgcttctgagcctttcagttcaggggtcctccctgcctgaggtgatgtactcaggtgacattcgtcgtcgtggtgtttgttgtaatgctcg

SEQ ID NO: 316 - DNA, 865 bp, Hordeum vulgare
acagcagtacgggccaacgagccgactcccgattcatcaatggcgtctagcgacgagaagcctgttccgacgccggcctcaaccggaggcgacggcgggccggcggggaagccgacgaccacgtcgacgatgctgctcgacaagggcgcggcggcgctgcagtcgctccgccccgtgaagcagatcaagcagcacgtgtgcacgttcgccctgtacgcgcacgacccgcaccggcaggtggagacccaccacttcgtctcccgcctcaaccaggacgtcctccagtgccccgtctacgactccgacgacaagcacgcccgcctcatcggtgtggagtacatcgtgtctaggaagatcttcgagtcgctgccggcggaggagcagaagctgtggcactcgcacgcgcacgagatcaagacggggctgtgggcgaacccgtgggtgcccagcatgctggggaaggcggagctggaccacatggccggcacgttcggcaagttctggtgcacctggcaggtcgaccgcggcgaccgcctgccgctcggcgcgcccgcgctcatggtgtcgccgcaggcggagcgcgtcggcgccgtgcgcccggacctggtgaggaagcgcgaccagaagtacagcttctccacggaggagctcaaggccgccagggccgacgtggaggtgccggcggagccgcgcccgggccaggccgactactgggtccgccaccacaagggcttcgccgtcgacgtcgtgccgcacgagatgaagcgccacgcgccgtttccgtgagcgaccccgttcctcggcgccagaagcgtcagcacaagtggggtagagcgcttccgtgttagtgtgtgaaactgtgcgc

SEQ ID NO: 317 - DNA, 582 bp, Hordeum vulgare
tctgagagatcacaccttcagttcaatcttgagccggttctgttcgatcgatcatctatgtcgtctggcctctccttaccggcgacggtgcggccggcatcctccgggcttggggggcgccagctttacgcgtcgccgccgcgccacggtacgaggaggccatgccgcggtctgctggcgctgcgaccgagcacgaggagctgcgcggctttcgggcaggaccactacgggggcgcgctggtggacgtgggcatggcggtgctccggcggaggatccgggagacgcggatggcggagaccaactacgaggcgccggcgggatgggcggactgggagaagcgctactacccggcatacgtctccgacgtggccgcgcttgccggagcgctgcagctgctggccatgggcaccaggcctggcgtcgctgcggccgtgacagcactgctgctcgccggcgtgcccatctccgctctcgcagccttgcacctcctcggtcaggcggtgggatccgttctgcaccatgtttcttgatcgactcatcattcattcgtacgcaatgtgtgctctctgtgtctatattag

SEQ ID NO: 318 - DNA, 1647 bp, Hordeum vulgare
ccatccatctacaagcagcagccaccaagtttctgtcaagatggggttgtcttcagccgctgatatcgatggggcgcagctgtgtatcttcgacctgaggagagggcagcaggaggggcaggagctcgacaagatcctcttcttccacccggctgactgccccatcctgctccagctctccgtcattggcctctgtgaaggaatcatcactttcacaagaatattttctccagaagatgactgtgaggtgatagaatctgacaaacactcccacgttttttaccaagctgagccagatatttggatggttctggtagtgcagaaaattaaggacaatgaatcaactttgcgctttggtgcattgcaaggaatactgaaagaatctcattcgcttttcgcaatgtttcatggacccattcgaactttacttgacagacaaccaagtgctgaatttgcccgtggtcacctccacacatttgtcacagattatttgagcgattttagtgttggcaaaaagctacaattgccaacctaccgtgatagcctaacggagcggggaacagtccaaatgctaacagtctcacgagaagtggcacttgaagttcagtcgctcaccacagttcttgggtcatgtcttcgaaatgtaatctgccaatcaattgtattatttgaggacctcttggtgtctacgacacttcccctggatgatacattaaacctatacacttatgctatcctgcggttgactcctagtgctttatcttccaacgggaattcatggtcctatttgcggaaagggggttatgttaatgctgacaccactttaagttcggcaaatggagcagctgcagcagagaggtatcatagtcgatctcgtgacacttctcctggtggacaaaatcagatgcaccataatttcaggcctcttcagcgtgagaaattgtccaagggaaaagatggttttgttgctgctgactttgcaactacagaaattcgtggtgctgtaccgttgaatccaatattgtggtttcatcaggcagaggagcgcatgtatttatgcgtttatcagcacaagaaccttactatcttgctagtgattccagcttcctcactgataaatggagaagagggcattgctcatgtgaagaggcatcttcttgaaaatgcatcacagaacattgtcagtgttgaacaaaaattatcacgaggatggggaggagaaaatgcctatcatgttggtggataccgctacatactctctgatccaaacagaaaagtatcaagagcctccccacctgggaaagtcatcaccctgtcaaaggattctctacttgccctcaacaggctaagaggagaagtagatcttgagaagtcaagagctaagaggagtgaccctacccatgacaaggattatgaagtatgcatcagagcgaaaaataatgcatggattattgctaaaatttctcgaggaaaagaactctatatggctatagagaagggcggcgaaacacttctctacgcatctacagctgttgagaaattcagcaacaggtactgcgagggggcattctctacagactgaacgcactgctagtatgagatccagtccagcactgcacatggttctcgactggatcactcccttac

SEQ ID NO: 319 - DNA, 1694 bp, Hordeum vulgare
attcacacacgctctccctcccccacctccgttccacggctcgcgttccttcgctggcaggctagcagatctccgatggggtgcttccagtccaagccggcggggaagccgctgccgcccgacgccgacgccgccctcccgcccgacgaccccgcagatcccgaggcggcgaacggagcggacggggcgggcgcggacggcgacgagaaggacggggcgaagcgggcggtgccggtgttcagggagttcgggctcgccgagctgcgggccgccaccaagggcttcagcgccgacctcatcgtctccgagagcggcgagaaggcgcccaacgtcgtctaccggggccgcctcgacggcggtcgcctcatcgccgtcaagcgcttctcccgcctctcctggcccgacccgcagcagttcctcgcggaagcggccggcgtggggaaggtgcggcacaagcgactggtcaacctcattggctgctgcgccgagggtgacgagaggctgctcgtcgcggagtacatgcccaacgacacattgtccaagcacctcttccactgggataagcagccgttgccatgggaaatgcgattgagggttgcacattacattgcgcaagctctcgatcattgcaatgcagagaacaggaaaatctatcatgacttgaatgcctacagagtactttttgatgaggaaggtgatcctcgcttgtcaagtttcggactaatgaagaacagccgtgacggcaaaagttatagcaccaacctggcttacacccctccagagtttctacgaacgggcagagtcatcgctgagagtgtgatatatagctacggaacagttctgttggatcttttgagtgggaaacacattcctcccagtcatgcacttgatttgataaggggaaagaacatactgctattgatggattcctccttagaaggacaatatgctaatgaagatgcttcaaaattagttgaccttgcatcaaaatgcttgcagtttgaagcaagggacagacccaatataaagtatttattgtcttctgttgggcctcttcagaagcaaaaggaggtggcgtcacatgtgttgatgggcattacaaaaactgcgtcggtcttaccaactattctttctccacttggaaaggcctgtgccggaatggaccttacagcagtacatgatatattgctgaaaacaggttacaaagatgatgaaggtgcagaaaatgagttgtcctttcaagaatggactcagcaagtgcaagagatgctgaacacaaagaagtttggtgatattgcatttcgagataaagatttcaagactgcaattgactactattcaaagctagttggaatgatgtcagtgccttcagctacagtttttgccaggcggagtttttcctacctgatgaacggacagtcggagcttgctctacgcgacgcaatgcaggcccaggtctgcatgcctgaatggcctaccgcattctacctccaagccctagctctctcaaagctcggaatggaaaccgatgcacaggacatgctcaatgacggagccacctttgaggccaagaagcaaaacagctggcgtggttagggacgaagccactgcttcccccaaactgttgttgcctttcaacagaaaagggtacaatgatgagtgttcactgggacgtctgatgagctgctaggagt

SEQ ID NO: 320 - DNA, 2696 bp, Hordeum vulgare
cggccatggcggcgaccaccgctacccccaccttcctccgtgcgaccgagctccgcctcctccgctgcaccctcccttccccgatctcccaaccagctcccccctcacctcccccagaacacccgctcggtcctgtcgtgtcctctgccgtcgccgccgtcgaggtcggggactacgtggctgctatcgcctccgccgtcccccacatcttccacccctccgccttcgccgaggttgcccagggctccccaacgcaagcttacgccgacctcactgccgctgccgaggcgttcctccgggaggatggcggaggggccgcgagcgaggggttccagtgcaggtgtgcgcttgttctctccgcggcggtggccgcgctgctcgcattcacgcagcagaacgtgacgggaccgtcggggaagtttccacccttccctttccagacttcacgtttggacgaagaggggcatggtgatcctggaagcaaatgggatgattgggcttcgggtcatttagctgcttttggttcccatgttcatgggaaattcgctctcttgccgttcattgtctttgcagaactactcttcacaagcatacagggtctcgactcctctgattgttggagtgtgcaatggtggttgtgcagaatatccttgtcccagcaaaatattttagatgagctatcgtcctctttgtttgatcgagtacaagtgtacaagaatgaaatgttggcccactttggtgaacttgaaaaggtctctagctactggggttctttgttatgtgatgaagaagggttttcttttgtctcagctgtttttctggaagctggaatcgtggagtataaatatggccaagttgatgcttcaaggctgcatctggatagtgctcaagaggcatgtgggattcatctctctctcacagggattcttggttttcgaacaatacaccaggtggacgccaagtcccaaatggttctagttgcgaagactactaaatcagcagctgatgatggccaatcaacagagctagcaggatctcagagtgatggtgtggcttcccggaacgcagggagctctgttccaagtgaaagtgatgaattttgtgatatactaagaacaccaagactggctgaaaatgggaatgaaacgagcggtgagagtatgacatccgcaaacacacagatatcgctatctgctatccagcaggccgctgtacttgcacaatgtttatatgtgagtcggaggagtcggagtgatgaaatgtctgggtgggagatggcaccatacatagagtcaattgattctcaagaaaaatcatactttgtggtcaggagcttgtgtgatgttctgcgtattaggtgggagtccacgcgcagtcggacaaaacagcgggcactgttaatgatggagaatttggttgaagatattgccaaagaatttcctgtagtttcacaaagaaccaaactggtttttggagttcatatgccgcctatccctgcattaaggaaagagtatggtgaacttttgataagttgtggtttacttggtgaagcacttaatgttttcaaagaactcgaattgtgggataatctaatctattgctatcgattatcgggtaaagttgctgatgcggtcagtttaataaatacccggctctctgttacaccaaatgacccaaggttatggtgttcacttggtgatgctacaaataatgatgatcattataagaaagcactggaagtctcagataacaagtctgctcgagctctgcgctctctggctcgcagtgcatacaacaggaatgacttccatacatccaaaattctttggggatcagcattggcactgaattctttgtatccagatggctggtttgcctatggtacagctgcatggaaggataaagatcttgagaaggcagtggatgcttttagtcgtgctgtgcagatagatcctgaaaacggagaagcatggaacaacatagcctgtctgcacatgattagaggaaagagccaggcagcagtccaggcattcaaggaagctgtaaagttcaagaggaatagctgggaagtttgggaaaattacagtaaggttgctttggacacatgcaacatgcgactgacacttgaagctgtcaaaatggtattgaatctgtcctcgaacaagcgcttcaatgttgatctattggacaaggtgatggtctctgtcgaagaacaagctagacatcttagtgatactcaagaagctaaatccataagcaacgcttcagatgatgcaaataaagagaccaggctaccaaatcaattgctaggtgtaattggtgatatccttcagcagattgtacggagtggggctagcaatgcagagatatggggattatatgcaagatggcataaaagcaagggcaacctcatggcatgctctgaagctttgttgaagcaagttcgatccctccagggttcaggattatggcatgatcagaagaagttcacgaagtatgctcaagcttctctgcaactttgcaaggtctatatcgaaatttcctccacgactggaagcagacgagaattattgtcagctgagatgcatcttaaaagctccttaaaacaggcaacggacttctcaggtacggaggagtataaatcacttaatgactgccttgaccaattaaggggcctgattggcgctgcatagtag

SEQ ID NO: 321 - DNA, 569 bp, Hordeum vulgare
agcagacagcatcctacctacgatccgagatactgaattttccctcaggtacaaaatcgaaagcaacacctacaatgtcgatcgtgaggcgtagcaacgtgttcgaccccttcgccgacctctgggcggaccccttcgacaccttccgctccatcgtcccggcgatctcaggcagcaacagcgagacagctgcgttcgccaacgcccggatggactggaaggagacgcctgaggcgcatgtcttcaaggctgatcttcctggtgtgaggaaggaggaggtcaaggtggaggtggaggacggcaacgtgctcgtcgtcagcggcgagcgcactaaggagaaggaggacaagaacgacaagtggcaccatgtggagcgtagcagcggcaagtttgtgaggcgcttccgcctgccggaggacgccaaggtggaggaggtgaaggccgggctggagaacggtgtgctcaccgtcaccgtgcccaagacagaggtcaagaagcccgaggtgaaggccatcgagatctccggctgagtattcgagtcggagccattctggttgatgtgtgtgtag

SEQ ID NO: 322 - DNA, 1031 bp, Hordeum vulgare
tcagatcgagagctccacagcagcgttccgcattcggatccagctgccgaaggaaggaccagccaggcgatggcggcgacgcaccacccggcctccccgaccggcggcaagccctcctccccctcgcccccgtcgccggtgcgcctggcggcgtcgcaagcggcggcggtggcggcgatccagcccagctcgccgcgctacttcttctcctccctggcggcctcctcgtcgccgcaccgccgcatcgccatcgccgtcgacctctccgacgagtccgccttcgccgtcaagtgggccgtgcagaactacctgcgcccgggcgacgccgtcgtgctcctccacgtgcgccccacctccgtgctctacggcgccgactggggctccatccccgtctccgtcgacgaggagggcgccggaggcgcggccccggcgtccgaggacccggaggacgacgcgcggaagaagcgggaggaggacttcgacgccttcacctccaccaagtcgcaggacctggcgcagccgctcgtcgccgcgcagatccccttcaagatccacatcgtcaaggaccacgacatgaaggagcgcctctgcctcgaggccgagcgcctcggcctctccgccatgatcatgggcagccgcggcttcggcgcctcccgcaaggctggcaacggcaggctcgggagtgtcagcgactactgcgtgcaccactgcgtttgccccgtcgtggttgtcaggtaccctgatgacgccggggcggcgggtggtgccgactctgtgggggatgagctgcggacggtgcctgagaatgaggtcgtgttccatgaggcgccggaggggcagaaagaaaactgagaaggtaatagcgagcaccaagcagcctgatcacgagagagcaagttttgcttgatgccaagccatctgtaagctgtaactgagtggtttttccactctgctttccgcttgagtttgtgtcagacttgtagatcatggacctgtccttgctgtttcgcttcctgagaactgaaatgaga

SEQ ID NO: 323 - DNA, 1861 bp, Hordeum vulgare
gtggatagataggcagcgagtgatagatctgggggaggcgcagatctgactgaccggccggtgctcattctcttcccgccggtgagagtttgtcggggcggccatggggaagaagggcaagtggctgggcgccgtcaagaaggtgttcagcccggagtccaaggagaagaaggaggagaaactgaggaagaaactggctgcaagagaccccagcccaccagatcttacaccttctacttccttggaagtcaatgtttcgatgccgccgccccctcccgcagttccttctccgcaccaaactgaggaggttcaggtccgtgatgtggagctggagctggagctggagctggagcaggagcaggagcagagcaagcatgtgaccgtggaggcagcccctgatgctcctgctcagacgtcggcggcattgccacctggtgtgtcgagggaagagctcgctgcaatcaagatccagaccgccttcaggggatacctggctaggagggcattacgagccttgaggggccttgttagattgaagtcattggtcgagggtaattcggttaagcgtcaagctgcaagcacactgcgttgtatgcagactctcgcacgggtgcagtcacagatacgttcaagaaggctgaagatgtctgaggagaaccaagccctccagcgccagctcctgctgaaacaagaattggacagtttgaggatgggggagcactgggatgacaccacccaatccaaagagaagatcgaagcaagtctaataagcaggcaggaggctgcgataagaagagagagagcgctcgcatacgcgttttcccatcagtggaagagcagttcaaggtcctccaacccaatgtttgtagacccaaacaacccacactggggctggagctggctggagcgctggatggcagcaaagccttctgaggccggccgcactggaaccggcaaggaaagcaacattgaccagggatcagtgaagagcatgagtttgaaccttggggagggtgagatcactaaagcctttaatcgtaggggctccaagccagacaagtcgtcaccgacgactccaaagctgacccgcccagcctcccggctatccccttctacacccactgccaaagtgacaccaatagttgtgaagaagaaacctgctacaccgaagaatgggctttcacaggtggacgacgacgcaaggagtgtgctcagtgtgcagtccgagcgacccaggcggcacagcatagccacctcgacggtgcgggatgatgagagcctcgccagctctccgtcagtcccaagctacatggccgccacaaaatccgccagggccaagtcccgccttcaggggtcgccactgatcgatagtgcagagacgacaccagagaaaggaggctctgttagtattgggtcagccaagaagaggctgtccttcccagcaggaggggcgcccccctcgccaatgaggcggcattctggccctccaaaggtggagagcatggtgaaggacatcgctgtgacaccgcagccagaggccctggcgatcaatggttgaaagctgaaacaaaggagcaactcataagagtgccgagacggggctatggatatacatatttcacacccaggaacaaaggttaaaaagttattgaattgttgcattttgctttcatcaaattaattgttgtgactacattgtcagctttattaggagaagactctcggtgtcatctgtcggtccatgtccatttcatttgttgcttgtgtaaaaccatatggggtttgttgtttgtatgtacacaacacaggtcttctatttatgcgagcaatatatttcttccatgccttactccaatgaact

SEQ ID NO: 324 - DNA, 640 bp, Hordeum vulgare
ctcgcctccatccaaatcccccgagcggaggaggaggaggccggcggcggcggcggaagccatggaggaggggaagcaggggttccagccgcacctgatgggcggcggcgggaggatgaggggcgcggcgggggccatggggctgcagaagcagaactcgtggtcgcccgacatcgagcgggacgaggcgtgggagcggcgccggcgcgggatactgggcaggggccgccgctcgccgctgcagcgcgcgcagagcgtcaccgacgaccagctcgacgagctgcgcggctccctcgatctgggcttccggttcgacccgccctcgcagcgctgcgccgcctgcgacgccgggaggagccgcctcgtcgagacgctcccggcgctcgacctcctctacgccgtcaacgccaacgccaacgccaaggccaaggccggctgcgcggccagccagtgctcctgcggcgcctcctcggaggcctcggagccgtcgcccatcgggagccccctctcaatactctctccagatgacccgccggagacggtcaagatgaggctgaagcagtgggcgcaggtggtggcgctgtccatgcgcagccgctcctgaacagaccagccatggctgaacgaacatcccgtgtag

SEQ ID NO: 325 - DNA, 1709 bp, Hordeum vulgare
cggcaatggcgagcgcgtcggaggacgaggcgggctcggagcgctgctgcggcagctacagccccagcgccgacgtcagcggctccgagacctccagcgactgctccgcccccaccgccaccacccgccgcttccccttctcctcctcctccgcctccgcctccgcctcccgcggcctcgcctcctcctcctcctcccagctccccaccccgtccgccgccttcttcccctcctccgtccccgcctccgacctctccgagatcgacatgatgaaggagcgcttcgccaagctgctgctcggcgaggacatgtccggcagcggcaagggcgtctgcaccgcgctcgccgtctccaacgccatcaccaacctctccgccaccgtgttcggcgagctgtggcggctggagccgctggcgccggccaggaaggccatgtggacgcgggagatggactggctgctctccgtcgccgactccatcgtcgagctcatcccctcgctgcaggagctccccgacggcggcggccagttcgaggtcatggtgccgcgcccgcgcagcgacctctacatgaacctccccgcgctcaggaagctcgacgccatgctcctcgccatgatcgacgagttcaaggagaccgagttctggtatgtcgacagggggattgtggtcgacgacggcggcggggggccgtgcccgtcctcgtcctcgtcttcgtcctgcgggcggccgtcctcggtgcggcaggaggagaagtggtggctgccgtgcccgcgggtgccgcccaaggggctgcccgaggaggccaggaggaagctgcagcagagcagggactgcgccaaccagatactcaaggcggccatggcgatcaacagcgatgtgcttgctgagatggagataccggatgcgtatctggagtcgttgccaaagagtggtcgaacttgcttgggtgagataatttacagatacataacggctgaacaattctcacctgaatgcctcctggactgcttggacctgtcatcggagcaccatacacttgaagtagcaaacagaatagaggctgccatccatgtctggagactaaagggccaaaagaaaacgacgactcaggcaaagtcaaagaaatcttggggcggaaaagtgaagggtcttgttggagatacaaagagccaagtattgtcacaaagagctgatggtctgctgcagagcttaagattgcgacaccctggtttgccacagacttcgcttgacatgaacaagattcagtataacaaggatgtcggtcagtccatacttgaaagttactcaagggttctagagagcttggcattcaacacaattgcgagaattgacgacgtgatttacgtggacgacgcaacgaagaaatctgcagctgccgagaccgtttcgatcttcaaccgcggcacgggtgcaccagtccagaagaaaatctccccgagcccattctcgatccagcatacgccgtacgcctcccccttcgccacacccaccttctgctcctccaccccagtcaatggcaacagccccggaagagcaccactgcctccgccgagcaaaaagaacccgccagcgaaacccgagatcaaagtcgagaagctcttctccggtgatgtagagaaggtgtggacctatgccggaaacctgagcgcgcggaaagaagccggagacgctcctgaaagggactgatga

SEQ ID NO: 326 - DNA, 1527 bp, Phaseolus vulgaris
gaggcacagcagatggagtatttcaacaaagccaaggccgtgaagctacggagccacctcgggaagtacctagtggccgacgacgaccaccacaaactgcgtcagagcaaaaacggctcaaccagaaattcaatatagttggtggagctggtgaaagggaagagccaccacgtgcgtctcagaaactccaacggccgttacctaaccgcgacggaggcgccctttctgttaggcgtgacggggaataaggtggtgcaggggagtttgggggatggttggaatgggaaattggagtgggaacccataacggaagggttgcacgtgaaactgagaagctggtgcgggaagtaccttagagggaatggtggaacgttaccgtggagaaactcgatcacgcacgatgacccttacgcttccaccacccacgattggatcttgtgggctgtggagcctctggagtttcccgacaaactgctttcttcgccggagactcattttccgtcgtcgttggagtcggaggatgagcttcgcggttcggaagaaccgggttcgtcactgttgcagagcacaagttccgacaccatgttccgctccggcatggagctcttccaccgcgcgaaggtggtgcggctgcgcagccaccacgacaagtacctcctggcggacgaggacgaggaatcggtgacccaggaccgaaacggatcctccaggaacgccaagtggacagtggagctcattccggagttcgacaacctcttacggctcaagagctgttacggcaagtatttgacggcctcgaaccagccgttgctactgggcgtgacggggcgcaaggtggtgcagagcgtgccgcggcagctggattcctccgtggagtgggagcccgtgcgggacggcgcgcaggtgaagctgaagacccgttacgggaactttctgagggccaatggggggctccctccttggaggaactccgtgacgcacgatatcccgcataggaccgccacacaggattggatcttgtgggatgttgatgtgttggagatccacgtcgagtctcctgctcctcctcctattcctcactctgattccctcgatttcgattcctatactccctctgctgtttccatcaaatccactgctttctccagacaagagtcgacggattcaaatgtgggttcgccaccgaagttggaggggaggactatatactaccatgttgcagaggataatggggacgtggatgatgagaatgtgcagggttattctttgactttcaaaggaaatggggttgagcagttgactctgaagtttgtggaagagacggggcttgagggagttattgtgtgcactcgaagtcctttgaatggaaaactctaccctcttcgcttgcagcttcctcccaacaatgtcaccatgcaggttgttttggttcttccctcgtctaaagtggcaagagactttgaggagcaaggtctactatgacaagctagattattgttggagtcttgaatctactgaaatgcaagg

SEQ ID NO: 327 - DNA, 338 bp, Phaseolus vulgaris
aaccttcagttcagggaaagtgatgcatttcaatcctttgggaaatgggtttgtggactttacttgaggggtttttgcttcttgcaaatgcattggcaatattaaatgagggtcgttttcttgcacctagaggatggggtttcacagatttctcaggaggaaggactaagtcgttcaaaggccagcttataggtctcatttatgcaactcagtaccttagagttcctctcatacttctcaactccatttgcattattctcaaattcgtgtctggatgatgcttgacaaggtttggggtttttgttagatgatttcacgaaggtctttaagatagcagg

SEQ ID NO: 328 - DNA, 2632 bp, Phaseolus vulgaris
ttctctcgactcctttggtttctgcaatggccacccttgcagacattggtgtctcagctaccatcaacattctctcagcctttgctttcttgctggcttttgctctgctgagaatccaacccgtcaatgatagggtctactttccaaagtggtatctcagtggagggagaagtagtcctaggagttctgggaattttgtgggcaagtttgtgaacctcaatttcaggacttaccttaccttcctgaattggatgcctcaggctctcagaatgagtgagtctgagattatcagccatgctggccttgactctgctgctttccttagaatctacactctgggcttaaagatttttgttccaatcacagttgtggcactcctcattcttataccagtcaacgtatcaagtgggacattatttttcctaaaaagggaattggtagtgagtgatattgataaactctcaatatcaaatgttcctcctgaatctataagattttttgttcacatagcattggaatacatgttcacattatggatttgttttctgctgtacaaagaatatgataatatcgcatcaatgagattgcacttcattgcatcacaacgcaggcgtgtggagcaattcacagtacttgtcaggaatatccctcgtatgcctgatcacacagtatcagattctgtgaatggcttctttcaaacaaaccacccagatcattatattggacaccaggctgtctacaatgcaaataaatttgctaaattatcgaaaagaagagatagactccaaaattggctggactattaccagcttaagtttgaaagacatcctgacaaaaggtccaccgtcaagactggatttttaggcctttggggtgggaaagttgatgcgattgagtactacaaacatgcaattaaggaacttgataacctgatgacattggaacgccagagagttataaaagatcccaaagctattttgccagttgcttttctttcattcaattcccgttggggagcatcggtttgtgcacaaacccaacaaagcaagaatccaacactctggctaactgattgggctcctgagccacgtgatgtatattggcggaacttagccataccatttgtttctttaagcatccggaagcttgtaataacattgtctgtgtttgccttggtattcttctacatgattcccattgcttttgtgcaatcacttgccaatttggagggtcttgaaaaagttgctcccttcctcagaccagttatagaattgaacttcatcaagtcctttctacaaggttttcttcctggtttggctcttaaaatatttttgtacattctaccatcagttctgatgatcatgtcaaaaattgagggatatactgcattgtcaactcttgagcggaagacagctgcaaaatattattactttatgctggtgaatgttttcttgggaagcatagtgactggaactgcatttcaacaactgcatgctttccttcaccagtcacctacacagattcctagaacaattggagtttccattccaatgaaggctaccttctttatgacatacataatggttgatggatgggctggaattgctagtgagattctcagattaaagccattggttatataccatctcaagaacatgttcatagttaaaacagaaagagataaaggaaaggccatggaccctgggagtgtggactttccagagactattccaagtcttcaactatacttccttcttggaattgtgtacgctgtggtgacaccgatccttcttcccttcatactagtcttctttgccttcgcatatttggtttatcgtcatcagataatcaatgtctacaaccaacagtatgaaagtgctgctgcattttggccacttgttcacagccgcatcattgcaagcatgctaatatcccagtttcttctattgggattgcttagcaccaaaaaggcagctaaatctacacctttgcttgttatattaccagtattgacatttgcattccacaagtactgccagagacgttttgagccagcatttcggaagtacccgattgaggaagcaatgtcaaaggatttattggagaagagcacagaacctgacttgaacataaaggcttatttggctgatgcttacttgcatccaatcttcaggtcatttgaggttgaagaggaattgattgaaatcgaagtagataaacaacaaactgctgctcctagttctccatcgactgagcctagttcaccctctccaccccatcatctggatcagtcattcccatctcatcatttgcatataccatccccaccccatcatttgcctgaactgtcagcactccatcatttgcctcaactgtcagcaccccatcatttgcctcaactgtcaccaccccatcatttgcctcaactgtcaccaccccatcatctgcctcaactgtcaccaccccatcatctgcctcaactatcaccaccccatcatatcattgaacccgcactaccacctcaatataatgagtatccaccaggttattactaccaataccatcctccctcccctccccattatgtttatcagtactaagtttagccttgaactcaactcctgcataccaa

SEQ ID NO: 329 - DNA, 2665 bp, Brachypodium distachyon
atttcttcgcttccccagcattttctctgtttccgattaatttctccattgttcttgcgaagggaacttgacagggcttaatctggtggtcacttatgcttgaagagatggtggtcgctgtggagaatggggtaaagatggaatccgccgccgccgccaccactgacgccgacgccgattctcctatttccgttctggaggacgagaaaatgtccgaatccaaggatgaaaaagccagtcgttttgtggatgcgagcacgtccctgcctgttaagttcgaggccaacggtggtgaggtgcatcccatagtccaggcgctgaatgctgaagaggcgctattgcaatcagtcaaagttgagactgctgatgagtatttggatgctagtacttctcttcctattgacctcgaggccaagaacggtgatgcatccttcattactgaggtgatgtcaaaggaggaagaacaattatatcaggcccggcttaaggaagaagaggaagaagaggaggccaaaacgaaagaagctgcaaaacatgcttttgatccgaaggcacggtttagcaagttggatgagctgctgacacagacacagctcttttcggaatttctactggaaaagatggagcagatcacagataaaggtgttgaagttaaagatgaagaggaacctgtggaagagccgcagaaaggacgtggcagaaagaggaaagcgaattctaagccacagtacaatgataaaaaggcaaagacagcagttgcagccatgcttacaagatcacaggaagatcgttctgctgatgatggtattctcacagaagaagaaaagtgtgaaatagagcaagccaagcttgttcctttaatgactggtggaaagttaaaatcttaccagattaagggtgttaagtggttgatatcactctggcaaaatgggctaaatgggatactagctgatcagatgggccttgggaaaacaattcagacaattgggtttcttgcccatctgaaagggaatggtctgcatggtccatacatggttattgctcccctgtccactctgtcgaactggttgaatgagatatcgaggtttgttccatctctaactggtctgatttatcatggagacaaggtgactcgggcagagctaaggagaaaatttatgcccaaaactgctggtcctgattttccgataataatcacttcatatgagatagctatgtcagatgcaagaaaagttctttctcattataagtggcagtatgttattgtagatgaggggcatcggttgaaaaattcaaagtgtaaattattgagtgagttaaagcacattccaatggataataaactacttttaactgggacacctcttcagaataaccttgcagagctgtggtcgctcttgaacttcattttgcctgatatattctcatcccatcaggagtttgagtcatggtttgatttttctgggaaaggagacgaggaacaacaggaagatactgatgagaacaagagagttgttgtttcaaagcttcatgccattttgcgtccattccttttaagacgtatgaaggaggatgtagaacagatgcttccaaggaagaaagagataattatttacgctaacatgactgaacatcaacgtcaaatccagactcatttgattgagaagacattcgacgactacttgcttgggagcgcagatattgtgttgagacctggcatgaaggcaaagctgaataatctaatgattcagatgaggaagaattgtgcccatcctgatcttttcaatgctgcatttgactcaacaggcctctacccacctattggtaagcttctggagcaatgcggcaaatttcagctgttcaacaggttgctggattctctactcaaacgaaaacacaaggttctagtattttcacaatggacaaaagtcttggacctcatagcttattatttggatacgaaaggcctggaggtttgccggattgatggtggtgtcagattggaagagaggaggaggcagatagcagagtttaatgacttgaacagcagtttgaatgtcttcattctaagcacacgtgctggcggtcttggtatcaatcttacttctgctgatacctgtatactgtatgacagtgactggaatcctcaggctgatttgcaggccatggatcgatgccaccggattggtcaaacaaaaccggtgcatgtttatcgcctggcaacatccaattctgttgagggacggattattaagaaagcttttggaaagttgaagctagagcacgtcgtgattgggaaggggcagtttcaacaagatagagccaagcctaacgccttagatgaggcggagctgctagcgctgctcaggaacgagcaggatgaggaagacaggatgatccagacggacatcagcgatgaggaccttctgaaggtgatggatcgcagtgatctcacaggccctcctggtgccgtcgatgccacccctcttgttcccctcaaagggcctggctgggaggtcgtggttgcgtccaagagcggcggcggcatgctcacagcgctcaccagctgagacctgtcccagcccagcactgtagtgacgagtgacgacgcctctctttttcggtgcttcggcttgttcaccgggaattagccgatgtttcgtaa

SEQ ID NO: 330 - DNA, 1490 bp, Chlamydomonas reinhardtii
tgtaaatggacccagcgaagattcgcccctcgtccgcgtacaacaccccctactggaccaccaacagcggtgcgccggtatggaacaacaacaactccatgacagtggggacgcgcggtcccatcctcctggaggactaccacctggttgagaagctggcgcagttcgaccgggagcgcatccccgagcgcgtcgtgcacgcccgcggcgctgcggcaaagggcttcttcgaggtgacgcacgacatctcagccctgacggcggccgacttcctgcgcgcgccgggcgtgcagacgcccgtcatcgtgcgcttctccactgtggtgcacgagcgcggctcgcccgagaccctccgcgaccctcgcggcttcgcggtcaagttctacacacgtgagggcaatttcgacatggtcggcaacaacatgccggtgttcttcatccgcgacggcatgaagttcccggacatggttcacgccttcaagcccaaccccaagagccacatccaggaggcctggcgcattatggacttcctgtcgcaccaccccgagtcatgccacatgctgacgttcctgctggacgacgccggcatcccgctcaactaccgccacatgccgggctttggcgtgcacaccatgaagctgatcaacaaggccggccgcgagacgtatgtcaagttccactgggtgcccaagtgcggcgagaagtacctgctggacgacgaggcggtgatggtgggcggagccaaccacagccacgccaccaaggacctgttcgacgccatcgcagcgggcgactacccggagtgggcgctcatggtacagaccatggaccccgcggacgaggacaagtttgactttgaccctctggacgtgaccaagacctggcccgagtcgctgttccccatgcagccggtgggccgcatggtgctcaaccgcaacgtggacaacttcttcaacgagaatgagcaggtggccttctgccccgccatcatcgtgccgggcatcggctacagcgatgacaagctgctgcagacgcgcatcttctcctacgccgacacgcagcggcaccggctgggccccaactacctactgctgccggtgaacgcgccgcgcgccccccaccacaacaaccaccacgagggcttcatgaacttcatgcaccgcgacgaggaaatcaactacttccccagcaggtttgacccggtgcgcaacgcggagcgggtggctgccgtgtcgagtgcgccgctgtctgggcgccgcgagaagatggtgatcgccaaggagaacaacttcatgcaggccggcgctcgctggcgcgcgttcgacgcggcgcggcaggagcggtttgtggtgcgggtggcggacatgctggcggacccccgctgcacgcaggagatccggcgcatctgggtgggctactggtcccaggccgacccgcagctgggcgcgcgcattgccgccaagctgcagggccgcggctgcctgtagtag

SEQ ID NO: 331 - DNA, 497 bp, Chlamydomonas reinhardtii
caacgatggccgcttcctgccttcggccggcacccacggcctcggcgcagatgatgactcgctcgccagtggctggcttgccgcgcccttgctcagctctccagcgctcaggatgcacgcttcaaggggcatttggaacgtttgcgccccagacaacccggacgttcgtggtgacctgggccaaagggggcgtaatggacgcacccacaacaactcaacagccggccagcggggttgagcgcagccagaagcggccacctatctataaagtcctcctgcacaatgacaattataacaagcgcgagtacgtggtgaaggtgctgctgaaggtggttgagcagatcaccgtcgatgacgcggtgacctgcatgcaggaggcacacgagactggcgttgcgctggttgttgcctgcccacaggacaacgcagagcgctactgcgagggcctgcgcctcaacggactcacgtcgaccattgagccgggtggctgctaataa

SEQ ID NO: 332 - DNA, 1439 bp, Chlamydomonas reinhardtii
gacaaatggcgggcttccggccgctaaacctagtgcggccgttcctctcggtgctgcccgatgtgcagcaagccgaccggcgcgttcccttcagggagaagttcctctacaccgcggttacgctgttcatcttcctggtctgctctcagctgcctctttatggcatcaagaccaacagcagcagcgaccccttttactgggtccgtgttatcatggcgtccaaccgcggcacctgtatggagctcggtattagtcccatcgtcacctccggcctggttatgcagctgcttgctggttccaagattatcgacgtcgacaacagcgtgaaggcggaccgcgagctgctgaacggcgcgcagaagctgctcggcgtgctgatcaccattggcgaggctgtcgcttatgttgtctccggcatgtatggcgacgtgcgtgagctgggcgctgtcaacgctattctgattattactcagctgttcatggctggcatcatcgtcatctgccttgatgagctgctgcagaagggctacggcctgggctcgggtatctccctcttcatcgccaccaacatctgcgagtccatcatctggaaggcgttcagcccctacaccatcactggcccccgcggtgctgagttcgagggtgccatcatcgccatgttccacctcctcatcacccggtccgataaggtccgcggcctgaaggaggctttctaccgcactaacctgcccaacatgaccaacctgatggccaccatcctcatcttcctggtggtcatctacttccagggcttccgcgtcgacctgcccgtgcgcaacaagcgcgcccgcggccagcagggcaactaccccatcaagctgttctacaccagcaacatgcccatcatcctgcagtccgccctggtgtccaacttgtacttcatctcccagctgctgtacaagcgctacggcggcaacatgctggtgcagctgctgggccgctggcagcagaccgagtacggtggcggccagatgatccccgtgggcggcctggtgtactacatctcgccccccagcagcctgaccgaggtggcgcaaaacccgctgcacgcgctgttctacgtgaccttcatgctcactgcctgcgcgctgttctccaagacctggattgaggtgtcgggcagcagcgccagcgacgtcgccaagcagctgaaggagcagcagatgttcatccagggccaccgcgacaccaccgcctccctgaagaaggagctgaaccgctacatccccattgccgcggccttcggcggcatgtgcatcggcgctctgaccatcgtggccgacttcatgggcgccattggctcgggcaccggtatcctgctggctgtgaccatcatttaccagtacttcgagacgtacgagaaggagaaggcccaggcgcctggctctctcttttaataa

SEQ ID NO: 333 - DNA, 3274 bp, Chlamydomonas reinhardtii
tatgcaactttagccctgtgtcactggcgaatcgtcgagaatgcgcaactcgtcgaccttactgcgttcggcattcgcccgccggggcacgcacttacaacagcagagtgcgctgtgggagttgcatcgcgcccgatactcgacgaacgacgatagtaatcgcgaggaggggggcctgctcaacaagatctggcgggccgggctcggccagaagccgaaggacagcagcagtagcagcagcagcgctgccggaggcagcagcagtagcagcagtagctctcgcagcagcggcgccagcagcggcgatgcgctggtgcccagtggcccggagcggcggcaccacaaggtgtttgtggtggagctgtctcgcaagccgctgttcccgggcatttacacgccagtcatcattagtaagaacgaggcgctggtgaaggagatcatggacgtcaagaagcagggcgcccacgcctacgtgggtgcgttcctcaagcggccggagccgccgctgggcatgacggccgccgccgccgtggccgccgcgggggagacggaggtgcgggacgccgcctcccacctgtacgacatcggcacgtttgcgcaggtgcacacagtgctggcgggcgacagcgccgactcggcgcagctgctgctgctggggcaccgccgcatccgcaagaccggagtgatctctgcggaccccctgcgtgtgcatgtggaccacctgcgtgatgagtcctacaccagcgatgacatcctcaaggccaccagcatggagatcgtgaacaccatgcgcgacctgctgcagctcaaccccctgtacggcgagcagttcaggacgctgctgtcgctcaccggcagtatcgacctgcaggacatgagccgcctggtggacgccgccgcctcgctcaccagcgccgacgacaccacactgcagacggtgctggagacactcaacgtgccggagagggcccggctggtgctggggctgctgaagaaggaggtggagctgtgcaagctgcaggcggacatccgggagcaggttgagggcaagatcgtcaaggagcagcggcgcatgttgctgatggagcagctcaagagcatcaagaaggagctggggctggagcgggacgacaagagcgcgctgctgcagaggttccaggcccgctgggacgagcgcaaggcgctggcaccccccgacgtggcgcgggctgtgcaggaggagcttgacaagctgggcggcctggagccggtcagccccgagttcaacatcacgcgcacctacctggactggctcaccagcctgccctggggcgccaccacgcaggagctgttcgacctggtgcgggccaagaaggtcctggacgacgaccactacgggctggaggacgtcaaggaccgcatcctggagttcatcgcggtgtcgcacctgcgcggcagcgcccagggcaagatcctgtgcctggtggggccgcccggagtgggcaagaccagcatcggcaggtccatcgcgcacgcgctcaacaggaagtactaccgcttcagtgtgggcggactgcacgacgtggccgagatcaaggggcacaggcgcacctacgtgggcgccatgcccggcaagctggtgcagtgcctcaagagcacgcagagctccaacccgctggtgctcattgacgaggtggacaagctgggccgcggccacagcggcgaccccgcctcggcgctgctggagctgctggacccggagcagaacgccgccttcaccgaccactacctggacctgccgctggacctcagcaaggtgttgtttgtgtgtacggccaactcgctggacaccatccccggccccctgctggaccgcatggaggtcatacggctgtccggatacgcacaggatgagaagcgcgccatcgcgcggcgctacctggagccggccgccgccgccgacgccggcgtgccgcccgggtctgtgagcctggcggacgacgcgctggaggcgctgatcggcgagtactgccgcgaggcaggcgtgaggaacctgaagaagcacgtggacaaggtgtaccgcaaggtggcgctgcagctggtgcgggcgggcgccaaggtgatcaggctggacgaggaggggaaaacaccccagcagcagcagcagcagggggaggcggcggtggaggcgggtgccgggagcagcagcggcaccgccgaggcttccaccagcacgagcacccctagcagtaccagcagcaccgccaccaacaccgacagcaccaccaccaccagcaccgccaacagcaccagcagcaagccggctcccaaggtgcgggtggagtacgacgggccgcccatcacggtgcaccgcgcgcagctcaaggactacgtggggcaggcgccctttgcaaaggacaagttctacgagtccacaccgcccggtgtggtgatgggtctggcctggacgcctctgggcggcgccacgctgtacgtggaggcggcgcgggtggcgggcagcgaggcgcgcggcagcctcaccaccaccggtcagctgggggacgtgttccgggagagcgccaccatcgcgcacacctacgcacgcaacttcctggcggcccgcatcgccgacggcaccattcccgccggcgccgccgcgtcctcgccctcggacgacacgccggcctcgtcaccctcggacgccaccacggccagcagcagtagcagtgccagcagtggcagtagcagtagcagttccgggaagcagcagcagcagcagccgcagctgccctccgggcccggctccttcttctccagcggcgcgctgcacgtgcacgtgccggcgggcgccacgcccaaggacggccccagcgcgggctgcacgctggtgacggcgctgctcagcctggcgctggaccggcccgtgcggccggacctggccatgacgggcgaggtgactctgacgggctgtgtgctgcccatcggcggcgtgaaggagaaggtgcttgcggcccggcgcagcggcgtcaaggtggtggtgttccccgagggcaacaggcccgagtacgaggagctggcggaggacatcaagcagggtctggagccgcacttcgtgagcagctacgaccaggtcttcaaactggcgctggagcacgacagcggcagcggcaacgcggacaaggccaagcaggaggcgccgctgtccacgagcgcatgaggtggtcggcggggggcaacaccgagcgagcgcgtgcgaggatacggagggggccacgtagtcagtgtcgagtcgtag

SEQ ID NO: 334 - DNA, 890 bp, Chlamydomonas reinhardtii
taaacatgcgtcagtcactgtccagcactagatctgcaagtgcaacaccctcagcgtgctgctcgcggacagccgcgcgcgccgtccacgcaggccgctggctgccccagcgccggcggaacttgacccccgtggcggccgccgcggagggcgggggcggagccgtgctgcgtcaagtgctgacgggccccgagcgcaccaagctcgacacgggcgatgaccggggcttctacgacgtgccgcgactggtcaagcacgtggatgacggcttcctggaccaggtcacggagctgtaccggcagcgtatccccgagggcggcgccgtgctggacctgtgcagcagctgggtgtcacacctgccgcaggacgtcacctacagcaaggtggtggggcacggcatgaacgcggcggagctggcccgcaacccgcgcctggactcgttcttcgtgcgcaacctcaacgccagcccggacggctgggcggcggcggaccagagcttcgacgccgtgctgtgctgcgtcagtgtgcagtacctgcagcagccggagcgtgtgtttgccgaggtgtaccgggtgctcaagcccggcggcgtcttcatcatcaccttctcaaaccgcctgttctacaccaaggcgatttccgcatggcgcgacgcgtcgggctatgcacggtgccagctcgtgaagcagtacttccaggctgtggccgggttcacggcgccggaggtgctgatggaggtacccaaggctgctggcagcgcctcatcagcggcaggcagcggcggcgcgctcccgcagtggctcaagcctctgggccgcttcttcgagcgcaccagctcagaccccttctatgcggtggtggcgtaccgcaacttcaagcgggaatgatga

SEQ ID NO: 335 - DNA, 1222 bp, Gossypium hirsutum
ccgtctttaacacttttcaatggcttcctcttctgttattgcttggggctcaggtgaagatggtcaattgggtatcggaaacaatgaagaaagagaatgggtttgcgttgttcaagctcttgagcctcacaatgttcgctccgtcgtcgctggcagccgtaattctctcgctatttgtgatgatggcaagttgtttacttggggatggaaccagagaggaaccctagggcaccctcccgagaccaaaactgagaatattccaagtcaggttaaggctcttgctaatgttaaaattgttcaggcggctattggtgggtggcattgtttggctgttgatgatgaaggcagagcttatgcctggggtgggaacgaatatgggcagtgtggtgaagagcctgagcggaaagatgatactggtaggcctttgagaagggacattgtgattcctcagcgctgtgcgccaaagcttgtagttcgccaggtagctgctgggggtacccattctgtagtgctgacacgtgaaggatatgtttggacctggggtcaaccttggccacccggagacataaaacaaatatctgttcctgtgagagtacaaggtctcgaaaatgtgaggcttatcacagtgggagcatttcataatttggctctccaggaggatgggactttatgggcatggggtaataacgaatacggacaacttggaactggggacactcagccaagatcacaacctatacccgtccaaggattatctggtctcactttggttgatattgctgctggtggatggcattccactgcattgactgatgatggagaggtgtatggttggggaagaggagaacatgggaggctcgggtttggagataacgataagagcagtaaaatggtgccgcaaagggttcaacttttagctggggaagatattgttcaggtatcttgtggtggaacacattcggttgcattgacacgtgatgggcgcatgttttcgtttggacgaggtgaccatggacgactaggttatgggcggaaggcaacaacaggtcaacccatggaagtcccgatcaatctgccagctccaaaaagtgttagcggaagtggtgctgaaggatattggatctctaaacttgttgcatgcggaggccgccatacgcttgctatagtagaatggaagaccgatgaatctaagccataactgaagaatgtaatgttctcatag

SEQ ID NO: 336 - DNA, 1398 bp, Gossypium hirsutum
agagatcgtcgatcagatttagttgattgatccaaagaatcaaatggaatgaaatgaacgtagagtgagtggatttcagcaatgaaaagcgtcttctcggcgcccggagattacatctacttcaagtcccaagtccctcttcacaggatccccatcggcacgaagcagtggcggtattatgattttggtcccaaagtggttactccactcatatgtcttcctggaactgcagggacagcagatgtctactacaaacaaatcatgtgcttgtccatgaagggctaccgggtcatttctgttgatattccctgtgtttggaatcatcaagagtggattcaaagttttgaaaagttcttggatgccatcgatgttcatcatatacatctgtatgggacatcccttggaggcttcctagcacaactttttgctcaacatcgtcccagacgggttaaatccttaattctatcaaatacatttttggagacgcgcagttttgcagcagcaatgccttgggcaccttttgtcagttggaccccgtcttttttgttgaaacgatacgtcttaacaggaatccgtgatggccctcatgaaccttttattgccgattctgtggactttgttgtttcgcaggtcgaaacactctcaagagatgaattagcatccaggttgactttgacagttgactctgcttcagtaaaaccgctactactttcagattcatttattactataatggatacgaacgactactcggcaattcctcaacaacttaaagatcagttgagtgagaggtacccaggtgcaaggcgagcttatctcaaaacaggaggcgatttcccctttctttcccgcccagatgaagttaacctacatcttcagctgcacctgagacgggttggattggaagctcagccagagctggttcagagcatcccaaaagatggcaccggtggaggccccagcaaagaaaatgataaggaggatcgtgatgatgaacaaaaagataatgggggaaatcccgaaagcaattctgaagaaagccagccgtcaccttcggctccggaaagttcagaatctcatggtctagatgaacagctcctcagcaatgccgaaattcattacatcaatcagaaagattcaatcattttgaagccttctgcaatgtcattgaatcaacacagtgcggctgccggaatcctcctccaatcgacatgggagttctttattttctctttgctgccgttatatgtggattcattatacatttattctaataatgcttggaaattgagacaactggtgtaaatagagcattggttagcagtttctgctcgttgtttatataaatataagcgctgttgcaaacagtttctccattgacaatgttgtatctattca

SEQ ID NO: 337 - DNA, 2076 bp, Gossypium hirsutum
tacgccacactctcattgtttctctgtcgaaatggaaggctcagtcgaagaaatggcgaaagcagtttccgatttagcattggattcgtctgctgccggtgaagctcagagcaaaaatgctcgtaagaaggaacttaaaaataagcagagggaagaggagcgtcgccgtaaggaggaggagaaagcagccaaacaggctgcagccaaggcaggcacacaaagtcagaaacatgcagccgctgaagacgaagatatggatcccacgcaattccacgagaacaggctgaaatttcttgcagcccaaaaggcagaggggaaaaatccatatcctcataaattcttcacatcaatgtctattgttgaatatatagagaaatatggaagcctaggcaatggggagcatattgaggatgccacagtatctttagctgggcgaattatgagcaaaagagcatccagttcaaaactttttttctatgacttgcatggcggtggtgccaaagtccaggttatggctgatgcgagcaagtcaggcttggatgaagctgaatttgcaaaattccattcaactgtgaagcgtggagatatagttggtgtcactgggtttccaggcaaaactaagagaggagagttgagcatttttccaatgtcatttttagttttatcccattgtctccatatgatgccaaggcaaaaagcaggccctgatgccagcgtgaagaaaactgatgtatggatcccaggaagtactaggaatcccgaaacgtatattttgaaggatcaggaaactcgttatcgccaacgttatcttgatttgatgttaaaccttgaggttcgtcaaatattcaagactcggtcaaagatcatttcttatgtgaggagctttcttgacaatcttgatttcttggaggttgaaactcccatgatgaacatgattgctggaggtgcagctgcccgtccatttgtaacccatcacaatgaattaaatatgaagctctatatgcgtattgcacccgagttatatcttaaggagttagtagttggtggactggatcgtgtgtatgagattggaaaacagtttagaaatgagggcattgatttgactcacaatcctgaattcactacctgtgagttctatatggcttttgctgactataatgacttgatggagcttactgaaaaaatgttgagtgggatggtcaaggaacttacaggcagctataaaattaaataccatgcaaatggccttgacagtgctccaattgagattgatttcactccacctttcaggaggcttgacatggtagaggagttggagaagatggctaacctcaacatacccaagcccttttccagtgatgaaactaacaagtatttggcagatgcatgtgaaaagctcgagattaaatgccctcctcctcaaactacagcacgtttgttggataaacttgttgggaattttctagaagagacgtgtgtgaatcctactttcatcatcaaccatcctgaaataatgagtcctttggcaaaatggcataggtcaaaaccggggctgactgaacgatttgagctgtttatcaacaaacatgaactttgcaatgcatacactgagttgaatgatcctgttgtacaacgtcaacgatttgctgaacaactgaaggatcgacaatctggtgatgatgaagctatggctttagatgaaacattctgtactgcacttgagtatggattgcctccaaccggtggttggggattgggtatcgatcggctagctatgctattaacagattcacagaatatcaaggaagttcttctcttcccagccatgaaacctcaggatgaaccatccactaaagctccagcaacttagggagttgaacctgccgaaatctgactcatcgccgtgatctagtatgtttactgtaaaccagtggtgagatctgtcaacttttttggcgtagattttgtcttgaaagaaatattgcaattgacattcaaccctcttatgtatttgctagtatagataggtgttttatcatacacgctagaagtcacgtcaggtcacctccatccatt

SEQ ID NO: 338 - DNA, 683 bp, Gossypium hirsutum
caacaatttcgtctcccgttaccaaatttccccattaaaaccaaaaatgagaatcccaaatctcaccaaagcctttattttgttaatggcaataactctgatgtcaacccaagccagcggcctaatcccttacggtagatccttatgggacgtgatgcttgctgaagacccattcaaaatcctggaacaaaccccagtgaccgtccccaaaggatcagaacccgtcgctttagctcgagctgactggaaagaaaccccacggtaccatgccattaccctggacatcccagggatgaaaaaagaggatttgaagatcgaggttgaagagaacagagtgttaaggatcagtggtgaaaggaaagaagaagcagaaattgaaggagagaaatggcatagagctgaaaggacgaatgggaagttttggaggcagttcaggttgcctgcgaatgtggatatggatcgcatcaaagctcatatggaagatggggttttgaggatcagtgtgcctaaaattgtagatgagaataagaagcaggctaaggtgattgacattgttcagtcgggtggtactggtgaagatatcaaggcaacctcccagggtcatcagtagatatttgattgatctaccaggtttttgatggattgatttcgggttttcatcgtttcgcctacttatgtaataa

SEQ ID NO: 339 - DNA, 1776 bp, Gossypium hirsutum
gccaaatttcaagagcaaaccaaaaaaaggctgcaaattcagcttttcaatatctgcttttgatcaatcgaaatggcttcacaagtttctcaaatgccttcttcatcacccctttcttccaataaggatgaaatccgtcccaaagccgattttcagcctagcatttggggagatttcttcctcaattgtcccgacaagaatattgatgctggaactgaaaaacgccaccaacaattgaaagaagaagtgaggaagatgattgtggcaccgatggctaattcgacccaaaagttagccttcattgattcactccaaagactgggtgtgagttaccatttcaccaaggagatcgaagatgaactagagaatatctaccataacaacaatgatgccgagaacgacctctacactacatctcttcgattccgactactccgagagcatggatacaatgtttcatgcgacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccaccaaccatttaagccttgcagtagcatctttggaccatcctttatccgaagaggtttctcatgctttgaaacaatcaattcgaagaggcttgtcaagggttgaggcaaggcactatctttcagtataccaagatattgagtcccataataaggctttgttggagtttgctaagatcgacttcaacatgttacaatttttgcataggaaagagctaagcgagatttgcaggtggtggaaagatttagactttcaaagaaagttgccatatgcaagagatagagtggttgaaggctatttttggatctcaggagtgtactttgagccccaatattcacttggtagaaagatgttgacaaaagtgatagcaatggcatctattgtagatgatacatatgactcatatgcaacatatgaagagctcattccatatacaaatgcaattgagaggtgggatatcaaatgcatagatgaacttcctgaatacatgaagccgagctacaaggcactattagatgtttacgaagaaatggaacaactggtgcctgagcatggaagacaatatcgtgtcgaatatgcaaaaaatgcgatgatacgacttgctcaatcttaccttgtggaggccagatggactcttcaaaactacaaaccatcattcgaggagtttaaggctaatgcattgccaacttgtggttatgccatgcttgctattacatctttcgtcggcatgggagatatcgtaacaccagagacctttaaatgggcagccaatgaccctaagatcattcaagcttccacaattatttgtaggtttatggatgatgttgcggaacacaagtttaagcataggagagaagacgattgctcagcaatagagtgttacatggaagaatatggcgtatcagcacaagaggcatacgatgtattcaacaagcatgttgagagtgcctggaaggatgtgaatcaagagtttctgaaaccaacagaaatgccaacagaagttttaaatcgtagcctaaaccttgcaagggtgatggatgtactttacagggaaggagatggatatacatatgttggaaaagcggctaagggtggaatcacttcattgctcattgaaccaattgcactttaaaattatgttaatttttcctctccaagcttgtttccttga

SEQ ID NO: 340 - DNA, 1158 bp, Gossypium hirsutum
catcaatcttgcaaagcaaagcgtttgctaatggagggtctgatgcaggtgccttatgatgttacggttaggttcatgttgaccttcttggagcgcaatttgttgcctgatgctattatacggaggttgactcggcttctcctggctagtcgtcttcgttctggttataaaccctccactgaactccaactctctgatctccttcagtttgctcattccctaaaggagatgcctatagctatcaagacagacaagcctaaaactcaacattacgaactgccaacctctttcttcaagttggttcttgggaagaacttcaaatacagttgctgttacttttctgatgagtcgaaaactttggaggatgctgaggaagcaatgttggaactgtactgtgagagatcgcaattaaaagatggccaaacggttcttgatgtggggtgtggatggggttcactttctctatacattgcccgtaaataccccaattgcagggttacagggatttgcaattccaccactcagaaagcttttatagaggagcaataccaggatcggcaattgcaaaatgtggagatcattgttgcggacataagcacatttgaaatggaggcatcatacgacaggatatattcgattgaaatgtttgagcatatgaagaactatcacgatcttctcaagaagatatcaaagtggatgaaagaggatagtcttctttttgttcattatttctgccataaagcatttgcttaccactttgaggacataaatgaagatgactggataaccaggtacttctttacaggaggtacaatgccttcagctaatctgcttctatatttccaggatgatgtttctgttgtcaaccattggcttgtgaatgggaaacattatgcaaaaactagtgaagagtggctgaagaggatggaccgaagcttggcttccattaagccaataatggagtccacctatggcaaggatcaggctgtgaaatggacagtgtattggagaacattctttattgctgttgcggaactctttggatacaataatggagaagaatggatggttgcagttttcctattcaagaagaaataaagccgtcgtcaatgctcgtagtcaatgctcatttccaccaagaatcagctttgggcatta

SEQ ID NO: 341 - DNA, 506 bp, Gossypium hirsutum
cagctttagcttccacttccacctaacatttccatcttcccaatctttcctcctccatcggcccgtggtctttgacttctccggctacgccgtttacaaagagctacattcagcaatatttgtaacagatggcttcttccttccgagcattcctaaacagtccagttggcccaaaaacaactcacttttgggggcctgttgcaaattggggttttgttctcgctggattggtggacatgaataagcccccagaaatgatttctggcaacatgacatcagcgatgtgtgtctattctgcattattcatgaggtttgcatggatggtacaaccacgaaactatctactgttggcgtgccatgcttcaaatgagacagtacagctctaccaactctcccgttgggcaagagctcaagggtatttgtcggagaagaaagacaaagctacattgcagtaaagcagcttcagttggagctagctgcttttcgtttctttccattccaagtgt

SEQ ID NO: 342 - DNA, 1422 bp, Gossypium hirsutum
cctcccaaatgacaccaaagtgaatcaaccctcaatatcaagcccctcaaatcttctcaatttgaagcacatcatagaactgctcgcccttggttccactcttctgttactgttgaagggtcatgttgaataagctagccttgccagaatccagcactttcccaggaaagccaatgccacccacagctgaatgctggtttgatgatgcatgcatccttgacatggactactttgtgaagaccatctcaggcataaaggccaagggtgttcgtcccgacttagtaggctcaatcattgcacattatgcatcaaaatggctacctgatctatccggcaatgacaccgaaaagggtcctatgagtctccaagagtcatcgccggagagtgtcacagtttcatggatgaaaaagaggttctttgttgaaaccttggtgggaatcttgccacctgagagagattccatcccctgcaacttcctcctacgccttctccggacggccaacatggttggggtggagccttcctacagagcagagctggagaaaagaatttcgtggcagcttgaccaagcatcactgaaagagctcatgattccatcgtttagtcacacttgtggcactctgctagacgttgagcttgttataaggctggttaagagatttgctagccttgatgaaggcactagaagcggcattgcggtggttaaagtagctaagcttgtggatagctacttggcagaagcagctttggataccaatctgagtttggaggactttattgcacttggtgctgctcttcctagccatgcccgagccatggatgatggcctctaccgtgccattgacacttatctcaaagcacatccaggtgtttcaaagcaagataggaaggttctatgcagattgatagacagtcgaaaactgtcaccagaagcatccctacacgctgcacaaaacgaacgtttgccagttcgggcggtgattcaagtgttgttctgcgagcaaagcaagctcaaccgacatgttgattggagtgggtcgttcaacggaacccggagtccgaacccggcaggactggaagccccggttcggtgcatgtcgaaacgtgaaatgaacgctcaacaaatggagataaagaagctgaaggaagagctgctgagggtccaaaaccaatgcgtagcgatacaaatgcaaatggagaaactagtggataagaagaaagggtttttcaggtggaagaagctggggataatgccgtcgctgaagagcagcgtgagtgtatttgagaagattgaagaagaaagagaggctaactttgggaggcaaacccccattgatatcaaacaaaagcctgttcgtcctcccaagtggagaaaatccatgtcttgacttcattgtgcaggggttcctaattaatttgctg

SEQ ID NO: 343 - DNA, 891 bp, Gossypium hirsutum
tactaaacgaggaaatggggaacagcataggaggaagaaacaaggcaaaggtaatgaaaatcgatggtgaaaccatcaaattaaagacaccaattcgagtttgggatgttctaaaagattatccaacaggccatgttttattagattcacaaaccgtgaagcattatgggatccgtgctaagccattagagccacaagagagcttgaaacccaagaaaatctacttcttggtggagctgccgaagcttgccgatgatgaagttcataaggcgccgaggagggtgcggtcaggggggattcatatgagtgctaaagataggttagagtgtttgatgttgtcgagaaggacggtgtcggacctttctatggttcgaccgtcgtcgacgagcatggtgcccgatggggttcgactaggtggtggtggtggtacttccggtggggggatgatgactgtgaaaatgaggttgcctaagtctcaaatggctaagttgatggaagagagcaaagatggtgttgaggtagctgagaagatccttgatctttataccggaaatggtggtagtggcggtgatgaggccggtaatcgaatccaccgtgaagcaccgtggaagcctggccttggtaccgttggagaaaactttaagcccaaacgtgagaagagagtgagctttattccacaagaagaaggtgaaatccatttagcaaatcacttgtagcagccaaatttggagtcagcatcaaaatccagcaattcagccccaatactagttttctttctaaataacttattatttatgacttgtttttcttttttatataatcacatgtattttcatctgttttacggttcaagtctagttctattcggtgaggtgacattcaggtaaagcc

SEQ ID NO: 344 - DNA, 637 bp, Gossypium hirsutum
ctcctcccttggaatggaacacttctagatctactccttggaacaagttatgaaaatggctatatctcttgtactgagtcgactcattctcttcctcactctcacctgctttgcagccgtctcatcatctactacgaccacaacaactctaaaacggcactctgggtttctctactctagaacccgaggaaaatgcactcctcagttctggagcagcaggagagaggcgtggccaaggatggtcccacagggatcaacggtatcgaacgtgttcgggtcgagagcgagtgagcggtacagatcggatatgacattgttggaatcaagggctgtgaatgaagaagggaacgtgttcaatgagctgctgaagcaggcgagtgcagcattgctgaactcgtatgcgaggaaagggttcccttactcggcgtgggaagtgaagactctgatgattcaagggttggtctcggaatatgccgcagcacgcctaaccagactcttttccgttgctaatgatgcttgtatttagtagtattcgggttgatactagcttaaaaggcgataggagaagctagttttgcttgaagcagtacgactctgttctttttatttttagtttgtcaatttggtagattatcgc

SEQ ID NO: 345 - DNA, 639 bp, Setaria italica
gataagcagaggcagagagagagagagatgggttctccagtgccgctccgtccccttgctcttgcctgcttcatcttcctctgttcatccttctgggcagcaaatgggatgtacggtagggttggtgcggcggcggcggaggtggagagcaggaggaggatgcggctgcacaccgacgggagccgcggcgacgcgcacgcgtggccggggtacctctacacccgagcagttgggagatgcacaccccagttctggagcagtggagctgagccgtggccaaacatcgttcctcaggaagcagctgtgtcaaaggtctttggctccaggtccgttgagagatacggaccacgcctcaccctgctggaagctaccatgagaaccgacgacatcggtggcagtgcctttgtgaagctcgtgaagcaaggaagtgctgctctcctcaatgcctacacgaggagaggtttcccttttgattcctgggaggtgaaggccttgctgttagaggcgctagtgtctgaggaggtggctgcagtccaggcagaacgatttgagcaggcgaatgagtcctgcgtttgatggatgaaatgatgatgatgctggagcttctgtccctgcttggaagctgtatcagaagggtga

SEQ ID NO: 346 - DNA, 3073 bp, Setaria italica
cctgtcaatagcagacgagccggcctgtgaccgagcggctgatccgattgggttgccgccttcggccggaaccatggatcagcagcggaggagcagcctcaggtcgtacgggtccaacgcctcgtcccagtcggggtccttcgacttcgaccacgaccaggacaaggagcgcgccggcagccagcacggcgacggcgaccgccgcgaggtcgtcgtcaagatcgatgccgaaccgcactcgccggtctccctcagcgcggccgccggcgtgtcccggaacaactccgcggtcagcactccgcgggccggcggcgcggtgagcatgctcgcggcgtctgcgtccgggtcgagcgcgtcgacctcgcccagcgtcggcggcgacgcgtcccgctccggcgactcgttcagcttcaagaaccgcccgccgcagtcgccctcgtcgccgggggagtccagcgaggacccgcccagccgcctcatcggcagcttcctccggaagcaggcggcggccggcggggagctgtcgatcgacccggacttcgaggtggacgacatgaggaggccaccgcgcgcgccgacgtccgtcagcgcatccagggagctgcgcgtctcgttccagaacccccacaagcggttctccccgtcgacgtcgtcggcgtcctcctcctcctacgacggcggcgacaaccgcaaccagagtggcatcgacggggacaccgccgaggtgctgcgctgcacgtcgacgtccaccggctcctcccttctggcgcgcagcaagacgcgctcccggctaatggacccgccgccgccgtcgagcgcccccgccaacgagccggacccccgcaagtcgttcgtctcgaagggcctgccgcccaagtccgggcagctccggtcgggtctcatcggcaagtcggggctcatcggcaagtcgggcggcttcgacgacgaggatgacgacccgttcgtcgacgagggaatgacctcggacttcaagcgcgacaccatggactgcctcctcatcatggagtgggtcagcctggtggtcatcgtgggcgcgctgatctgcagcgtcaccatacccagcctctccaggaagaaggtctcgggtctccacctctggaagtgggagctcctcgtgttcgtgctcatctgcggccgcctcgtctccggctgggtgatccgcatcgccgtcttcttcgtggagcgcaacttcctgctgcggaagaaggtgctctacttcgtctacggcgtgcgcggggccgtgcggaacgtgctctggctgggcatcgcgctcgtgtcctggcacctcctcttcgacaaggacgccaagcgggagacccacacactggtgctcccctacgtcaccaaggtgctgtgctgcctcctcgtcgccaccgtcatccgcctcgtcaagacgctgctcctcaaggtgctcgcctcgtccttccacgtctccacctacttcgacaggatccaggaggcgctcttcaaccagtacgtcatcgagaccctctccggcccgccgctggtggacgagagccgcatgatggcggaggtgcagaggctccagagcgcaggggcggccatccccagcgagctcgaggcgacggccatgccgagcaagtccgggcccgtgcccaagagcggccgcctcacgacggccccgtccaggcgagggggaggggtcagcaagcagctgcagaggcagaagaccgagcggcacctggacgatggcatctcgatcgaccagctccacaggctcagccagaagaacatctccgcatggagcatgaagaggctcatgaagatcgttcgctacggggcgctgacgaccatggacgagcagctcaagcatgcgacgggcgaggacgagctggccacggagatacacagcgagtatgaggccaaggttgcggccaagaggatcttccagaatgtcgccaagcctggatccaagcacatatacctgtcagatttgatgcgcttcatgaggcaggaagaagccttgaaagcgatggatctttttgaaggagcgcaggagaacaacagggtcagcaagaggtcgctcaagaactgggtggtgaacgcgttcagagagcgcaaagcacttgccctgacgctcaacgacacgaagaccgcggtgaacaagctccaccagatggccaatgtcgtggtcgcgttgatcgtgcttgcgctctggcttctcatcctagggatcgcaacgtccaagttcttcgtcttgctcagctcgcagctcctcgtggcggtcttcatgtttgggaacactctcaggaccatcttcgaggcgatcgtgttcttgttcgtgatgcatcctttcgatgtcggcgatcgatgcgaagttgatggaatgcaggtggttgtggaggagatgaacatcatgacgacgatcttcctccgatacgacaacctcaaggtgtattatccaaacagtcagctggcccaattaccgatcatgaactactacaggagccctgacatgggagacgccgtcgacttcactgttcatgtcggaacaccagtggagaaactgtccctcatgaaggagagactattgcattacctcgacaacaagaaggagcattggtaccctggctccatggtggtcctgcgcgacgtggacgacaccaacaagctgaaggtctccatctggtgccgccacacgatcaacttccacgacatgggcatgaggttcgagcggagagagctcctgctgcaggagatgatcaagatcctgagggacctcgagatcgagtaccggatgctgccactcgacatcaacgtccggaacgcgcctaccatccagtccgcaaggatgccgtcgacatggacgttcaactactgagatcatgctggataccttcttcagacttgtttgtgaggttctgctctgaagtttgctagaagtagagtaagtattccagaatcctaagccagtgttccctgagtgctttgagctgtgacagcctgctgacgagagaggcaacaggtcttgctgtccctgcagccatcactagtgctttcctgtagttaattgtgttgttggtccgtataa

SEQ ID NO: 347 - DNA, 555 bp, Setaria italica
catttgcatccgtctcaggggaagcacgaagcagaggcgcgtcgccgaggatcggcggagatgcagatccgcgtgcgttgcgggtgcggcgattcgtcgtgcccggagtgggccgtcgtggagcttcagggcgtggtgcagccgcaggcatccttctccggcgacatccgggggctccacatcggccgcctctgctctgccccctccccgtcctcttccaagggagggtacaccttcacggtggggtaccatgaactcgccgggacgaaagtgaccttgaagaagcccctgctggtgctcaggaagaagaaggtgaccggtggtgctgcggatcaggagccaccgacggcggcggaggaggcggagctggaggtgatcggcgtcatccggcacaagatcctcttcaaggaccgccccaaggccctcatctcaaagccaccgaccaaggagaagaaggccgtgcagccagcagcaaattgacgccattcctggggaacggccagcagcaacttggtccagtcatgccagcgatttcgtggaccttgagaatctgaa

SEQ ID NO: 348 - DNA, 499 bp, Setaria italica
acacgaagtgaaatcctctgctaagttcacaagaagattcggcgttccggcggccggagtttccgcgatcaggcagcagatggggaactgtctcgagacgtctcgtcgcggtcgctccggtggcggaggtggctccgtgcattactccaagacgaaccccgtgtgggtggaggaggaagtggggaggaaggaggaggaggaggaggaggcgcgtaagggcgagagcgcgccggcagcgggggcagcggcgacggaggtgaagatccggatcacgaggaagcagctggaggagctgctgcggcgcgtagaggatggcaaggaaagcggcgacggcgtgccggtccgggatgtcatctcggagctcctgtacgtggccagcaccagctccaacttccggcacagggatgaggggcagtggcggccgtcgctgcagagcatacccgagtgagatcgaatccatcctacctgttgctgcatctacagcaacacttccagctag

SEQ ID NO: 349 - DNA, 275 bp, Setaria italica
cggcgatgccgatgaacgcggggctgcgcgcgtaccgcgaggtgctccgcctggtgcggcggctgccggcggagacgcggccctactacgccaaatacgcccgcgagaacttcgtcaactaccgcgacctctccgccgacgacgacctcgccgccctcctccgccgcgcctacacccactcgtcatgggtcctctccaagtactcaatagacggggagaaggctgcggcgcggctcaaggatctcggcggcggccaccccgccgggcactgatga

SEQ ID NO: 350 - DNA, 1367 bp, Setaria italica
ccgacatggaggccgccgccgcggcgcccgtgctcgacgccttcttcgccgggccgcgccaccaccaccaccagctccgccccaccgccgccgccggaggcggctgcagatccgcgcgcctccaggcccagccgtcccgcgccgccgccgccccctacgcccgcgccgactggcaggccgcctgcgccatcctcgccagcaactccagcggaggcaacggcggcagcaccagcagcgccgacgccagcaacagcaatagcagcagcaagcagccggcgccgcgggtcaacgggcaggagccgccgcggccgcccgcgctggaggcgacgccggcgccggtgcccgcggagctggatctggtgccggtctccaacctgccccggcccctcagcatcagcgacctgtccccggcgccgatgcacgggtcccagctccgcgtggcgtaccagggcgtcccgggcgcctacagcgaggcggcggccgccaaggcctacccgggctgcgacgccatcccctgcgaccagttcgaggtcgccttccaggccgtcgagctctggatcgccgaccgcgcggtgctccccgtcgagaactccctcggcggcagcatccaccgcaactacgacctcctcctccgccaccgcctccacatcgtcggcgaggtccagctccccgtccaccactgcctcctcgcgctcccgggggtgcgacgggagctcctcacccgggtcatctcgcacccgcaggcgctcgcgcagtgcgagctcacgctcaacgccatggggctcaacgtcgcccgcgaagccttcgacgacaccgccggcgccgccgagcacgtcgccgcgggcgggctccgcgacaccgccgccatcgcgtcggcgcgcgccgcggagctgtacgggctccaggtcctcgccgacggcatccaggacgacgccagcaacgtcacgcgcttcgtcatgctggcgcgggagcccatcatcccgcgcaccgacaggcccttcaagaccagcatcgtcttcgcgcacgacaacgacggcacctccatcctcttcaaggtgctctcggcgttcgccttccgcgacatctcgctcaccaagatcgagagcaggccgcaccgccaccgccccatccgcctcgtcgacgacgccaacgtcggcaccgccaagcacttcgagtacatgttctacatcgacttccaggcgtccatggccgacgtccgcgcgcagaacgcgctcgccgagatccaggagttcacatccttcctcagggtgctcggcagctaccccatggacatgacgccgtgggacgccgcgccgtcctcgtggtcctcgcgcgtcgacaatagcagcagccagcacttgtagtag

SEQ ID NO: 351 - DNA, 505 bp, Setaria italica
cttctcgtcttcggatcacacagcggtgcgtgctaggcgagacagcgggagcagagcaggggagtggggcaggggcatcatgttggaagggaaggcgatggtggaggacacggacatgccggcgaagatgcaggcgcaggcgatggcggcggcgtccagggccctcgaccgcttcgacgtcctcgactgccggagcatcgcggcccacatcaagaaggagtttgacacgatccatggaccgggatggcaatgcgtggtgggctccagcttcggctgctacttcacgcacagcaaggggagcttcatctacttccggctcgagtcgctcaggttcctcgtcttcaaaggggcggcagcatagcaaagcaggctggtaacatcacggccaggaaaatcagatgcaccgtgctattttctcctccggcttttgtggagggcgactaggtggcgccgcagccggcacggcggatggcgtgtgcgtgcgtatgtgaaattagttgggtag

SEQ ID NO: 352 - DNA, 1500 bp, Setaria italica
caggatcactctctcggctgccactggtccgctccgctctgccgcttgcccgcttccaccccactccgctctcccccgttcccccgccgagatattttcctgcgagcccctccccccggccatgccgctgctcgccgtcgcctcctccacccgcgccgcggcggtgcggccgccgcgcgcctcggcggcctcgggcgaggcggcagcgtcggaggccgcggggcggaggcctgtgaaggtgatcctgccgaagaagaagccgcagaagtggtcgacgggaatggagcccggggagtacggcggcgggccggccaccatcaagccgcgcaagtactggtgggggaaggaggaccgcgaccccgtgggcaacaccgacgacttcatctggaacaaggacttcctcccccacatggagcgcgtcatcgccaacggcggcgctgccgcggaacccacaatcacccgccgttccccggtggacgaggaggagtcaggatttctgagcatcaaccgtgccatgagccttgacagtgtggaggttgacctgagcaaggagcttcaagcgccgaccaggccaatccttcaaacgcaggttgaggctgccaggagaggccgggccattggtgctgaggctgtgaatggtgccacctctgcaagatggaggctagtcccgactcgccgggagcaggctaagtgggacagagcagccaaggcagctactggtggcagcgatgttatactaagggagtccaagtcaagagtgcagcaaggggaccctaaggaattggcagctagggccagagaggactacctaaagttgaaacaaagattgcagctgctcactttaggcattggtggtgttggtgtagtctctgcttatgtttcatactctcctgaaattgctgttagctttggtgcagggttgattggatcattggtgtacctccgcatgcttggaaccagcgtagattccctagctggtgggactggagaaactgtcaagagtgctgctgcacaaccaagattgcttattccagtggtacttgtgatgatgtataacagatggaatgggatattagttccagactatggcttcatgcacctggagttgataccaatgcttgttggattttttacctacaagattgctacattcgctcaagcaattcaagattcgatacctgcagttgaaaaacgtgaagtttgaacagtcctggtgaatagaaaataaaggtcttaccctacgcactgagggaagattggccattggtcaatcagatagtaaggttggtttggaagaatctgatctgacgtcgacaccaagtagatgagatgctcattgaggatgccatctgaaaacttttagcggttaaccacatattttacacaaatattctactattaaggtggtaccacattcattccatgttgttaacacgtagatcatcaatgtacaaatttacaacatggaaactttatcacaatgacagcagatagcaggac

SEQ ID NO: 353 - DNA, 3281 bp, Setaria italica
ggatccggtctctatccagtccacttgctctctctccctcatccgccactgcagcgagctctcgcttcgtcgtctctccctttccctcaggagtggcagatctgttcgcgtgatccccgacctggatcttgatgatttggcgactatgagtggtcgattccttcgggccagctggttatagggaagtgtggtttcctgatcctctgtttcaacctcaggacattgaattgaatctagtgataaccgtgtattgttcattcacaaagatacctgaaacttctgcttcatatgatcacccatcataaagatgccaacgaaaggacagtttagcagcgaaaggaatgtgaagatcatatcaggtcgtgatggacaaaagaagggaaattcacagcatgaccaaattgcgcacgtgccgaaggacagggtcacagcagccaatggaaatgtagatggaaaaattgaagatagaatcagagttgcaaagaatgataagttccgaaggcaacgggagtcttggagtggggaaaaggctgcatgcatgaagggctcaaaaccatggcctggtcgaaagacgactactgttgatgaacttgtcaagcatatgtcaaatgttccttcttatttacagcgtaaagagacagctgaccatcttcaagacaaggcattgaatgttggagttcttgagtggggccttctggctaactggtctcagcaacaaaagcatgagctcgctagaagccatggagcctctccatctaatactagtaggtctgtattattctcatctccatcacattcttccgcaagccccagcagcagatctcttgagagtaatcaatctacccccatgagtgaccatcaccattcatccatcagagctcagcagagtagactgtcggataaacagcatgggacggccagatattcacctagtccaaattctgccgtattgagcttgttgccagggcatggtaaacatctctctccagagaacagctgtaattatgttggctcgggtctcaggaatgtttctttacccgcagactctctaggttcttcctctagaagttttggaagacatgaaatgggtgaagatgaagagactagaaggaagattgaagatgttgtccatcactgttctcgtagactctttacagacagtgataaaattgggaagaatttcttcacatcaaataacaatgattccatgtgtaatgatcctgaacagagcagtgtcttgaatggtgaaaattttgagtcactaatatctgatgctgtgatggacacacctagaaatggcagtaggttacctgatgttttcttggaggatattgagccatcccatgaatttcctcgaattccatactcatgtccacttcccatcatagattcagctgctaaagagattggcaccactagcactgaagctagagataattttgttggtacagatgcaaaactaagtaagaacggtaaccgaaaccgatctgccatgagtggcgctgagaatcctccccaatgttctgcaaagttcagtgatagggtgcctgatcgccatctaggttctgggatgaatcgagtgagccgcagctctagcctgaaggagacaccatgtgctcgacaacctgatgcagtgccctctgttgataaaataggagacaggtcatcatccaacagcaaaggtaggcgaagcccattgaggaggatgttagatccaatattaaagccaagacattctagtccagtacgaccttcatttgttccgaagtgtcatcttccagtcaataccactaaacagtctctggacatgggcagatcagtgccacagaatgtgcagcgaaggtcagttgatatggtagtcaattcgaattatccaactgaagcaaacataaaccagcctcctcatgtgctgttaaacagtgcaagatacctccagcaagaaaaggattcaccaacgacaaggcaagcgcttctgcagctagcatggaagaatggcttgcctttattcatgctgtcgtatggtgagtctgatatcctggcagccactgtgagaaagaagagcatctctgagaaggatgatctggaaagcacatatgctgtattcactgttgaagaacctaagaaaaaaagtggagcttggatcaaggcagggggtaagaacaagaaacatcacctgttatccagcatagttggagaattaaaggtcacacgccgaaaatcaagatgccaccacacaaagaatattcatgtacacagggagtttgtgttggttggttccgaatttctaccatcatctgaagaatcaggcgattcacacatcagcggagagcttgcagcttttatcagcgcacttcctcagcaagaagcagaaacttcaagtcaatcatcttcacagaatgtgggacaaaataattcggcgccgattggctgcggttgccccccattgggaaacttccagccttgtaccaggaatgctaattctggttcagccaatgttattgccgtactacctgatggcttccatggcacatcgacatctgggcagccattgcctttgatcgagaggtggaaatcaggaggaacttgtgactgtggtggatgggatgaaggttgcatcctgagtgtcctcactggtgcggccccagaaaatgatgccattcaggctaaccaggcaatggatggcagccagcgatttgagcttctagctcagggtcgatcgcgagaagacaggaatgccttcagtatgatttccttcaaagaggggctgtatacagtggaattcagatcatccattgctttacttcaagcttttgcaatgtgtatagtgatgcttcatgggaggttccctagcaggatgcaagttgcttcgcaagcagcgcaagagcatgatctccttgccaatcatgagctcaagaccatggcagccagtcaaggtagagctccgaccagctatgtgccccatcggccacctctttctcctgtaggccgagcctagcttgttgcaattaaatgtatgttctttctgtgtcctctcttcagttgtgtagtgcctgtgggatcaatataccatggtcctatggtccatatgcaatacgcatatccaaagtgacaatccctgtgcaatctgctttagaggtagctatctgtacatgttgatgttgtatgactgctgctatgatgtggctgcaaggtccatctcagcgcttagttaccctttatatgttcaccccttgtcagttgcttctatgctgaaaggatacacacctcctgtctattgggac

SEQ ID NO: 354 - DNA, 2004 bp, Setaria italica
aaaccctagcttcgcccagcccccaaccatggcggcgatgatgcaaccgcagatcatcctgctcaaggagggcacggacacgtcgcaggggcgcgcgcaggtggtgagcaacatcaacgcgtgcacggcggtggcggacaccgttcggaccacgctggggccccggggcatggacaagctcatccacgacgacaagggcggcgtcaccatctccaacgacggcgccaccatcatgcgcctccttgacatcgtgcaccccgccgccaagatcctcgtcgacatcgcaaagtcacaggactccgaggtcggtgatggaactactactgtggtgcttctagctggagaattcttaaaggaagcaaaaccttatgttgaggatggagtgcacccccacagtctaattcgcagttatagggctgcgggcaatatggcaattcaaagggttaaagaattggcagttagcatagaagggaaaagccttgaagagaagaaatcattgctagccaagtgtgctgccacaacactctcatcaaaactgattggtggtgaaaaagaattctttgcttctatggttgtggatgctgtccttgccatttgcaatgatgacaggcttaatcttattgggattaaaaaggttcctggaggtaccatgagagattcttttctggtgaatggtgtggcattcaagaagacattttcatatgctggatttgagcagcaaccaaagaagttcctaaatccaaagattcttttgttgaacattgaactagaattgaaatctgagaaagaaaatgcagagatcagattatcagatcctctgcaataccaatcaattgtcgatgctgaatggaacattatttatgacaaactggataaatgtgtgaaaagcggagcaaagatagttctgtctcggttagctattggtgatctggcaacacagtattttgcagaccgagacattttctgtgccggtcgtgtcactgaagaggacctgcaacgagtggctgcagcaactggtggaaccgttcaaacttctgtgaataatgtcattgatgaggtacttggttcttgtgaggtatttgaggaaaaacaagtgggcaatgaaagattcaacatatttagtggctgcccttctggtcagacagcaactattgtcctccgtggtggtgcagaccagttcattgaggaagctgaacgaagtctccatgatgccatcatgattgttaggagagctcttaagaactctacagtcgtgccgggtggtggtgcgattgatatggaaataagcaagtatctcagacagcatgcacgaaccattgcggggaagtctcagttctttgtaaattcgtttgctaaagcccttgaggttattccacgacaactttgtgataatgctggatttgacgcaactgatgtgctcaacaagctcaggcagaaacatgcatctggtgatggtgctaattatggtgtagacataaacactggtggaattgctgattcctttgctaactttgtgtgggagcctgctgttgttaagatcaatgctataaatgccgcaacggaagcttcctgccttatccttagcgtcgacgaaacagtgaaaaacccaaagtctgagagcgcacaaggtgatgctgcagctggtgcaatggctggtcgtggaggaggtgcaatgcgaggccgtggcgggaggggcatgcgcaggcggtaaattgagccacgtcgactctgtaacttcatgttttgatcgcctgagggctgttgtatcataactgcacgtgtgatgtgaatgattcagaagcaatgatagcctttgtttcagaacagcagagatataccaggcatttatgaatgtagccgccaccggttgtgatatagatctgagccttgtttttttttctctcgagctaaaggatgtattccttttgttgcgatccttgtgcgctgaagcctaaaattttgtgcgttgtttttggaacgcggatgctgtttgctcagactgac

SEQ ID NO: 355 - DNA, 1312 bp, Setaria italica
aactcttcgagggtcgctgcgctgcacgccatggagctgctagtgcgagcgggggcggccgccgcagccgcgtcctcatccccgcacccctcgctccagctcccccgcagcacctgcgtcgtccctggcccctgccgcccccgtccccgccgccccaggtacccttcgctccgcgccgcagctgccgcggcggcggtcgccgttgagccggaaacggaagatcagcagaatagcatttcagaaactgaggtgtttgcatgccctgtttgctacgaagcattgataagaaaaggcccaccaggcataaacttgccagcaatttataggtcaggattcaagtgttcaaaatgcaacaagtcatttaccagcaaagacatcttcttggacctcactgtgacttcagggacaaaagaatataccgaacagaagcctgctagaactgagctctttaggagtccgcttgtgtcatttctttatgagagaggatggcgtcaaaacttcaatcggagtggctttcctggtcttgatgaagagtttcaaatggctcaagactatttccaacctgttgctggtggtatccttcttgatgtcagctgtggcagtggcttgtttactaggaaatttgcaaaatctgggacatactcagctgtgattgctttggacttctctgagaatatgctccgccaatgctatgaattcattaagcaagatgatactctcctcaaagcgaatctagcacttgtgagagcggatatttcaaggctccctttcgcttcttgttctgtagatgccattcatgctggagctgctatccattgttggccatcaccgtctaatgcggtagctgaaataagccgtgtcctgagacccggtggtgtgtttgtgggcacaacttttttatcatctcccaggaacaacccattctctgttgaagcattaaggccactgagacagattgttggaccagttaacaccagctacaactacttcaccgaaggagagctggaggacttgtgcaaatcgtgtggccttgttaactacagcagtaaggttcagaggtcattcatcatgttctccgggcaaaaaccatactgaagatatctctccaacctctactgattcttcaggattccttgtaaaatgtatttactaaaaattattatatttacatctccaatagagaataatgtggctaagggttcctcatatctgtatagatacgtgtttctgaatgtattcaaaacaatggtgtacaaaaatgcatgctgcagattcttgagagaaacactacaagtgccctacttctctgtga

SEQ ID NO: 356 - DNA, 1313 bp, Setaria italica
agcaaatggaaggcactaaccaaccccctggaagcaggatgcaaggggctccctttggcagtttagacttacatggcaactctatggaaacacatgctccaaacttaggaaagcagatctttatcaactctcaaatacctgggaccctcacaatgaacagggcttcagagcctgatgactttcctgggtttcagttcaaagaagatggaaggagtgataagaaccaccatcagcacagtcatcactcaaagaacggcttgattgatgacgagggacattatatgactgaagatgctaccaatacccccagtgtcaaaggcaagaaggcctctatgtggcatcgcatgaagtggacagattcaatggtaaagcttttgattacagcagtgtcttacactggagatgatcatggtgctgatttaggtggtggcaggaggaactctacaataatgcagaagaagggcaaatggaaggcgatatcgaaggtcatgggggagagagattgccatgtgtcaccacaacagtgcgaggataagttcaatgaccttaacaagaggtacaaaaggctgatagacatccttggtaggggtactgcttgcgatgttgtggaaaagccagaacttcttgatagcatgaatcatctttctgataagatgaaagatgatgtgaagaagctacttaactcaaaacaactgttctttgaagagatgtgttcctaccataacaacaaccgtaggaaattgcctgaagatcatgcacttcagcattcactactgcttgctctcagatgtaaagaggaccatgatcctctgagggatgcaagtggagatgctgatgaagatgatcaaagtgcggattctgatcatgaggagaatgatgatgaagagcaacatcctgtgcatacaaacatgagggagccctccatggacaaaagggctcgccacggcgatgcagctttgctcacctcaagctctcatgaaggtattaagaggtctgatccccatggcataacagtggacatcaacaaggctttcccagatggaaccaactgggctttgttgcaacaggacttggcttcacaatcactagaggtccggaaacgtctcttgcagattgaagaaaagaacctggaactcaaaaagcagtgtgttaagtgggagcgattcaggaagaagaaggatagggagatagaaaggatggcgatggagaatgagcatatgatgattgagaataagcaattggaacttgagctaagacagaaggagctagagttagagcttaagctaaaaggccaggccaatcatgcatgatga

SEQ ID NO: 357 - DNA, 1607 bp, Setaria italica
gttctccgcctctccttcctcccctcccctgcaatggcgtcggcgggagggccctccggggtcgtagggattagtgtccgtccggactccagtgcggcctgcctctttcagaaggttggagcccgatcgaattccctccctggcgcagcccctgttcaggttcgccggtgccacaacaaggcccgcaatggccaagctatcaggtgtgcaatggcaactggaaaagagcagggtgcagtcaccactactagtagtgatcaacacaaaggtggtttgcgtggcaaattaaacaaagttgttttagcttatagtggtggcttggatacatcggttattgttccatggctcagggagaactatggttgtgaagtcgtttgtttcactgctgatgttggccagggcgccattgaattggaaggattggagaagaaggcaaaagctagtggagcatgccagcttgttgtgaaggacttgagagaagaatttgttagtgaatatatatacccctgcctgcgagctggtgcagtttatgaaagaaagtatcttcttgggacttcaatggctaggcctgttattgctaaggcaatggtcgatgttgccaaggaagttggtgcagatgcagttgctcatggatgcactgggaaaggcaatgatcaggttcgctttgagcttacattttatgctttaaatcctgaactcaaagtggttgcaccttggagggagtgggacatcacagggcgtgaagatgctattgagtacgcaaagaaacataatgtgccagttccagtttcaaagaaatcaatatacagccgagaccgaaacttgtggcaccttagccatgagggtgacatcttggaggacccagcaaatgagccaaaagaagatatgtacatgatgtctgttgctccagaaaatgcaccttcggaacctgagtatctggagattggcatcattgcaggtgttcctgtttccatcaacggacgggacctgtcgcctgcatccctccttgcggagctcaatgaaatcggtggaaagcatggaatcggacgcattgacatggtggagaaccgccttgtaggcatgaagtctcgtggtgtctacgagacccctggtggcaccatcatggcagctgcggtgcgcgagctggatgccctgaccttggacagggagaccatgcagtggaaggacatggtcgccctcaagtatgctgagctggtctacgcaggccgctggtttgacccgctccggcagtccttcgacgccttcatggagaacatcactgcgacgactactggttcggtgactctgaagctgtacaaggggtcggtgaacgttgcgtcccggaagagcccctacagcctctacagggaggacatctcctcgttcgagaatggggagatctacaaccaggctgatgccgaggggttcatcaggctctatggtctcccgaccagggtccgggcgatgctggagaagggcatctaagttcctctgtttgttctgaaaataaaagccatcattcggaaactgtcaaagcgtttccagcgattgcggaccggttgttttgtatacgttgtttgagtttcaacgaatgaactctgaatgca

SEQ ID NO: 358 - DNA, 2014 bp, Setaria italica
agacaagagcaaccggacaagctagcccacagctagcgagcctgcgcgctgctgcggccggcggcgacgaaagcgaggaggaggatcggaggaggaagtggtggagaagggcgggcgccgtgcccgcgatggtggtggcgagggcgaagaaggcggcgcccgcgggcgccggcggcgccggagctggcgcgcggcggagcggcgtcagggtgggccccgcgaggctcgagggcctccccgcggcgtggccggcgggcgccgctgccgtcaaggtcaagtggcccgcgccggggggcgcgctctcgcagatgctcacgggccgctgggcgcgcggggtcaccgccgtcgagcccgtcgccgcggggggcaccgtgaggtgggagccgcgagacggcaaccgcttcagcctccacgtcgagcccgccggcgcgcgcggccgcaccgagcgcggcgtcttcttctccctcctctatggattccaagaacagggccggggcaaggacctggtgaggctggaggagatcgggacagccatgataagcctggaggagtgctgctgggagatgcaactgcagcagcagcgccagcagctggtggttgtccccatcagggtgaggaaggatggatgggcaagtgatgccatgctttatgtgaacgtggagctcgtggacatgatgaacacacgctccgacattgaaagggctgtctcgttcagggagaagccgagaacgacgagcaagccgccgccgcatgcaatgcgagaccaccggaagagcttggaggcagcggcgtaccatgacgttcttgatctgaagcagctgctcgacctggctgagaaggaaggccgggtggctgtgtacgggagcaagaggaactctgacaccagcagcgtgagcagcttcagtagcagcagcagcagcagcacgatcagcatcagtagtgccagctccagcggcggcgcgagcccggagctcgcctcgacgtcgaagcgccggttcttgccatggatgcggaggagcagggacttcgacaagaggagcaccgagtcgctctcccaagaactgccgatcaagtgcatggacgacgatccggccggcagctgggagacgcgcgagttcacgagcagggacgcggagacgaagctgaggacgccggtgttcttcgcgtccatcgaccagcgcgacggcagcgccggcggggagagcgcgtgcacggcgctcgttgcggtgctcgccgcggcgctccacgccaaccacccggcgatgccgacgcggccggagctggacgcgctgatccgtgacggctcgtcggagtggcggagactctgcgacgacgaagcccacatggcgcggttcccgaaccggcacttcgacctcgagaccgtcctcgccgcccggacgcggcccatcgccgtgcagcacgacaggaccttcgtcggcttcttccagccggagagcttcgcgtcgctctccggcgccatgtcgttcgacgacgtctggcgcgagatcgccggcggcgagcgcgagccggggcgcgcggacgtgtacatcgtcagctggaacgaccacttcttcgtgctcaaggtggagagcgactgctactacatcatcgacacgctcggcgagcggctgcacgagggctgcgacagggcctacatgctcaggttcgacggctcgtcggagatgcacgcgctgtcgacgccggcagtggacgacggcaaggaggaggaggtgatcgtcaccgggaaggagtgctgcagggagttcatcaagaggttcttggccgccatcccgctccgggaggagcttgagatcgagaagaagggcgccggcagcgttggcgcgccgcaccagcggctgcagatcgagttccacttcacggtcctgcaggacgacgagagatgaccacttggtgtggtgatctgatggcagtgaggggatgcttcttccctgattgcaatgtacactaacataatgtaaattcatctacactgtaaaggaacaggaagtgcagc

SEQ ID NO: 359 - DNA, 1576 bp, Setaria italica
ccaggccagcaagcccccgccaccccccgagctcgtcgtgggcatggacatgtccgtcgcttcctcccaccacctgcggccgtcgccggccggtccggcgcggcgccctggcttcgccgctgccgccgcgccgcgcgtggcgctccggcccggcggtgcgtcgcccccgtcacgcggccgctgcgccgtcgcggctgcggcgtcgggcgctgggggcgaggcggcttccgcccccgccgcggtgacggcggtcgcccccgcggccgccgccgccagagacaaggtgcggcggcacacgatttcggtgttcgtcggggacgagagcggcatgatcaaccggatcgccggggtcttcgccaggagaggctacaacatcgagtcgctcgccgtggggctcaacaaggacaaagccctcttcaccattgtcgtctccgggaccgacaaggtgctcaaccaagtcatcgagcagctcaataagcttgtcaacgtcctcagtgtcgaagatctatctaaagaacctcaggttgagagagagctgatgcttataaaactaaacgtcaaacctgatcagcgccctgaggtcatggttttagttgatattttcagagcaaaagttgttgatatatctgataccacccttaccctggaggtagctggagatcctggaaaaattgctgcagtgcagaggaacctgaggaaatttggaatcaaagaaatttgccgaacgggaaaaattgctttgagacgtgaaaagattggtgccactgcccgtttctggcgattttctgctgcttcttacccagaccttatagaggcactgccaaaaaatccacttacatctgtaaataggacagttaatggcagtttggatcaaccatccaatgctgggggtgatgtttatcctgtggaaccttatgagagcttatcgatgaaccaagtacttgatgcccattggggtgttcttgatgatgatgatgattcaactggacttcgctcacataccctctccatccttgtgaatgattgtcctggtgtcctcaacattgtaacaggggtctttgctcgcaggggctacaatatacagagccttgctgttggcccagctgagaaggaaggcatttcgcgtattacaacagtcgttcctggtactaatgaatccattgagaagttagttcagcagctttataagcttattgatgtgcatgaggttcatgacattactcacttacctttttctgaaagggagctgatgcttattaaggtttctgtaaacactgctgctcggagggagatcctagatattgctgaaatcttccgagcgaaacctgtcgatgtttctgaccacacagttacgctgcagctctctggggatcttaacaagatggttgcattacaaaggttattggagcattatggcatttgtgaggtcgccagaacaggtcgtgtggcgctggtccgcgaatccggagtggactccaagtacctccgcggcttctcgctcccgttgtagcccggcatttgtgatgatggcccagcaaagcgcgtgcctggttgctagagcagattgtgtaggtga

SEQ ID NO: 360 - DNA, 1725 bp, Setaria italica
catcacccttgctacctcgccgcgccacgccgccaggcaccatgagcgccgcccagcaagcagaaccgaccacctctcccgcctcccccacccccgccggcgccggcagcaccacggtaatcaagaacgcccggcaccgcccgagcgcgctcaaactctgctaccacgttgccatctccaacctcccgtacctcctcctggcccccttcgcggcggccctcttcgtccgcctctcccggcactcccccgccgacctcgccgccgcgctcacctccaacccacccctcaccgccgccctcgccgcgctcgccgccgtcctcgtcaccatctacctcgcgcgccgcccgcgggccgtctacctcctcgacttcgcgtgctacaaacccggcccggagcacgtggtgacccgggagacgttcatgcggcagtcgacggcggcgggggtgttcacgggcgacaacctggcgttccagcggaagatcctggagcggtcggggctcgggcaggagacctacttcccccgggccgtgctcaacgcgccgcccaacccgtgcatggcggaggcgcgagcggaggccgaggccgtcatgttcggcgccatcgaccaggtgctggcaaagacgggcgtccgggcgcgcgacatcggggtcgtggtcgtcaactgcagcctcttcaacccgacgccgtcgctgtcggcgatgatcgtcaaccattacaagctgcgcgggaacgtcgccagctataacctcggcggcatggggtgcagcgccgggctcatctccatcgacctcgccaagcagctgctccaggtgcaccggaacacgtacgcgctggtggtgagcatggagaacatcacgctcaactggtactggggcaacaaccgctccatgctcatgtccaactgcctcttccggatgggcggcgccgccgtgctcctcacgaaccgcggcggcgcggaccggcgccgcgccaagtaccagctgatgcacacggtccgcacccaccacggcgccgacgaccgcgcctaccgctgcgtgttccaggaggaggacgagaccggtcgcgtcggcgtggcgctctccaaggacctcatggccgtcgccggcgaggccctcaagaccaacatcaccacgctggggcccctcgtcctccccatgtcggagcagatcctcttcctcgcctccctcgtggggcgcaaggtgttcgggctccggtcactcaagccctacatcccggacttcaagatggcgttcgagcacttctgcatccacgccgggggccgggccgtgctcgacaccatcgagaagaacctcgagctcagcgcgtggcacatggagccgtcgcggatgacgctgtaccggtgggggaacacctccagcagctcgctgtggtacgagctcgcgtacacggaggcgcaggggcgggtgcggcggggacaccgggcgtggcagatcgcgttcgggtccgggttcaagtgcaacagcgccgtgtggagggcgctgcggaccatcgacccggcgaaggagaaggttgggaacccgtgggtggaggagatacacaggttccccgtcgaggtgcccaaggtggagagcgtcgtcgtcgcgccggcggcggcggcggcggccgaatcgtgaggagcgtggagcatgcggctcttgtatttgaatttggaaaaaaacatgtggaattataaaagtgtatgttgatttgagttgagcgtggggt

SEQ ID NO: 361 - DNA, 1411 bp, Setaria italica
ggagtacagcaacagcaatggcgggagctggttcccagtgacgcgcgccatggatccccagccgttcgtgcgactctccgtcggccagctcggtctcaagctccccggcgggaacgccagcaaggcgtcctcccggctctgcgactgtgagatccggctcggcggtttcccggtgcagacggcgcaggtgcccctgatccactcgccggagttcaacctcgaccccttcaccaacgcggcggtcttctccctcgacgagtccgacctcaggtccctggcggcgccggggtgcttccgccccccacggccgtgcctcgaggtcgccgtctacctggcccgcttcggcggcgcgcgctgcggcgtcacgtggaggaagcggctcgtcggcgtgttcagggtggagcttgcgtcgtcgtcggagtggcgcgacgggaagcccgtgctgctccaccatggctgggctggcatcggcaagggtgcggcggaggccaggccggagctccacctcagggtgaagatggaggccgacccccggtacatcttccagttcgacgacgaggtcgcgctcaacccgcaggtcgtccagctccatggcagctcccggcagcccatcttcagctgcaagttcatccgcgaccgccgcaggccgtctcagggtgacgggcagtactggtcgagctccggcggtagcgaggagacggacatggagatggcgatgagaagggagaggaaggggtggaaggtggtgatccacgacctgtcggggtcggccgtggcggcggcgttcatggccactccgttcgtgccggcgccgggcggcgacacggtggcgcggtccaacccgggcgcgtggctcatcgtgcgcgccggcaccacggggtcgtcggacagttggcagccgtggggccggctcgaggcgtggcgggagtcgtcgtcgtcggcgccggcggcgagcagcagggacacggtgcggctgcggctgcacctgctcccggacgggcaggacgactgcgtgctggtgtcggaggcgccactgggcagcgacaagggcggcgagttctccatcgacatggacaggcaggcgccggcgccggtgccggccgcggcggcggcggcggggcactgcgcggtgagcctgggcgccgcgtgcgcggggggcgggttcgtgatgagctgcaaggttgagggggaggcgcggagcagcagaccgttcgtgcagctcgccatgcgccacgtcacgtgcatggaggacgccgccatgttcgtcgcgctcgccgccgccgtcgacctcagcgtcaaggcgtgccggccgttccgacggaagcccggcaagaaggccgcctcgccgtcgcccgaccctctcgagctcgacacgtagaggcacatgcagctcaggacacactgtaaatag

SEQ ID NO: 362 - DNA, 1931 bp, Setaria italica
caaggcaagcgagcagagctcacggggcgcgcgcaaaggcagagccgccgcgagagctaacggccagcccggcccgttggccacttggcctccgcggcgcccgtcctgccgatggcggcggctctgcagccacggcgggcgcggctcctccttttcctcgggctgctgctccacgccctggcgcgtggggccgtcgaggcggcggcgccgttccgggcgagggacgtgctgccgctgctaccgcggcggctggcgtggcagctcatgggcgccacggcgcacagcgccgtcgacctgctcccatccttcgtcggcgccgtcgcgcccggcggggcaccggcggcctggcgtggcgcgtgcttcgcggagaacgaggccgtcctcagcctcacccccggcgccggcgccggcgcggctggccgcaacgggaccggcggggcactccacggcaacaccagctccggcctcggcggcgccgtcctccacctcaagactgcttcgcctgagagctggacatgtatggatctgtatgtgtttgcaactccatacaggatagcctgggattactatatgagatcaaatgaaaatcacacctttgagattaagacatgggaggaagcagcagaactggaatatgtaaagcagcatggcattgccgtctttctcatgccatctggaatgcttgggacgttgttatccttgattgatgtcgtacccctgttttcaaacaccggttggggtcaggatgcaaacttggcatttctccagaagcatatgggaacttcatttcagaaacgttctcagccctggtctgcgaatataagaaaagaagatgtacattcgggtgactttttggccctttcaaaaatccgaggacgatggggtggatttcagacattggagaaatgggtgaccggtgcatttgctgggcacactgcagttttcttgaaagatgagaatggcaccctctgggttgcagaatccggctatgaaaacaaaaagggtgatgaaatcattagtatgactccatgggatgaatggtggggaatggcacttaaagacgattcaaatcctcagattgcacttctgccattgcatccagatgtacgggccagattcaacgaaagtgctgcgtgggattttgccagaagcatgtacggaaaaccctatggatatcataatatgatatttagttggattgacacaatgtcagacaattatccgcctccccttgatgctaacctggtaatggctattatgtcaatgtggaccagattgcaaccacactatgcttcgaacatgtggaacgaagcccttaataaacgacttgggaccgagaaattggaccttcacgggatcattacagagaccgaaagacgtggcttgtctttcaaccagctgctcaccatacccgagcgagacgactgggaatacagcgatggcaaatcgacgacgtgcgtggccttcatcctttcgatgtacaaggcggctggcgtgttcgctcctttcacggagtcgatccaggtgacagaattcactatccgggacgcgtacatgctgaaggtcttcgaggacaaccagacgcggctgccggggtggtgcaacgcggcggcggacaggctccccttctgccagatcctgggggagtacaagatggacctgccggagtacaacaccatcgagccctacgccaacatgaacgagaactgcccgtccgcgccgcccacctacagccgcccggcgcgatgctgacggccgccgtgcaaaccgtgtactaagtgtaaatagactacgcacgctgcgtgtgctgtgcggtggtctcgctgtatgtgcggctttgtccacagttcctttctctcacaagtgattgctctgtgactctgagcagagcatatagtattatgcagaggtagttctcgttcatgctggct

SEQ ID NO: 363 - DNA, 1176 bp, Setaria italica
accacttcagcagccaggaaaatctcctgaaccccgcccgaacgagggaaaaaggggagctaaaccctcgccgccgccgccatggccgacgagatcgacgagctgattggcttcctctccgaccccaagccgcaggtgcggagcgcggccgtggacatcgtgcgggggctgacgggcggggaggacggcctgcgggcgctcacggtacgcgccgaccgcgccctcccggcgctgctccgcctgctggcctccgccgcgggaagcggcgcgggggaggccgcggcggactcgctcgtcaacctcagccaggatgccgccctcgccgcccgcctcgccgcgcttggcgccgtcgacgccgccatggacgtcatcgccaggcgcgccggggagcagccggcgctcgcgcgaagcctcgtcatgctgctcgtcaacctcacccacgtcgcgtccggcgtcgccgcgctcctccaggttggggatgaaaaggtgcaagggttgtatgttgcaaagctggtgcgatcattctgtaggtcatccagtgattctgaagagcaagacacttttgaatatgttgcctccatgcttgtcaatatatctaaggtcgaagctggaaggagaatattgatggaacctaagagaggtcttctcaagcagattattcgacaatttgattcaacaaaccaactgagaaagaaaggggttgctggtacaatccgcaattgttgctttgaggctgatactcagctacagaatttgctttctttagcagaatatctttggccagctctacttttgcccgtggctggaaagaagatatatactgaagaagacagatcgaaaatgccacttgagctgtcaagtgcactctctcatgaacgagaagctgttgaggattctgaaattcgccaacataccttggaggctatctatatgattgtattgcaggatgatggccgacgttccttttggtcagttaatgggccgcgaattctgcaggttggttatgaggatgaagaggacccgaaagtgatggaagcatatgaactgattggttccctgcttgttgggaagggcgaaggtgaacaagagcaaggaggagagaagtctcaatgaccccaccccctgaaataaaatggtggttctctcagtttctcacaccatcacttcagaacataa

SEQ ID NO: 364 - DNA, 1887 bp, Setaria italica
gacggattaagccaagatcgcggccactggtcctgctgcagcggcgggggtgtccaagaaatgagcctgcggggggacccggcgccagccggggacgagacggcggaggagctgctggagcgggtccaggggatggtgccggcggcgctggaggcggcgagggcggcgggcgggttcccgggccggtggaaggcgatcgccgccaagctggagactctgccggcgtgcctgtccgacctgtccagccacccgtgcttcgccaagaacgcgctgtgccgcgagctgctgcagtcggtggccgccacgctagccgaggcggccgacctcgccgggcggtgccgggagccgcctccggacgggaagctgaggacgcagagcgccatcgacgcgcttgccgggaagctcgacctcaacctccgggactgcgcgctgctcgtcaagaccggcgtgctgtccgacgcctccggcccgtcgccgccgccggaggctgccgcggcggggtcgccggcgcacgcggacgtccgggagctgctcgcgaggctgcagatcgggcagacggaggcgaagaaccgggccgtggacgggctcctcgaggcgctgcgcaaggacgagaagagcgtgctcgccgtgctcggccgcgccaacgtctccgcgatggtgcagctgctcacggcgtcggcgccggtggtccgggggaaggccgccacggtggtatgccaggtcgcggagtcaggcagctgcgacgggctgctcgtgtcggagggcgtcctgccgccgctcatcaggctggccgagtccggcagcctcgtcggccgcgagaaggccgccctcaccctgcagcgtctgtccgtgtcccccgacgtcgcgcgcgcgatcgtcggccacggcggcgccggcccgctcatcgagatctgccagacgggggactccgtctcccagtccgccgcggccggcgcgctcaagaacctctcggcggtgccggaggtgcggcaagcgctggccgacgaaggtatcgtccgcgtcatggtcaccctgctggactgcggcgccgtgggcgggtccaaggagcacgccgccgagtgcctgcagaacctgacgtcgagcaacgacggcttgcggcgcgctgtcgtgtcggagggcgggctgcgcagcctgctgctctacctcgacggcccgctgccgccggagcccgcggtgggcgctctccggaacctcgtgggggccgtctcgcccgacagcctggtgtcgctgggcgtgctgccccggctggtccacgtgctcagggtcgggccagtcggcgcgcagcaggcggcggcggcggcgatctgccggatctccagcaccgccgagatgaagcgcgcggtcggcgagcacgggtgcgtgccgctgctggtgcggctgctggaggcgaagtcgagcggggcgcgcgaggtggcggcgcaggcgctggcgagcctggtgggttgccctgccaacgcccgggaggtgaggaaggacgacaagggcgtgccgaggctggtgcagctgctggacccgagccccgccaacacggccaagaagtacgccatcgcgtgcctgctgacgctgtcggcggcgaagcggtgcaagaagctgatgatctcgcacggtgccatcgggtacctgaagaagctctccgacatggacgtcgccggcgccaggaagctgctcgagaggctggagcgcggcagcctgcgcagcctgttcagtagggactagcatagcagctgtaaaaagtattaactaaagcttcgctcgctgcttatatgatgatacgtaccatgaaattttccttttttgatgtaacatgtaaaaatcaagtgcagtttcacataccgtcgatgaaatggtgctgtgcaggagttttga

SEQ ID NO: 365 - DNA, 3475 bp, Setaria italica
tatccaaccttcacccaagcacccaacccgaaagggggagcggagccgcagaagcggcggagccccgagcccgcggaggaggggagaaggccgactgatgcgcttccatggccgcccgcgcgctgggcccgctgcctcctctcggtagcatgtggggacccccgcgcgccgccgccggctcccccgccatagaggcctccgccgcggccgctcatgccgcaccgcgcggcggagccgcggtcagctcggccctgtccggccttcgcggaaggccctccttgtgttcggtgcaattcatggatggtcttagaagcaatattcaagcagaagtgaacttggctctttccccaaaggcttcgatgtctaatgggagtgacgattcgaccataacctgtaaaggattctgtacaatagcatggaacctgaaagctgatgtacaagatggttacctaatattcataacaggagaccctgttaccttgggctgttgggaatccaacatggctgttcagttggctcctgttgaaaacgataatatatggacagctgaaataaaggtgccatatggggtgcacttcaaatataattattttgttcgagaagaaaaaggttcctgttctgatattatatggaggccaggtccagattactccttatcaataccttcagttggccggaaaaagcaggtcattgttgtgaaagatctatggatgaaaaccagtgtggcaggtcttcctgctccttcgtggggatcatggctgatggaagctggttctcttgaaggtgaatttttcgagggtggaaatcatcaaagcattgtggaagctcactctgctagggatacaacagatcaagatttatctgtaggtgagcatattatattgaaaatggggaatggcacacctttacattcaaagctgttgtcagagagtctatctaccaaaatgcacaatcgtataaccgacaaaccaaatgccaataatataagccaacatggaaggtatcaagttgtagaggagccatggattcttgaatctattgcggcttcaaagaaaccagttgcaagagtcaaagataagaaaggcaaaaagaagttttccaataataagcatgattttagcaaagctagtgaaaacgtgcctcaagaggatcagcctgttgaagagccatggttatttgaatctatggtggaagcaaatgaaactatagttcatgctgatggaaaaatagaagccaaggatattatcagaaagctaaggaaaatagaaaagcctccagcacctttggatgagaataagccccctacttgtgaaccttcatcaagagttatacttattaactcctctgtctgcactatgcagagaattgcagtattagaagatgggaagctagttgaactcctgctggaaccaatcaagaacaatgtacagtgtgatagtatttacttaggtatagtaacaaagcttgttcctcatatgggaggagcatttgtagatattggaattttaaggccttcacttatgagcataaagcaaaaccgagatccttttgtgtatcctcaagttgtaaagaacagtagagcagatcctgttgatgattcttactataatgaagataaccttccaacttatgacgaagatgatgatatgagtgatgatgagtttgcggatgaagaaactcatgatggctcatcatcatttccagttgagaatattacagataatgaagaaggcatggctgatgctaaaatagacattgtcgatagtactgaatttgaaggcatttctggttatgatgaagacaaagatgatgaaaatgatcacatggaagatgaatatagtgaggaaatactgcaagcagatcagtcagaaatttccaatgatcttaagactttatcttcaattcaacatgctttgagagaatctgatgacgacacaaatggaagcaggtggtctcaagttcgcaagggcactaaaattatggttcaggttgtcaaggaaggattaggttcaaaaggtccaacacttagtccatttccgtgcctgcgaagccgattttggatattggtttcccgtggtaacaaagttggagtatccaaaaagattactggtatagagcgcaccaggttaaagggaataacaaaattattgcgacctcctggatttacattgacagctcgtacagtcgctgctggtcattcttgggaggaattgcagagggaccttgatggcttgctatctgcctggaaaggaataacggaacatgctcaatctgctgccttggctgctgaggagggagtggatggtgctgttcctgtaatgttgcacagagcaaagggtcaggctctatctgttgttcaagatgattttaatgagaaggtgaagagactggttgtggattctcctcgaacatatcatgaggttacaagctatctccaagaagttgcacctgagctctgcagtcgagttgatctttatgagaaaagaaagcctatatttgatgaatacaacattgagaaggagatagacaatatcctttgcaaaagggtaccgctacaaaatggtggttctctggtcatagaacagactgaagctcttgtttcaattgatgtgaatggtggtcacagtatgtttggtcagggaacatcccaggaaaaagctattttagaagtcaatcttgaagctgcaaaacaaattgcccgtgagttgcgcttgagggatattggtggtattattgttgtggattttattgacatgacagatgattcaaacaaaaggctagtctatgaagaaatgaagaaagcagtggaaaaggatcggtcaacagttggtgtttcagaattatcaaaacttggtttgatggagataaccagaaaaagggttcgaccaagtgttacattcatgatcagtgagccttgcacatgctgccatggtactggtcgtgtagaagctcttgacacatccttttcaaagatagaacgtgaaatatgtcgacgccttgctgcctctcggcgaaaatcagaccctgagaaaccaaagtcatggccaagatttgtgcttagagtggatcatgagatgtgcacatatttgacatcggggaagaagacaaaactaggacttctgagtagctccctcaaagtgtggattttattgaagatcgccagaggtttctcccgtggagcttttgaattgctaccatactcagaggagaaggaaaatggtgaggagaaagaaacatcatcagagtcaccacagaaagagggaagccccaaactctctgtgtttcctatcaagaagtggatgagccgtgcaaagcgagcgaagtgaacctcttaaaaacgtgacaattttattggcatgtgcccttccgggctattcacagattataataacaagagcaaaatcaagaagagggtgatgcatttgattcgcagagatcccagcatcagatatccagatgacctcctgaccaaatt

SEQ ID NO: 366 - DNA, 994 bp, Setaria italica
atgtttgtcgtgaagtgctctgatgattgaaagatgctgtttcggttaatgctcttcttctgcaagtgttactgtcaaaggtgtttttttttcgttgtagcttggacttggagtctatattgcagaggtcccctcaattttttctgcactgtagcaggacaatcgagcagtgagcttaaagttattgaggatgtcagaacgttctgagagtgcaactgaaaagattatgagcagcatcattgacaccattgctgacaatcttcctaagcagaagtctgggcaatttggtccaggctcggtctctgacaaagtgaagaacaagctgtttggtcgtcagaagaccctgcatggagctctgggtggtggaaaacctgctgattgcctgttatggaggaacaagaagatatcatcaagcgttctggctgttgcaacagctatctgggttttcttcgagtggcttgattaccacttcctgacaatcgtttcatttgcccttgttcttggaatggtcgtccagtttgtctggtccaatttctcaaacatgctaagcggatctccttctcaagtgccccgagttgagttgcctgatgagctgtttgtgaacattgctgttgcaattggtgcgcaaataaacaagttcctgagcttccttcaagatctgtcttgtgaaagaaacttgaagcattttgtagtggcgattgctggactgtgggctgctgcagtgattggaagttggtgcaatttcctgacagttatatatattggatttgtttgtgctcacacacttccagtgctctacgagaagtatgaagaccaagtcgacaatttcctctacagccttcttggtctgctgcaagatcagtatcagaagctcgaccaaggtgtcttgagcaagatacccaaagggaacctgaaggctaagaagaacgagtagtttagcagctggatgtcaagaatgaatgggctggtgaactattgctgtgccctcttgtag

SEQ ID NO: 367 - DNA, 1860 bp, Setaria italica
aacccttctcccacatttatcccccacgctgcacatccttctccggtttctccccttctcctcaacccaccggcagcagcagcaccgtaccgacaccgcggcgccatggccgcctcccaccaccaccgcggccacttcttcctcctcgccctctccctcgccgcgtccctcgccgccgccgccgactcctcctccacccacaacatcacgaccgtcctcgacgggcggtcggagtacacgctgtacaacagctacctctccgagaccaaggtgtgcgacgagatcaacagcgagcacacggtgaccgtcctcgtcctcaccaacggcgccatgtcctcgctcgtcgccaacctctccctcgccgacatcaagaacgcgctccgcctcctcaccctcctcgactacttcgacgagaagaagctgcactccctcgactccggctccgagctcaccacctcgctctaccagaagactggccaggccgctggcaacatggggcacgtcaacatcaccgacctccgcggcggcaaggtcggattcgcccccgccgcgcccggtgccaagttccagtccacctacaccaagcgcgtcgacgaggagccctccaccctctccgtcctcgaggtctccgaccccatcaccttcccgggcctcttcggctccccgtcggcctcttcggtcaacctcacggacctcctcgagaaggccggctgcaagcagttcgcgcgcctcatcgtgtcgtccggggtggtcaagatgtaccaggccgccatggacaaggcgctcacgctgctcgcgcccaacgacgacgccttcaaggccaaggacctgcccgatctgagcaagctctccagcgccgacctcgtcacgctgctgcagtaccacgcgctgccgcagtacacgcccaagtcctcgctcaaggtcgccaagggcgacatcccgaccctggcgtccaccggcgcgggtaagtacgacctctccgtcgtctccagcggcgacgacgtgtcgctggacaccggcaaggacaagtcccgcgtcgcgtccaccgtgctcgacgacacccccacggtcatcctcacggtggacaaggtgctgctcccgcccgggctcttcggcggcgcgccgtccccggcgccggcgcccggaccggccgccgacgtgcccgcttcggccccggctcccgaaacatccgcgcccgcgccctctcccaaggccgccggcaagaagaagaagaaggccaagtccccttcacactccccgcccgcgcccccgtcggactcgcccgacatggcccccgccgacgcccctgagggcgacgcggccgacaaggtcgagtcgaagaagaacggcgccgcggcggcggccgcgagcttcgcggccacgggggcctgtgtcgccctggccgtcgcgtccttcttgtgagcgggcgagcggcaggtgttcgacgccgagcccgcccccgtagttctctctctctgagcatgcgtgatccgacgcgatgcaatctgttgttgctcgtgagttctcgtgggctccattgataatttgacatgctcatctcatcaggtgtttcttctcctccttgtttgctggttggtagttagtaggaagtaggatttggtcctccacttctcaggtggagaccgtgattgtgatgcttttgctagtattgagcccggaactgtcatttgaggttgatcttgtgtcttgtgctccttccaggctccagctgcattttgcatatccagccagtagtttcctgcagcttcttgcaattccttgtcattctttgatctttaaccgtactacgccgccggcgatggcccttgtggcaggaggttggattgatgtggctaatga

SEQ ID NO: 368 - DNA, 1393 bp, Setaria italica
ctcctccaatcctccgaacgggcgctccacggccgactcagcgcctcgacctccgatccagcggccgaaggcagagagaggtgggagcagcgagcgcatttgcaaacaattcgactggcccaatggagcaagaagacgaatcagaaggtgctgcagcggagcaaccggcggacgaagcagaggagcagctcgccgacgatctcctcctgcacttcgagcgagtcctccactccgaccccctcattgacgaggtggggttcttgcatccgacgcagttcggctcgctaggctgcggccaagatggcgattctgcatcccaggctccggagttccagcacaggtacttctggtgcagagaccacaagcttgccatctgctctgagatcctgcccaagctctaccgcgccgcccgcgatgcgtactacaacacgagaaatgctccatcacaagcagttcatctgatgagcctcaccaaggtgctactcatactttgccctgacatgcttaccgcatggaactccaggaagatggttctgtcggagaaatatgatctcacaaagctcaaggatgagctgcaattgtgtgcgctgatcctttcctactcgccaaagaacgagagcacatggagccacaggagatgggtgttaaaacaagttgcagagcaaaaccaagatatggcacagcttgtagagaaggaatctgtactagtgaaagagatagcagagaggtcaaagatgaactaccgtgcatggaggcatcgatgctggcttattccttacatgacaagaaaacaggtgctggatgaactgaagaagtcaacaagatggagtgaactacatgttgctgacaactgctgctttcactaccgcaggtccctgcttcttgcactgctagacagttgtctagggaatggagaggattctgtcagttgggagtcagaaacttgcatgctctggaaggatgagctgaggtggaatgaaatgcttatcagacgctaccaagggagagagtccttgtggaaccaccggaggttcctttcacaatggtggattcggcagttgttttctgttgaagaaacctgcccctcaacgacatcccaggtggatctgttcatcacccaggagataggcctgctgtcagagtgcctgaatgaccctgcggatgagtttggggagtcatgcgtccaagcagagctttcagcactctacattctgtggatatcgaagcaagtcccagctgtgaaagggaagctggaagagaggctgcattctgtttccattgtggggttgaaggatgttctagtaagagcctgccgaccggagaagaggtggctgtggatgaatctgcttggcctgcctgatcgatcacagtgacgacatagcattgcttattg

SEQ ID NO: 369 - DNA, 1367 bp, Setaria italica
ccgcctgtctccagagttcagacagaacatcgatgggcaaaagcgggaagaagcccagggaatcgcaccggcagggccgcggccgccgcgcgtcgcacttcgacgacgacttgccttcatcagcctacgacgccttaccgccccaccataatgactccactgacgacgacgacgacaccaacgaagcaacagcggaggacgaacgagaggaaaatggggaagctggcgagcaggaccagtggccagcagggtccatgccctccaagtttcacctgtaccagctctccgtgcagtctccaaagggggacatcagctacctgcaaaagttcttcctgatgtacgttggcgggcgcgtccctctccacctgcaggaggatttctgtggcacggccctcctcagtaccgagtggatccgtactgatgcaagaaggacagcaatcggcttagatttggaccttgagtcacttgagtggtgccttgaaaacaacctaagcaagataggagctgatggctattcaaggatgttgcttttccatggaaatgttctacaacccaaggaagcccgtcttgtcaagcaaaagttcagtgatcttgtgcaaggccttgatgtaagcagcgagaatggctcttcaggaagtaacagttgcgagcagccaggtcttgctaattcgaagtgcttagccaattcaaccatgtcagaggcagctttgcctggaagggatattatctgtgcattcaactacagctgctgttgcctgcatagtcggaaggacttggttttgtatttcaggcatgcattcagctctctctcgaaaagaggtggcatatttgtaatggatgtatatggtggcacatcatctgaacgcaagctacgtctccaacggaaattccccagcttcacgtatttctgggatcaagaagagtttgatatcataagtcgccaaacaaggatcagtctccactttcaagctggaaagaagcaaatgctgcggcatgctttcacataccattggcgcctatggtcgataccagagatcaaggactgcttggaggaagcaggattcaagtccatccacgtttggatcagggagatgccaaacacccagtcaaatggaaacgccaaggaatacaatgccaaccgagatgtgaagtacgaagaatcgcagcgtttcaatcaaggagacgcttggaacgcctacgtcgttggcgttgcaaacatctagctggcgcatggcgcatacgcgaatgtgatggaacctggtggctcttagttttccctttcaattaatgttgtctgaacgctcacgcttttatcatgacttttgcctcgcattgctgcaaaggtatgcagagtgtactactattaa

SEQ ID NO: 370 - DNA, 1067 bp, Setaria italica
acagtaacacaagcacctgagcgctcagacaggtcggaatggcgctcgccgccgccgtcctcctcttgctccctggcattctcttcacagcgatggcggccacgccgtaccctcacggccgcggcggcgacccgctcctcggcgcgtccaagaagtacgagggcagctccgacctggtggacctccggtaccacatgggccccgtcctctccgccgcgccgctccgcctctacgtgctctggtacgggcgctgggaccccgcgcaccaggccccggtccgcgacttcctcctctccatctccgacccgtccccgccgcggccctccgttgcggactggtgggccaccgccgcgctctacgccgaccagaccctcgccaacgtcacccgacgcgtcgcgctcgcgggggaggccgccgacgagtccgcctcgctcggccgctcgctctcccgcctcgacatccagcgggtgctcgcctcgaccgtcgccgcgggccacctccccgcggacacccgcggcggcgcctacctcgtgctcacggcgcccggcgtcggcgtccaggacttctgccgcgccgtctgcggcttccactacttcaccttcccgtcgctcgtcggccacacgctcccctacgcgtgggtcggacacagcggggggcgctgcgccgacgtctgcgcctacccgttcgcgctgccgtcctacatgtcccggagcggcatggcggcgctgcgcccgcccaacggcgacgcgggcgtcgacggcatggtcagcgtcatcgcgcacgagctggccgagctcgccaccaacccgctcatcaacgcgtggtacgccggggaggaccccaccgcgcccaccgagatcgctgacctctgcgagggggtgtacgggacgggcggcggcggcgggtacgccgggaaggtggcggtggacaagcaggggaggagctggaatgtgaacggcaggaaggggaggaagttcttggtgcagtggctctggagcccagaggctaaggcctgcgtggggcccaacgccagtgactaggctgcgttcgtcaccgctagcatgtag

SEQ ID NO: 371 - DNA, 1637 bp, Setaria italica
tccgcatgaactccgaagccgaatgcgcagcagctccggccgccgccgatgcggtgggcggtggcggcggcagggcggaggtcgacacgtcggcgccgttcgagtccgtgcgggaggccgtcgaccgcttcggcggcagcgccgcctggttcgcgccctccaagaaacatgaacactctgaacaagctgcagaagccatcgacgtacaagagcaggctgctcagctagaaaatgaggttgcccgcaaagagagggagactcttgatgtgttgaaggagctggagtcaaccaagaaagtcattgcagacctgaagctgaaaatacagaaagaagccactgaaacatcccctgatgaagctgtcaagtctgaggaaactgatcaggtttctgcgccaggacctgaagagcagcaacctgaaaatgttaccgtggatatggatggcatggaaggcatagaagaaaatccgcagctgtcttctggttcagttttggtggaacttgagcaagccaaagaaatactgaacagaactacaagtgatctggcacaagtgcgggctgcagttgagttactgcgaaatagcatagcgaaggagaaaatattacttgaaagaggccaagaaaagctttcctctaacacctccttggtttctcatttggaggatgagcttgatcagacagcacaaaagctggaaactctgaaggatctgcagaagagacgcaaagatccctcagacatttttattgagatcaagaaaatgacaactgaggttcagcagctcaggagcatggcaaatgattcaaaatctgaagcgatgttgttggctgcagaaatcgagcaggcaaaggccagcattagcacagctgagatcaggtgtattgcagccaaaaagatggaagaagcagctagagcagcagagtcccttgcacttgcagagatcaaagctctattgagcagtcaaagttcttttgaaggtgacaactcttctgatggagtgactctctcaatagaggagtatttcacactgtgttccaaaactcttgaagctgatgaaaactccaagaagaaagtaggagatgctatgttgcaggtggatatagctaacagctcagagtccgagtcggttaagaggctcgaggatgccaaagttgaggttgaagaatgcaagaaggcgctacaagaggccctaaagagggttgaagctgcaaaccatggaaagcttgcagttgaagagatccttcggagatggaaatctgagagtggacacagaaagcggtctatctgcggatctccgaagttcaaaaacgcagcccatcctcgtaaagattcacacagcatggatattactgatgatgtttcagatagatctttcaagcaaactttgtcaattgggcagatactgagtatgaagttaatggggcctgatgggtatgacaaaagtgtctgggacgacaaggcaagcgagatgccaaatatctcacttggtcagattctgaaccgcagtggtgttttgtgtagagaagatatggctccccgcaaaagaatttcaggaaagaggaagaaatttgcattgactgggctttctgttctcctggcgaagcaatctaagagcaagaagaagagagaatccttttaataa

SEQ ID NO: 372 - DNA, 2235 bp, Setaria italica
atcatcaacggccaagctcgccggcgagctccaccgccatgtcaagtgacccctccgcgcgctcgtcgccttcctcctccgccgcgtcgcctcccaatgacgcgcggcggagagaccaagcaggacaggcgacgccgccgccagggggagaggcgatcgacaccagcggcaagagccgccggggccggcggcggcgcgtgccctggtgcccccccggcctcggcgcggcgtggccgctggacccgcgggcgaggtgggtccggcagtggaaccgcgcctacctcctggcctgcgcggcggggctcatggtggacccgctcttcctgtacaccgtgtccgtgagcggcccgctcatgtgcctcttcctcgacggctggctcgccgccgctgtcaccgcgctgcgctgcgcggtggacgccatgcacgtgtggaacatcgcgacgcagctccgcttgacgcggggcacggcggggagcaagcgcgcggaggggagctcgggcgacgaggagcagcaggcggcggcggccgcgggggaggaggaggacgacgacgaggagggcgccgacgaggtcgcgcgcaagctcccggcgggcgcgaggtccaagaaggcctcggtgctggacttgttcgtcatcctccccgtgatgcaggttgtggtgtgggttgcggcgccggcaatgatccgcgcggggctgacgacgccggtgatgacggtgctgctggtggcgttcctgctcgagtacctgcccaagatctaccacgccgtgcgcttcctccgccggatgcagggccactccggctacgtcttcggcaccatctggtggggcatcgtgctcaacctcatggcctacttcgtcgccgcccacgccgtgggcgcgtgctggtacctgctcggggtccagcgtgccagcaaatgcctcaaggagcagtgccagctccaggcggcggccggggggtgcgcgcgcagcggcgcggtggtggcctgcgcagcgccgctctactacggcggctccccctccgccgccgcggcggggcacctcggcgccggcaggctcgcgtgggcccgaaacgcgccggcccgtgccacgtgcctcgccagcagcagcggcgacggcagcggtggctaccagtacggcgcgtacaagtggacggtgatgctggtggcgaacccgagccgggtggagcggatgctgctccccatcttctggggcctgatgacactcagcacgttcggcaatctggagagcacgacggagtggctggagatcgtgttcaacatcctgaccatcacgggcggtctgatcctcgtcaccatgctcatcggcaacatcaaggtgttcctgaacgcgaccacctccaagaagcaggcgatgcacacgcggctccgcgccgtggagtggtggatgcgtcgcaagggcctgccccgcgggttccggcaccgtgtgcgccagttcgagcggcagcgctgggctgccacccgcggcgtcgacgagtgccagatcgtgcgcgacctccccgagggcctccgccgggacatcaagtaccacctgtgcctcgacctcgtccggcaggtcccgctcttccagcacatggacgacctcgtcctggagaacatctgcgacagggtcaagtccctcatcttccccaagggggagacgatcgtgagggagggcgacgtggtgcggcggatgctgttcatcgtgcgtggccacctggcgtgcagccaggcgctgcggaacggcgcgacgagcagctgcacgctggggcccggcaacttcagcggcgacgagctgctgtcgtggtgcctgcgccggccgttccgggaccggctgccgacggcgtcggcgacgctggtgacgctggagagcacggaggcgttcgggctcgacgccgccgacgtcaagtacgtgacgcagcacttccggtacaccttcgccaacgaaaaggtgcggcgcagcgccaggtactactcgcccgggtggcgcacctgggctgccgtcgccgtgcagctggcgtggaggaggtacaagcaccgcaagacgctcgcgtcgctctccttcatccgcccgcggaggccgctgtcgaggtgctcctcgctcggggaggagaagctacggctctacaccgccatcctcacctcgcccaagcccaaccaagacgacgacttctaggcttctagcctctaggccggtcgaggctggatggctggctggctggcttcatcatgcaaattag

SEQ ID NO: 373 - DNA, 1647 bp, Setaria italica
cgatatccgttgcagtacgacggacttgaggagcgctctcgcttgctgccggcggcaactgcagcgatgcgagccgcggcaggaggccgcgcggtgttccacctccagcacctccgcccgcgccctccatgccgagcttctcctgctcccgccaccgcggtcctcccccactccgcgcccgcgagccgcgcctaccaccgccgcctccccaaaggctttttacctactctggagccgggggtttcagcagtctacttgtgtcggcgagtacactccacaacatgtagtgtttcattggatggcagattacagggggagttagatggtgcaaagggagaagtgcgaaaacatgaaacagttggtgcatttcaaaaaataccaatggtgatgcctgcaaccgatatacttatgtcagcacaaaggaaatcaagaaatgtgccaccgacaaagggcatagcaaatatcgctaagcgcgaaaggaacaaaggtgcgaaacaacttgatgccttaatgaaagaactttcagtaccactgagaacatacacagaaaacttccctaagaggagagatttgcatccttatgagaggtctctcattgagttgacttttggggagggttattatgagcaggttctaggacgagtcgatgctctcaggaaaaggattacttctgttggaaagcaacatgcttcagtgtgtgctaagtcaacaacaaaacgtgaagcagaggagcgcctcgctgagggcaaaaagagacttgaagaagctttccagcatggacagcatgccattgatgatttagtaaatgtagcaaaggctttgcgttctatgcctgttgttgatctacatataccgacactatgtctagttggatcgcccaatgtgggaaagtcatcattagtccgcatattatcatctggaaagcctgaggtctgcagctatccattcacgacaagagggattctaatgggtcacattgtatccaatcatgagcgttttcaggttacggacactccaggactacttacgaggcatgatgatgacagaaataacatagagagattgacacttgctgtcctgtcttatctaccgatcgctgtcctgtatgttcacgatctatccgaagactgtggaacctcagtagccgatcagtacacaacgtacaagcatatgaaggaaaggtttggtgatcgcctatggatcgatgttatatccaaatgcgatcttttgggcaagaaagcgcctataagctttgacgacgctgatgaagatgtgacacaatacagaaaattcggtccagaaggtgccctccgggtatctgtgcagagcgaaatcggcgttaaagagctaaaagaaagagtgcaccagctcctgacctcccaaatggctcggatcaaagctgacaaggcggagcatgaaacacaggaagctggcgttagtgttccttggcgaagttagagaatgaatacttgcgcacgttcgatgtttatgtaaattttccactcatgaggaccgcaactaatttgtgagtgtcttgcaattttggccatttcgatgttttagtatgtctccttgctaagttcgtcatttttctccacaagctcactgcaagtatttttcagcagggagttgttcctttcaagacca

SEQ ID NO: 374 - DNA, 1238 bp, Setaria italica
gggacatgagctgcttcggctggttcaagcggcggtcgaggagcgtcggcgggtcggcggggaagcgtggggcgtcggcgccgccgtcgggcccggcgaccacgacgacggtgtcgggggtgagcacgagccggtcggacgactccggtgcggtgcggccggtgagcaagtcggcggggtcggccgcctcgtcgcagtcgcagcggagcatctcgtcgctgtacgaggagcggggccacggccagctgcgggtgttcgactacgaggagctcgaggccgccacggccgagttcagccgcgcgcagaagctcggcgagggcggcttcggcagcgtgtacaagggcttcgtccgcgccgccgacggaaagggggaccgcatccccgtcgcagtcaagaagctcaaccagcgcggcctgcagggacataagcaatggttggcagaagtacagtttcttggtgttctggagcacccaaatcttgtaaagctacttggatattgcgctgttgatagtgaaagagggccacaaagattgttggtgtacgagtttatgccgaacaagagcttggaagaccatttgttcaggcgagctaatcctcctctgtcgtggaacggaaggcttcaggttatcctgggtgctgcagaaggattggcttaccttcatgaaggcgtagaagttcaggtaatctaccgggacttcaagacctcgaacattttactggacaaggacttcagagcaaagctgtcagacttcgggctagccagggagggaccaactggagcaaacactcacgtctcaaccgcggtcgtcgggacgcacgggtacgcggcgccggagtacatcgattcggggcacctgacggcgaagagcgacgtgtggagcttcggcgtggtgctgtacgagatcctgacggggcggcggtcgctggaccggaacaagccggtggcggagcagaagttgctggagtgggtggcccagttcccgccggacagccgcaacttccggatgatcatggaccccaggctccgcggcgagtactcggtgaaggccgcgcgggagatcgccaagctggccgacagctgcctgctcaagaacgccaaggagcggcccaccatgagcgaggtggtcgaggtgctcaggcgggccgtgcaggcggccgagccggatggccgggcacccggtgccggcgccgtcaaggggaagagagccgacgcggccgcgccgtccaggaggtgataa

SEQ ID NO: 375 - DNA, 2023 bp, Setaria italica
tagagtgtggcttgtggtcttgtagccaagtttttgctgatagcaagagagccttcgatccgattgcagcggcctcccaccgctccagctttccaatcggcggccagcgccctccagttctcccacttcgcttcaatccaagaagcgcttccacctttttttttcttcccttttttctccctcagtcctcgcccgtttgtttccttcccccaagaagcttggagtaaggcgccgccgcggcccaccactcgcggaggtcggtgtgccttggtagcacgcgctgtccccgggctccacgcatggcggcattacagcaccttggcaaggcggtggacgggaatttccggggggcggcggcggccggcgggatggtgcggccaccgcccccgagcctcatcgccccgaacggcaccgccgccgcccccaggtcctccgcgccgccgagccgtcgggaagagggtgcggcggcggcgaacggcggccctgacctccccgcgccccgttccgtcagcaagccgccgcctgggaagaagttttccaccagagcagctggcggcaacaagcccaggaagccggcgccgccgctctggcagtggcaggctgccttcttcgtctccttcgcgctcaacgtcgggctcttcctccgcacccacccctacgtcaacagcacggtccctccgcaccacgaggagcaccagcaggcctgcctgatgcatctcgacgctgcagacaacagcggcaggagaacggcgaggcagcaggaggagcccgtggcggccggggcgccgtcgacgggcaagccggcggtgacgccggagtccgtgatcaacctcgaccacggtgacccgaccatgttcgaggagttctggcgcgggacgggttcggcggcggagatcgtcatcccggggtggcagaccatgagctacttctccgacgtcggcaacgtgtgctggttcctggagcccggcttcgaccacgaggtgcgccgcctccaccgcctcgtcggcaacgccgccgtcgacggctaccacgtcctcgtcggcaccggctccacgcagctcttcatggccgcgctctacgcgctctcgccgccagccgccgccggcgccggcgcgcccatgagcgtcgtctccaccgcgccttactactcgtcctaccctgccgtcaccgacttcctccagtcggggctcttccggtgggccggcgacgccaactcgttcaagggcgacgcctacatcgagctggtgtgctccccgaacaaccccgacggcaccatccgggaagctgtcctgtcctccgagtccggcaatggcatagccgtccatgacctggcctactactggccccagtacacccccatcaccaagcgcgccgaccatgacatcatgctcttcaccgtgtccaagagcacagggcacgccggcacgaggatcgggtgggcgttggtgaaggaccgcgacgtcgcgaagaagatgaccaagttcatcgagctcaacaccatcggcgtgtccaaggactcgcagctgcgcgccgccaaggtgctcagggcggtctccgacgcctacgagctcccggaggcgagggaggagcaccgcctgttcgactacgggcgccgcaagatggcggagcgctggagcatgctgcgcgaggccgccgccgcgtcgggcatcttcagcctgcccgacgagacctccggccactgcaacttcgccaaggagacggcatccactaaccctgcgttcgcatggctgcgctgcgacagggaggacgtggaggactgcgcgagcttcctccggggccacaagatcctgacccggagcgggagccagttcggagcggacccgaggtacgtcagggtcagcatgctggacagagacgacgcctacgacatcttcgtgaggcgcctcgcctcgctcaagtgaagtgatcgaggaggacgacgcgtggttcgaccatcgatgccgcacacctccggatgtggcgtcgccgcgtcggcatgcccgtgggagcatgagtagagcag

SEQ ID NO: 376 - DNA, 567 bp, Setaria italica
cgagtcctccgtaaccctaaacccccaaaaccctcgtcgcctcctccgtccatccatccaatcccaatcctcggggcgagcgcgcgcggagagggagaagattcccacggcgatggcggcggtggctagggttttccgcgggtcccggttcctcatgtccccggcggccggcgcggcggcggcggcgggggccaagaaggcggcgccggcgccccaggtcaccaaggcggacgcgacggcggcgaaggagaagcgcgggatcatgaagccggtgccggtctccgaggagatgcggaggttcgccggcggcgcgcccgagctcgcccgcccccaggccgtcaagctcatctgggcccacatcaaggccaacggcctccagaaccccgcaaagaaaacggagatcaactgtgatgccacgctcaaaagcttgtttggtgggagggacaaggttgggatgctggagatctcgaagctactgaaccctcacttcctgaagaactaacaaaatcagcagatggatccagcgatagtactttattggatggccaatccatgttaagtccaggt

SEQ ID NO: 377 - DNA, 476 bp, Setaria italica
aattccggagcagcaagagaggaggcatggggttcgtgctggtgatctccctgcccttcatcttcttctccatcctgctcggcttcggctgctacttcctcggcaagcacaggggccgggaggagatgcgggccggcgtcggcgcgcagatctacggcacgccgctgccgccgcccggcgtcgtcggcgggtcctcgccggcgcatgagccgttccacatgaagaaagaaggggctgagaacgtctgagtgggatgtcgtttcgggatttgtttggtttaactgatatagttcattcctttcatctatgctatgttgcggtgtacattgagcaatttggtgcctgtatttgttacttcgttcaggttcaggggaaatggtgattgtggtgtgatataacgtaatcacagtatgtgcttgtaagcagtaccaatatgcattgtataatggtttgtgtttctcaatgtttggcaagct

SEQ ID NO: 378 - DNA, 579 bp, Setaria italica
cgattcctcgtctattccagagcccgcgctcagctcgtcggcgagatggcgtacatgcgcgtgacgcaccgcgacgaggagggcaagaaggtgacggagaagatgcccatcccggagacgcgccgcccggacacggccaagcacttcgagcgcaagctggaggagcagggcttccaccgcctcgagcgccaccccgccaacgcgccccgcggcgtcggcatcggcaccccgccgcccaagtccgggcgcggcggcaagtacacctgggagggccccggcggcctcgtccaggacgagctcgacccggcgccgccagccatcgaccccaatgatcccaactacgaggaggacgatggagccgtcggggctgaggatgatgcggccaaggaggtggtcgtcggggaggtggaggtcgccaaggtcgccgaggagagggacggcgtcgccagggttgacgtcgcgccgcagctcctccaggagcagaagcagtagctagttccggttgcttcagtgctcactgctcagctagctcatcgtggtgtgggttttgctccgtgtggagctaatcaacttgggtag

SEQ ID NO: 379 - DNA, 2711 bp, Setaria italica
actccagcctccaaggaaccgtagcagccgctgccacttcagcgagtagcgaagatgttcggagtgaagatcccgatcatcgacgacctgacgggcggcaacaagcatggccacttgaatggcaacgtggtgctcatgcgcaagaacgtcctcgacgtcaacagcatcgccggctccctcatcgacggcatctccgagttcctcggccgcggcgtcacctgccagctcatcagctccacagtcgtcgaccccaacaacgggaaccgcggcaaggtgggcgcggaggcgagcctggagcagtggctgctgaacccgccgccgcttctcgccggcgagaaccagttcagcgtcacgttcgactgggaggtggagaagcacggcgtccccggcgccatcatcgtcacgaacaaccacgcctccgagttcttcctcaagaccatcaccctcgacaacgtccccggccgcggcaccgtcgtcttcgtcgccaactcatgggtctacccccagtccaagtaccgctacaaccgcgtcttcttcgccaacgacacgtacctgccgagccagatgccggcggcgctcaagccctaccgcgacgacgagctccggaacctccggggcgacgaccagcagggcccgtaccaggcgcacgaccgcgtctaccgctacgacgtctacaacgacctcggcaacccggacggcggcaacccgcgccccaccctggggggctccaagcaccacccctaccctcgccgcggccgcacgggccggaggcccacggagacggaccacgactgcgagagcaggctcacgctgctggatgacgacgtctacgtgccgcgcgacgagcgcttcggccacatcaagtcggccgacttcctcggctactccatcaaggcgctcgtcgacggcatcgtgccggcgctcaagggctacgtcggcgtcgagttcaactccttcaaggatattatccggctgtacgagggaggcatcaaggtgcccgacgtccccgcgctcgaggagatccgcaagcagttcccgctccagctcatcaaggacctcatgcccgtcggcggcgacttcctcctcaagctccccatgcccaagatcatcaaagaggacaagaaagcttggatgagcgatgatgagttcgccagggagatactcgccggcgtgaaccccatgatcatcaagcgtctcacggagttccctccgaaaagcacgctggacccgagcaagtacggcgaccatacgagcaccatcacggcggcgcacatcgagaggaacctggagggcctgaccgtgcagcaggcgctggagagcaaccggctgtacgtagttgaccaccacgaccactacatgccgttcctggtcgagatcaacaacctggacgacaacttcatctacgccacccggacgctgctgttcctccgcggcgacggcacgctggcgccggtggccatcgagctcagcctccctgagctccgcgacggcatcaccgccgccaagagcactgtgtacacgcccacgtccaccaccggcgccgaggcgtgggtgtggcacctcgccaaggcctacgtgaacgtgaacgactactgctggcaccagggcatcagccactggctcaacacccacgccgtgatggagcccttcatcatcgccaccaaccggcagctcagcgtgacgcaccccgtgcacaagctgctcctcccgcactaccgcgacaccatgaacatcaacgccctcgcgcgccagaagctcatcaacgccggcggcatcttcgagatgaccgtcttccctcgcaagtacgcgatcgagatctcctccaaggtctacgggagctggagcttcgccgaccaggccctccccaacgacctcgtcaagagaggcatggccgtcgaggatccctcgagcccgtacaaggtgcggctgctgatcgaggactacccgtacgcgtcggacgggctggcgatctggcacgccatcgagcagtgggtggctgagtacctggccatctactaccccgacgacggcgtgctccaggccgacgccgagctgcaggcgtggtggaaggaggcgcgcgaggttgggcacgccgacctcaaggacgagccgtggtggccgaggatgacgacggtggcggagctgaccagggcctgcgccaccatcatatggatcgcgtcggcgctgcacgccgccgtcaacttcgggcagtacccctactgcgggtaccacccgaaccggccgtcggttagccggaggccgatgccggcgccgggcacggaggagtacgcggagctggagcgcgacccggagaggttcttcgtgcgctccatcacctgccagttccaggccgtggtggggatctcgctgctggagatcctgtccagccactcctccgacgaggtgtacctcggccagcgggacacgccggggtggacgtcggacgccagggcgcaggaggcgttcaagaggttcggcgcgcggctggccgagatcgagaagcgcgtggaggccatgaacgcggacccccggctcaagaaccgcaacagcccggcaaagttcccgtacacgctgctctcccccaacgtctccgaccgcgagaacgccggcgtcaccgccaggggcatccccaacagcatctccatctgatggatcggctgaggataacaatattcaacgaggaagtagcggtgggtgattcccgttatatt

SEQ ID NO: 380 - DNA, 1020 bp, Setaria italica
tctctcgtgcgcgacaaggcgtcctcgggcggcgtgagggcgcgatggcgagtggctgcggcgggcggcgggggcggaagccgagggcgagggcgcggggcaaggggaagaagaccaggtacctcagcctcagcgatgtcctgattaaggtggaggcggaggcggggacgccgccgcggtcgcaggaggatgagcccgcgccggtgtgggaggaggcggaggtgaagcaggaggacgccggggatggaggcggccagcagcagccgccgcagcaggtggagccgttcgcgctgcacaacgaggcatccaccctgttcgcggcgctgccggcgccgtcgctctccgacatcctcggcgcctccgctggcggcggcgacggcgacgagtcgccctcgccgtccgcgtcgccggacgggggttccggggggtcggagttgccgtgcgcccaagaggaggacctggcgcggcgcgcgctaaggggcagggagcgttgggtgtactgcagcagcggctcctcgccgacggccaccaccgccaccacgtcgtcgtcgtcgccgtgctcctccgcggcgagcacgggcgcctcggtgcggtcgctgctgctcaagctggactacggggagatcctcgccgcatgggcggaccgggggtcgctctacatcggcggcggcggcggaggcgcggacagcgacgccgcgccggagctggagctcaacgccgtgttggtggaggtggagccgcctgagcatgccgcgagtgcgccgccaccgccggcgccggcggcgttcgcgtggaccgcggcggagacggaggcggcggggcgcgagagggcggagaaggtgaggcgatacaaggagaagcggcggaaccggctgttcgcgaagcggatccggtacgaggttcgccgggtcaatgccgtcaagcggccgcggttcaagggccgtttcataaaggaacatgaggatatcaagctccagcccacatagcccccctggcttcttccatcaccacaaggatagc

SEQ ID NO: 381 - DNA, 1648 bp, Gossypium raimondii
aatcaaaccatcttccaccattctttgttgaacatatggctggaggggagcagaaaaagggtggaggggagcagaaaaaggctggcggtggagggaaaaagaaggaagtgaagaaggaaactggtttgggtctctcctttaccaaggatgagaattttggtgaatggtactctgaggttgttgtcaatggtgaaatgattgagtactatgacatttctggatgttatattcttaggccatgggcaatgtcaatatgggagaacatgcaaacgttcttcgatgcggaaatcaagaaaatgaaagtcaagaattgttatttccctctttttgtatctccgggtgttttgcaaaaggagaaggatcacatagagggttttgctcccgaggttgcttgggtgacaaaatctggtgagtctgatttggaggtgccaattgctatccgcccaactagtgagacagttatgtatccctactattctaagtggatcagaggacaccgtgacttgcctttgaagcttaaccagtggtgcaatgttgttcgatgggagtttagcaaccccacaccatttatcaggagtcgtgaatttctatggcaggaagggcatactgccttcgcaaccaaggaagaggcagacactgaggttcttcaaatattggagctataccgacgtatatatgaagaattcttggcaattcctgttacgaaaggcaggaagagtgaactggagaagtttgctggtggactttacacaaccagcgttgaggcatttattccaaacactggccgtggtattcaaggtgcaacctcccattgtttgggccaaaacttcgcaaaaatgtttgagataaactttgaaaatgaaaagggggaaaagtctatggtctggcagaattcctgggcatatagcactcgaacgattggggtaatggtgatggttcatggggataacaaaggcttagtgctgcctccaaaagtagcagctttgcaagttattgtgattcctgtgccctacaaagatgcagatactcaaggtatctttgatgcctgtgctgccactgtggcaatcctctctgatgctggtattcgtgctgaagctgatcttagagagaactactcacctggttggaagtactcaaactgggaaatgaaaggtgttccactaaggattgaaataggacctcgagacttggcaaataatcaggtgcgtgcagttcgccgtgacaatggagaaaagactgatatctctagagtctttttggttgaacaagtaaaaggaatgttggaaaagattcaacagaacctatttgatgtggcaaaacaaaaaagagatgcctgcattgaagttgtaaaaacttgggatgagtttataaaagctctcgggcaaaagaaactgatcttagctccttggtgtaatgaggaggaggtggagaaagatgttaaagctcgaacaaagggtgagatgggagcagctaagtctctatgtaccccatttgaacagcctgaacttccagaaggtactaaatgctttgcttctgggaagcctgcaacaaagtggacctattggggcagaagttactaggtttattcactttttaaaaccatctccttttcatggttctttgcctgatgtcaacggttctggtcatt

SEQ ID NO: 382 - DNA, 1499 bp, Gossypium raimondii
cacctgtcggaccaaagtaaacaacaaaaaaaaagggaaaataaggcaaagaaaatctttcatccatggtgggtcttggcgataacaacaatcccagttgccaaaacaacatcagcagcaaagcaaaagacaagaagaagaacaagaagaagaagcgtgggggaagcaagagaaagatgacggctgagcaaacctcggctttcaaatcggtgaccgaatgggtttatttagaccggcaccaccaccccaattcttcttcgacggcgggtttatcgtcgtgggtggtggatgattttggtgtgcaaaagagtttggggagagggacggagaaaatggtgtttgaattgcattcccattcgaaacacagtgatgggttcttgtctccttctaagctcgttgagagagctcatggcaatggggtgaaagttcttgctctgacagatcatgatacaatgtctggaatcaccgaagctgtagaagctgctcgcagattcggtatcaagataatccccggtgttgagatcagcaccatattctctccaagaaatcctgaaatggaggaaccagtgcacatccttgcatattacagcagctgtgggcccacgaggtacgaggagctggataaattattggctaacataagggagggacgttacgtacgtgctaaggacatggttttgaaactcaataaactcaagctacctcttaagtgggagcatgttacaaagattgcaggcaagggagtggctcctgggagattgcatgtggctcgagctatggttgaagcaggttatgtggagaatctaaagcaagcttttgcaagatatttatatgatggaggacctgcttattccacaggaagcgagcctcttgcagaagaagcagtgcagctgatatgtgaaaccgggggtttagcagttctcgctcatccttgggcactaaaaaacccgattcctatcataagacggttaaaagatgcaggccttcacggaatggaggtttatagaagtgatggaagactggcagcatacaatgacttagcggatacgtacaaccttctgaagcttggagggtcagattatcatgggagaggtggccatggtgagtccgaactaggaagcgtgaaccttccagtggtggttctgcacgactttcttaaggtagctcgacctatctggtgcagtgccattaaggacattctagagggttatgcaaaggaaccctctgatacaaacttcgccaagatagccagatttacaaggatgggcagtttcaagggaagtactcccttgagttgtggcaaggacttgattgatcgttgtttagcatcgtggttgactgccgaagaacagcagaatgatgaattcgaggccattaggttgaagctttcccatgctacgatcaacctcagtggagttcaagttcctatagagaccaaatagtacttgattggagggaaaaaaaagagattaggtaccatttgattcttgccattgttg

SEQ ID NO: 383 - DNA, 2513 bp, Gossypium raimondii
tcagctcaggtccttaggttgggaacttgatagtcatggatggttggctgaagggatctaatagttttgtggatagggtaggactaaatgacagtacggtcttagctttatctggtcgggatttcgataaccggtttaagaatgagaattgtgtcgatattccttcttcggaacctgttatgattccaggaaattcagggaacatggtgtcttcctttggaacttgttctgatagagttggactaaatgatggtacggtgttggccttatctggtcgggatttcgatagccggtttaagaatgagaattatgttgatgttcttcctttggaacatgttatggttccgggaaatttagtgccttcctttggaacctgttctgatacagtaggactaaatgttgatagccaacctgttccgattccgggaaattcagtgccttcctcgagtgtgaacgagggagatttgcatgaggattttgacttcagcgatgaagttcttaagtacataagtcagatgcttatggaagaagatatggaagataagacttgtatgtttaaagagtcatcggcagcacttcaggctgccgagaaagcattttatgaggttctcggagagaggtatccaccttctcctgaatatgatgctgatcaaaaccaagaaagctccgatgaaagtcatggtcaaaattgttggagatgtagtagtgcaagcattagtagtggtagcgtagttgatcccgggcacaaccatgatttcggtgagcaaagggctctgaacttcccgtcccaggctagttcatctcatagctcgggaaacagtattggtagcatggtagatggatatgcagattctccggtaagtactgttaggcttcctgaaatatttaacaatagtgagtctgccatacaatttagaaaaggcttcgaggaagcgagtaagttcctcccgaatggtggaagcttgtttgttcacggggagaatgatggattgtttctcaaagagctaaaggaagagactaaagatgtggcagtagataaggtggagaaggatgagatttcccaggatggatcaaggggaaagaaaaatccttatcctgaggatctgagtctagagtgtgggaggagttccaagcaatctttagtttatactgagtctgctgtaagccctgaaatgtttgatatggtgctactaaattgtcaaagtgtaaccgagcttcaaaaagttttgcaagatgaaacgagcaagaatgtgcaacagaacggacaattgaaaggatctaatggtggaaaggcacgtgggaagaaacatggtggtaaaaagaacatggtggatttgagaactctcttaaccctttgtgcacaagccgttgcagccgatgattggaggagtgctaatgagctaatcaagcaaatcaggcagcattcttcacctatgggtgatgggatgcagaggatagctcactatttcattgatggcctagaggcacgcttagctggttccgggacccaaatttacactgcgcttatcacaaagccgacttcagctgctgatgtgttgaaagcccaccatctgtttcttgctgcttgtccttttaagaagctctcaaatttcttctcgaataagactataatgaatctagctgaaaatgctgctaggcttcatattattgattttggtattctatatggtttccaatggccttgccttatacgacgtctctcgtctagacctggtggaccgcctaagttaaggattacagggattgatcttccacaaccgggttttcggccggcagaaagggtggaagagacagggcgccgtcttgcaaactatgcggaaacattcaaagttccgtttgagttccatgctattgctcagaagtgggacaccattcaaattgaggaccttgggattgatcgtgatgaagtacttgttgtgaactgtatgtacaggcttagaaatctactagatgagaccgtgattgtggagagtccaaggaataaggttcttaacttgatcaggaagatgaatcctgatgttttcatactggggattgtgaatggtgcttatagtgctccgttctttatcacgagatttagagaggctctcttccacttttctactttattcgatatgctcgagactaatgtccctcgcgaaattccggaacggatgctgattgaaagagagatatttggatgggaggcaatgaatgtcattgcatgtgagggtgctgaaaggattgagaggcctgagacttacaagcagtggcagatgaggaacatgagggccggtctcagacagttgcctctgaataaggagatcatgaagatagcaaaggagagggtagatacaggctaccataaggactttgtaatcgatgaggataatcgctggttgctccaaggatggaaaggacgaattgtttatgcactctcaacttgggttcctgccccttagaaggtaaagtcttgcgaagtactttatggtcggattgcaaccattgattag

SEQ ID NO: 384 - DNA, 546 bp, Gossypium raimondii
cccatttctccctctctcaaactcctttttgctttgctatttgaagtaaagaaagaaaatatgggtgccttggactctctttctgactatatttctgatttggtaaccgtccatggcaaaagaaagaagcgtaaagtcatgcagactgttgagatcaaggttaagatggactgtgatgggtgtgaaaggagagtcaaaaacgccgtttcctccatgaaaggtgtgaaatcagtggaggtgaatcgaaagaaaagctatgtgagcgttagcggatacgtggagccaaacaaggtgctaaacaaagtgaaaagcacagggaaaagagcagagttttggccttacgtcccctacaacttagtggcatacccatacgtagctcaagcatacgacaagaaggcaccgtcggggtacgttaaagaggcggtgcaagctttgccgagtccgaatgctgtggacgagaagtttgtcactttctttagcgacgaaaaccccaacgcctgttccatcatgtaggctggccaagagaattaaaggttaaggagggca

SEQ ID NO: 385 - DNA, 955 bp, Gossypium raimondii
tcctattcctttggaactctctctctctctccctcatttttcttctcctttcttccctcttctctcattcatttctctacttctctccgccatggtttcgcaccttgtcaccaccatccgaaatgtagttggaatcacagggaatgtaatctccctcttcttgttcttgtctcctgtgccaacttttattagaatttggaagaaaggatcagtggaacagttctccccagccccataccttgcaaccttaatcaattgcatggtttgggtggtttatgggctgcctatggtgcaccccaacagcaccctggttgtaaccatcaatggcacagggactgccattgagattgtatacctaaccctcttcctcatctattgccatgacaagaaaaagagagtgaaagtgatgctaatagtgctagttgagatgatttttattgcgggtgtcaccgctctggttcttatcatagctcacaccactcaacgtcgatccatggtggtcggaattatagctattttgttcaatatcatgatgtatgctgcccctttatccgtcatgaaactggtgatcacgacgaaaagtgtggagtatatgccatttttcctgtcactagcatcctttgccaatggtgttgcttggactgcatatgctttcctcccttttgatccttttattgctgttccaaatggactagggacattgtttagtttagcacagctgttgttgtatgccacatattacaagtccacaaagagaataatagcagcaagacaagaggccaagatggagatgcatctctcggaggtggtggtcaatggtgataataatgatcccaaaaagaactccacagcaccttagagacccatccttctactatatataactagagagggtgtttaattttgttatgaacatcaatcaccataaacatggtgctatgcagcagcttgttta

SEQ ID NO: 386 - DNA, 776 bp, Vitis vinifera
ggatccctttcatggcctgtcattgtgcttttccattctcatcatcaccgcagagggactgtttctccatgacccacaccagcctcaaaccttccagagcatccaaacccgttgttctctcttccattggcagcactaaagcctcctacaatgccctggtttttgaggctgctaggcttttgggtcctccagcaaaatttgacgcttcaaagctgaaagttgtgcccatgggagaagaaattgataattactctggaatcagcccaagagtatacaccctctcccactgtgactttacagctaatctaaccttaaccatatccaatatcatcagccttgatcagttgaaagggtggtacaacaaggatgatgtggttgctgagtggaaggaagtaaagggggaaaagtgtcttcatgttcactgttatttgagtggcccaagcctctttcttgacttggcagctgaattcagataccacatattctccaaggaattgcctctggtgcttaaagctgtgttacatggggattctgtgttcttcagagaacatccagagctaatggatgcaatagttcgggtctatttccactccagctcaactaagtacaattgtatggaatgttgggggccactgaaggatgctgcacagggaagacagggagatcacacccatggttcgttaacagcaagtaaggagggttctcgtcctcaaaattggggaaacccgaaatccatcttccaagctttcttcacgttccttctttgatgaaggcct

SEQ ID NO: 387 - DNA, 1409 bp, Vitis vinifera
gagccatggattatcacatctatggcttccccaatctcaagatgatcaacatcctcttcctcgcttctttcttcctcctctctacccatgcccattcttctgcattgcccaggaagccctcttcttcctccaactctcctcaaatcaactccaactctgtcctcgttgctcttcttgactcccattataccgagctcgcggagcttgttgagaaagccctcctcttgcccacccttgaggacgctgtcggcaaacacaatatcaccatcttcgccccaagaaacgaggctttggagcgtgaccttgaccctgagttcaagcgctttcttctcgagcccggaaatctcaagtctctccagactcttctcttgtttcatatcattcctaaccgtattggttccggtgagtggccggaggggctttccggagaccccacgcatagcaccttgtccaatgatcggcttcgtttggagagtaagggttctggtgtgaggagtgtggatctggcggcggtggtccaacccgacgccgttcttcggcccgacggggttattcacgggatcgagaggctgttgattccccggtccgtcgaggaggactttaaccgcaggaggagtctccggtccatttctgccgttctgccagagggggcgccggaggttgatcctaggacgcaccgcctgaaaaagccagtgtcggtccctgccggagcccctccggtgcttccgatctacgacgccatggcccctggaccctccctagctccagcgccggcgcctgggcccggcggtccccgcggccacttcgacggcgagagccaggtcaaggacttcatccaaactctactacattacggcgggtacaacgaaatggcggacattctcgtcaacctcacctctctcgccaccgaaatgggccgattagtctctgaaggctatgttttgacagtcttggcacccaacgacgaggccatggcgaagctcaccacagaccaactgagcgagccgggagcgccggagcagattatgtactatcatctggtgccggagtaccagacggaagagagtatgtacaatgccgtgagacgcttcgggaaagtccgatacgatacgctgcgtttaccgcacaaagttgtggctcaggaggccgatggatcggtcaaattcggagaaggcgacggctcagcatatctttttgaccccgacatttacaccgacggccggatttcagttcagggtatagacggcgtgttattcccggcggaggagaaggagaccaaactcgaagccaaaacgagtcgggtcaccaagcttgttgccaagcccaggagagggaaattgatggaagttgcatgtaggatgctaggggcgtttggtcaagattctcgtttcactacctgtcaataataa

SEQ ID NO: 388 - DNA, 494 bp, Vitis vinifera
ggatcctctggatggcaaatctgtacgtgaaagcggagccgccggcggatctgaaccggaacacggagtggttcacgtacccgggtgtgtggaccacctacatcctcattctcttcttcgcatggctccttgttctctccatcttcggctgctctcctggcatggcgtggacagtcgtcaatctcttccactttttggtcacatatcacttcttccattggaagaaaggaactccttttgctgaagaccagggaatctacaataggttgacgtggtgggagcagatagacaatggaaagcagctcacacgcaataggaaattcctaactgttgtaccagtggtgctgtacttgatagcatcgcacaccactgactaccagcaccccatgctcttcttcaacactcttgctgtgattgtgctagtgatcgctaagttccccaatatgcacaaggtccggatctttggaatcaacgctgatcattaataagaattc

SEQ ID NO: 389 - DNA, 971 bp, Vitis vinifera
ttcaaatggagttttggggtgttgaggtcaaagcaggagagcctcttgaggtggtacctggggatgacatgcttgttcacatttcacaggcttctcttggagaaatcaagaaggacaaaggaaatgagttggtttgtctatatgcaaatattggtgggcagaagcttgttcttggaacactttctgccgagaaattcccacagatctcgtttgacttggtgtttgaaaaaaaatttgagctatcccacaactggaaaaatgggagtgtgtacttttgtggatataaagctgctaattcagtggaatctgaatcatctgatagttcttctgattctgattctgaatttgaaattgatcttccacataataccactgtggataatgggaagcctcaacagcttaagcaagagaaacctgagtctgctgcagctaagcaggtgaagatcgtagaaccaaacaaagatgctaaatcacccaaggaaaatgatgatgatagcgacaaagatagtgatgaatcaatggatgatgaagatgaatcatctgaggatgaggatatggtcaatgatagaagtgcaagctcagaggatgaagatgatgatgagaatgaagacaatgaggatgacaaaaatgaaatctctaagaagaaagagacaccaaagaaggctggaccaagcaagaaaagacctacagagtctgtttcaaaaacacccgttcctgataagaaggcaaaatttgttactccccaaaagactgatggcaaaaaaagtgatgacaaaaagagtggtggtcatgtagcaacaccttacccttcaaagcaggctggaaaaactcctgcaaacacagaaaaacctaagcagcaggttcagaaatctggtggatcattctcttgcaagtcttgcaacaggtcattcaattctgagaatgctctacaaagtcataccaaggccaagcacactgctgctaagtaataa

SEQ ID NO: 390 - DNA, 1341 bp, Zea mays
ccttagcttccacaaggctcgactcggccggcggcgatggcgcggaagaagatccgggagtacgactccaagcgcctcctccgggagcacctcaagcgcctcgccggcatcgacctccagatcctctccgcgcaggtcacacagtcaacggatttcactgagcttgcaaaccaggagccgtggctctcatctatgaagttggttgtgaaacctgacatgctctttgggaaacgtgggaagagtgggcttgtggccctcaacctagatcttgcccaagttcgccaatttgtcaaggagcggttgggagttgaggtcgagatgggtggctgcaaagctccaattacaaccttcatagttgaaccatttgtgccacatgaccaagagtactacctttcgattgtatctgaaaggcttggcaacaccattagtttctcagaatgtggaggtattgagatcgaggagaactgggacaaggttaagactatctttcttcccacagagaagcaaatgacacctgacgcatgtgctccattgattgccaccctgccattggaggtccgcacaaagataggtggtttcattagagctgtattttctgttttccaagacttggatttctcatttcttgagatgaacccattcaccttggtaaatggtgaaccgtatcctctggatatgagaggagaactagatgacacagctgctttcaaaaacttcaataagtggggcaatattgtgtttcccctaccatttggaagagttctcagtccctccgaaagttttatccatgaactggatgagaagacaagtgcttctctgaaattcacggtactgaacccaaaaggacgcatctggacaatggttgcaggtggtggtgctagtgtcatatacgcagacactgttggtgatttgggatatgcttcggagctaggaaattatgcagagtacagtggagctcccaaggaggaggaggttctgcagtatgctagagtgcttttggattgcgctacctctgatcctgatggccgtaagagagcccttctaatcggaggaggaatcgctaacttcacagatgttgcttctacatttagtggcatcattcgggctttaagagagaaggagtccaaattaaaggctgcaaggatgaacatttatgtccggagaggtggtccgaactaccaaactggactcgccaaaatgcgcaccctaggcgccgaacttggcgttccaattgaggtctatggaccagaggcgaccatgactgggatctgcaaagaagccattgattgcatcatggccgcgtaaatcacaaatgtggttgttccatttgaagtcacatag

SEQ ID NO: 391 - DNA, 505 bp, Zea mays
gattcgaaagcacccgtcctgtcccctcgcaaaaccctagctccagccaccatgaagggcaaggctgacacctccaagaaggacgagggcaggctccgggcgggcggcgccgccggaaagcgcaagaaggccgccgcgagcggcaagcccaagcgcccgccctccgccttcttcgtcttcatgtctgaattcaggcaggagtatcaggcgctgcaccctggcaacaagagcgttgcgaccgtgagcaaggcagcaggggaaaagtggcgtgctatgtcagatcaagagaagcaaccatatgtggaccaagctgggcagaagaagcaggactatgagaagactaaggcaaactttgataagaaggagagcacaagctcaaagaaggctaagactgaggatgaggatggctcgaagtcagaggttgatgacgaggatggcagcagtgacgaggaaaacgatgacgatgagtaaacagtctccaaggtcacgaggtagcaaatcgagt

SEQ ID NO: 392 - DNA, 1138 bp, Zea mays
ggagattggagagtacaagcaggggaagatgtcagacgcgctgatcaacggcctcgccggcgccggcggcgggatcatcgcccagctccttacctacccgctccagaccgtgaacgcgcggcaacagacggagcgcgacccctccaagccggcgttcaaggacggcgccgctcgccagttgtatctggttgtgaagaacgaggggtgggagcgcctgtatggcgggcttatgccctctctcgtcggcaccgctgcctcccagggtgtctactactacttctaccaaatattccggaacagggccgaggcaagggcccttgagcgatccaggagagggcttggcgatgggtctgtcgggatgctccagtctctcactgtcgctgccctgtctggctgtgtcaatgtactgctcacaaacccgatttgggttgttgttacacggatgcaaactcacagaaaggcaaacaaacagcaaagacctcagggtttgaattgtgctcttgataagccccttgaagctgctacagctgaaaacgctccatacaaaacaattgatgtttttcaggaactctacaaagaatctggagttcttggcttctggaaaggggtaattccggctcttatcatggttagcaatcccgcaattcagttcatgctatatgagactcttctgaagaaattgaagaagagacgagcctctaattttaagggagctgatggattgactgctcttgaaatttttcttcttggtgctgttgcgaaacttggtgcaaccgtcgttacgtatccccttctagttgttaaggcaagacttcaggcaaagcacatgattaacgatgacaagaggcatcgctacaaaggtacacttgatgcgttcacaaagatggtacgatatgagggtctgtcagggatgtacaaaggaatgggcacaaaaattgtgcaaagtgtttttgcttctgctttgctttttatgattaaggaggagctggtgaagggtgctcgactattggtaactggtaacactagtctggttaagaaactaccatcaaagtcatcaagatgaactacgggcatcgcaagcgttagtatatcatcctaaaaagccatttattatccgcataaaccgtaaacaaggtcg

SEQ ID NO: 393 - DNA, 1291 bp, Zea mays
tttccactgctctgcgtctgcgtctgcgtctgcactgcttcgcgtctccctccccccgcctccgcccccgccccggcaaaaagcaaaacacggccatggaaggctacgaccgcgagttctaccagttcagcgaccagctgcgcctgcagacggccgccttctcgggcctctccctcggcgactccatctggtcccccgccggccggcgcaacaacagcaacgacgtcctcttcgccgcctccgcgtcgcccgccgacgccgccgccaagagcaacgccgtcgtcgggctcaagctcaacgacggagggcccggcctcatcggctccgggaagctggccttcggcggcggcgccggaggcggcggcaccaacaaggccgaccgctacaacaacaacaacctccccaacaccgacaacaagaccgtgtacaacaccagcagcagcagcttcatgggcaacggcagcagctacgccaagaacaacaacaacaacgccgacatgctggcgttcgacaagatggggagctacggctacaacggcggcggtaataccaacaacaacagcaacggcgtggaggtgaagagctacttcaacaagtccgccgggagggcggcgagcaacaacaacaacaacaacaacagccacgccggcggcggcaacaagaagggcggcgccggggagtacggcaggaagaagcacgccaagagcgagggcgcggcggcggccacggacaagcagcggttcaagacgctgccggcgtcggaggcgctgccgcggggccaggccatcggcgggtacatcttcgtctgcaacaacgacactatggacgagaacctcaggagggagctgttcgggctgccgtccaggtacagggactctgtgcgtgctatccgcccgggactgcccctcttcctctacaactactccacgcaccagctccacggcatcttcgaggccgcgagcttcggcgggaccaacatcgacccgacggcgtgggaggacaagaagtgccccggcgagtcgcgctttcctgcgcaggtgcgggtggcaacgcggaagatctacgacccgctggaggaggacgccttccgccccatcctgcaccactacgacgggcccaagttccggctcgagctctccgtcaccgaggccctcgccctcctcgacatcttcgccgacaaggacgacgcctgatccccatcggatctgtcgtcgggccactcgaagctcggatgcacgaatgaatgaacaaacaataataacgaatggatgtgcatgtatatcgtcatgcg

SEQ ID NO: 394 - DNA, 1350 bp, Zea mays
aattcaatagcacagcgagagccaaggaagaagaagaagcaagcggagcgccatggcggcgtccaacggcgagggccacggccggttcgacgtgatcgtggtgggcgcgggcatcatgggcagctgcgccgcctacgcggcgtcctctcgtggcgcgcgcgtgctgctcctggagcggttcgacctgctccaccaccggggctcctcgcacggcgagtcgcgcaccatccgcgccacctacccgcaggcgcactacccgcccatggtgcgcctgtcccggcgcctctgggacgaggcccaggccgacgccgggtacaccgtgctcacgcccaccccgcacctcgacctgggcccgcgggacgactcggcgctcgtcgcctccatgaggaacggcggtgccaccgaagtcgtcgccggggatgagtcgtcgtcctggccgtgggcaggcgtgttcagggtccccgacgggtggacggcggcgcggagcgagctgggcggggtcatgaaggccaccaaggccgtggccatgttccaggcgctcgccgtcaagagaggcgccgtcctcaaggacaggactgaggtggtggacatcacctcctccaagcgaggtgaaggagaggggtcaatcatctcggtgaggacgtccagcggcgaggagttccacggcacgaaatgcatagtgacagtgggcgcatggacgagcaagctgatcaagtcggtgaccggcctggagctgccggtgcagccggtgcacacgctcatctgctactggaaggtgaggcccgggcgcgagcaggagctcaccccggaggccgggttcccgacgttcgccagctacggcgacccctacatctacagcacgccgtcgatggagttcccggggctgatcaagatcgccatgcacggcggcccgccgtgcgacccggacggcagggactggtccacgggcgcgggcgacctggtggagccggtggcccggtggatcgacgccgtcatgccgggccacgtcgacaccgccggcgggcccgtcgtccgccagtgctgcatgtactccgtgacccccgacgacgactacgtcgtcgacttcctcggcggggagttcgggaaggacgtcgtcatcggcgcggggttctctggccacggcttcaagatgggcccggccgtcgggaggatcctggccgagatggccttggacggggaggcgagcacggcggccgaggccggagtagacctccgccccctaacgatcggccggttcgcgggaaatcccaaaggaaacctgtctgccagccaaggctgatcggcgacggggctctgtttcatggtttgatgtcaaagtgtgtgctctgc

SEQ ID NO: 395 - DNA, 885 bp, Zea mays
atctgggaaggtctcgtcttgctcgcctccgtccgtcgccgcaccctgcgtcgtcgccatggccaccgacgaagccaccaagccgtccccgatcccaccctatcccgagatgatcctggcggcgatcgagggtctagacgacaagagcgggtcgaacaagtccgccatctccaagtacatcgagggcaagtacggctcgctgccccccgcgcacgcgtcgctgctgaccgcgcacctggcgcgcatgaaggagtccggagagctcgtcttcctcaagaacaactacttccgcgcgggcgcccccgacgcgccgccgaagcgcgggcgcgggcgccctcccaaggcgcgggacccgaacgcgccggcgccggcgcccaagtcgccgtcgtccacggggcgcggccgcgggcgcccgcccaaggccaagagcccgctggaagccgccgtgaagcaggccaccgcggggatgcccaagccccgcggccgcccgcccaagaaggccaagaccgacggcgccgcgtccccgtccccgtcccctgcccctgcccctgctggcgacgggtccacccccggcaagcgcggccgcggcaggccccccaaggtacgccccgccgtgcccagcgagacggccgcggcttgaccccgcttcttggggataatagttcgtcccgccgcgagatgggatggttagggcgtagcaattcgtcccgctgcagctgcggctgcagctgccgtgttaatgttggtaggcttggtctccatgcttcatctaattgttgtcgtcgtcggcgtcgtcgttgctcaattaattaatggagtaattaggaggattcgatgtgctgtcttctgtgctgtgttgtgttcagttcagtttcaccgtgtgtc

SEQ ID NO: 396 - DNA, 993 bp, Zea mays
cagctgcctctcctctctttggcccccggagccggagcaagagcgccaccaacagcccgctaccggcgccgtgtcatggcgggggcaggagacaaggtggactacgtcttcaaggtggtgctgatcggcgactcggcggtgggcaagtcgcagatcctcgcgcgcttcgcccgcaacgagttcagcctcgactccaaggccaccatcggcgtcgagttccagacccgcaccctcgtcatcgaccacaggagcgtcaaggcccagatctgggacaccgccggccaggagaggtacagagctgtgacaagtgcttattacagaggtgcacttggagctttgctggtctatgacattaccagacgccagagcttcgatcatataccccgctggctagatgaactacgagcccatgccgacaagaacattgtgataatgctggttggcaacaagagtgatctcgaggagcagcgagcggtgagcactgaagatgccaaggagtttgccgagaaggagaacctcttcttcctggagacctctgcgctccaggcaacaaacgtagagagtgcttttcaaactgtcttgacagagatattcaagatccacagcaagaagaacatggtgtcggagccgaagagcaatggagctgccccagcgatgccggggacaaaggtccttgtcccaggtccggcgcaggaaatcccaaagagcaagtgctgcagttccatgtgatgcttctacgtttggtgctgggtgggttgaaaatatattcacgcaacattgttttggttttaaatccctgctgaaatacttgggttttggtgggattgtgttggaacaccggtgtattttagatatctgtcacaattgtgacatgagagaaggatgtgctgatgtattagttctcttgttctctaattgatacgttttatccctgctgcaaatatctgtagcaccgattgtttttgagatgcgaggtgtgaatttgccgtgtac

SEQ ID NO: 397 - DNA, 1595 bp, Zea mays
agccaatggcgactctacctctgctcctgcacctgctatgggaggcctctccgtgggcccgtgcaggcgcggcgacggccgccgtggtgctggtgtggctagcggcctggacgcttgagtgggcgtggtggacgccacggcggctagacagagccctacgggcccagggcctcaagggcaccaggtaccgcctcctcaccggcgacgtgagggagaacgctcggctcaaccgagaagcccgcacgaagccactgccgcttgggagtcacgacatcatcccacgcgtgctacccatgttccacaacgcggtgaaggagaatgggacaaattcattcacttggtttggcccgattccgagggtgataattccagacccggaattaatgagagaggttttgtctaacaagtttggccactttggcaaaccactgtttagccgtgttggcaagttactagccaatgggctcgctaatcatgaaggcgagaaatgggcaaaacacaggagaattctcaaccctgcattccaccatgagaaaataaagcggatgctgcctgtatttgctacctgttgtgccgatatgattaacagatgggaaaattcaatgtcttccaaggaaccttctgagatggacgtctggcctgagttccaaaatcttactggagatgttatctcaagaaccgcatttggtagcaactatcaggagggcaggaacatcttccagctacaaggagagcaggctgaacgccttatacaatcttttcaaacaatatttatcccaggctactggctcttgcccaccaaaaataacagaaggatgaaagaaattgatcgggagatccgtaaaattctgcatggaataatcaggaaaagagagagggcttttatagatagtgaaggaactaatgatgacttgctaggcttattggttgagtcaaacatgagggaatcaaatgggaatgcaaaactcggaatgactaccgaagatataatcgaggaatgcaagttattttactttgcaggtatggagacaacatcagtcctgcttacatggacgttaattctgctaagcatgcaccctgaatggcaagagcaggcaagagaagaagttttaaaccactttggaatgggtacaccagactttgataacttgaaccgcctgaagattgtaaccatgattttatatgaggtccttaggttgtacccaccagtagttttcctatccagaagaacctacaaggaaatggagctcggtggcatcaaatatccttcaggcgtgagccttctactgcccatcatcttcattcaccatgatcccaacatctggggaaaagacgcaagcgagttcaatccacagaggttcgaggatggcatttccaatgcgaccaagcatcaggccgccttctttccatttggatggggtcccaggatctgcataggccagaacttcgcgttgcttgaagcaaagatggcactgagcaccatcctccaacgcttctcctttgagctctcatcatcctacactcatgcgccatacaccgtgataactttgcatcctcagcatggtgctcaaatcaggttgaagaagctttgatga

SEQ ID NO: 398 - DNA, 2664 bp, Zea mays
atgacacagagaaacggacatcccctctactagttttctctctctgccgccgtccgccggcctcgcgcaccccgtccccgccggcaatcgatcccacttgtcccaggacgcctccgccggccgtcaatcgtgcccctccccagaactcgcactgctctccgtcagttcagttaaaacatgactgctcagacaaagaagagaggcgctacagaaaatggggatggtgttggtttgggtcttgctgccttcattgcaaacaatgaggatgtgggtcccgtagtccggcacgctttcgagtctgggaagcctgaagccctcttgcacagcctccagaacatcgtgaagaataaagaggttgagatcgaagagatttgtagactccactatgaggaattcatccttgctgttgatgagcttcgtggtgtcctggttgatgctgatgagcttaagggcacattatctgatgagaacctgcggttgcaagaggttgctagcgctttgctactgaagcttgatgagctttttgagatttattctgtaaacagtaacgttggggaagccctagctacgttgaagatttgtctgcaagtaaccaacctctgcaaggtatgcaacagggacattaccgaagcaaaattactttctgcattgaaaacattggagttgattgagaaggactacctgcaaaatattccactgaagcttctgaaaaaggtcattcataaacaagttcctatggtaaagctgtacattgagaagaaagtttgtagtgagtttaatgagtggcttgtgtatatcagaaggactgctaaggatattgggcaggtcgcaataaaccagacatctctgactcataagaaagatcagggaatttgtgcccgacaaagggaagcagaagaatctagcctcgttgggttcgacgtgaatgcttacaccttggatgtggagcacatggctgaggaagcaatgctggaatttgatcttgtgccagtgtacagggcacaccatattcacataggccttggtcttggggagaagtttcgagaatattactacaataacaggctcatgcaactcaatttggacttgcaaatttctacatcacaacccttcgttgagtcctatcaacctttcattgctcaggtagctggcttttttattgttgaggaccgtgtctttcgaactgcagatggacttctatctgagagccaggttgatactatgcttgaaacagccatttctaaacttactctgatcttagaggaacagttctctcgcattcatgctgccaaccacctcctcctcataaaaggttatgtcagcctttttggtgcaaccctgaagaagtatgggtaccgatccatgtcgctggctgaaatccttgataaaactagggacaagtatcttgaacttcttctttctgactgccggaagcagctcaacgaggccttctctagggactcatatgagaggatggttataaagaaacaaaatgaatacgacgcaaacatagcggcattccaacttgaccccattgatggagtatcaaatttgccatacgtcgctccattttcctcctctgttcccaatgcttgtcgtattgtgcgttctttcatcgaggagttggtcagctacttgtcactcagtggtggcgtaaacgtctatgatgtggtgaaaagctacttggacaagttcttgattgagacgttgaatgatggttttctgaagctgatacatggtggatccctggaatttccacaggtggtgcagatcgcaggaaatatcgccgttctcgagcagtcctgtgacatgttcctttggcacgccgctcgactttgtggtgtccctaggtgcctcctcgagaagccccattctggattgagtgccagagctgtgctcaaagcctcccagaatgcggcatacaacggatcggttactttggtgaattccaagatcgacgagttcatgctgcagctgactagcatcaactggaccccggacgaagctccagagcacgccaacgactacatgaacgaggtcatcatctaccttcacgaggtggtgtcttccgggcagcaggccgtgccaagggacgcgctgttcaaggttgtatctggcgcgctgagccacatctcggactctatgacgacggtccttctcagtgaccgggtgaaaaggttcaacgcgaacgccgttgctagcatcgacgtcgatctgagggcgctggaggggttcgctgacgacacgtaccgcacggccgggtttctggacctgagaaagggaaccagtttcagagagtgtctagccgaagtaaggcagctcacaaaccttctgctgagcagccagcctgagagcttcgcgaaccctgcaaccagggagcagagctacggagccttagaccacaagaaggtggcgataatttgtgacaagttcaaggatgcccccgacagcctgttcgggagcctctcaggccggggcacggtgcagagcgcccggaagaagtccctggatgtgctgaagagaaggctaaaggattttagctagctggtgagctagatcatttagacaagctagtagcatagtacccctgttttagtgccagtcgtatccatttaaaatttcttttccgtctttctttattccctctttaatcgacttcccgtt

SEQ ID NO: 399 - DNA, 2490 bp, Zea mays
gttcctgatcgcaccatctccctccggcgacagtccgccgccccgccccgcgcgctcgacgaggccgctccgggtggtgaagagggtgctgctgcagtgtctcccctctcgctatgagtagtgctgtgaaggaccagctacagcagatgtcgacgacgtgcgattctctcctgttggagctcaacgtgatttgggatgaggtcggtgagcccgacatggcgagggaccggatgctgctggagctcgagcaggagtgcctcgacgtctacaagagaaaggtcgaccaggccaatcgatgcagggcccagttgcggcaggccattgcggaggcagaggccgagctcgctggcatatgctcggccatgggcgagccaccgatacatgttagacagtcaaatcagaagttacaaggtttaagggaagtattgaatgcgattgtcccatacttggaggagatgagaaagaagaaagttgaaagatgggaccaatttgttgatgtgatcgagcaaattaagaaggttgcatctgaaatcaggcctgcagattttgtaccctttagaattcctgtggatcagtctgatctgtcattaagaaagctggaggagctaacgaaagagctgcaatcccttcagaaggagaagagtgatcggctgaagcaagtcatggaacatcttaacactttgcattcgttatgcgaggtgcttggtgtagacttcaaacaaacagtaaatgaggtgcaccctagcctgggtgaggctgatggatcaaagaacctaagcaactgtacaattgaaagccttgcatcagctgcaagcagactgcgtgaattgaaagtccagaggatgcaaaagcttcaagatttggcctctagcatgcttgaactttggaatctcatggatacaccacttgaagaacagcagatgttccagaatgtaacgtgcaatattgctgcttctgaacatgaaataactgagcctaacacgctctctattgacttcctcagctacgtggaatctgaagttttaagactcgagcaacttaaagcgagcaagatgaaagaccttgttctaaaaaagaagacagaactggaagagcataggagacgtgctcatttgattggcgaggaaggctatgcagctgaatttagcgatgaggctattgaggcaggagctgttgatccttcgctggtgctggaacaaattgaggctcacattgccacagtgaaagaggaagcctttagcaggaaggatattctcgagaaggttgaaagatggttgaatgcatgtgaggaggaagcttggctggaagattacaacaaagatgacaatcgttataatgccgggaggggggcccacttgacactcaaaagggctgagaaagctcgtattttggttaacaagatcccaggactggtagatgttttaaccacaaaaattgtagcctgggaggcagaaagaggaaaggaattcacatacgacggtgtccgccttatgtcaatgcttgaagagtacatgatcgttcgccaggagaaagagctacagaagaagaggcaaagggatcagaagaaaatccaggatcaactcaaagctgagcaggaagcgctctatggatcaaaaccaagtccttctaagcctcaaagcacgaagaaggcgcctaggcactccatgggtggtgcgaaccgaagactgtctcttggtggagccactatgcaagcccccaaaacagatatactgcactccaagacagctcgtgccgccaagaaggctgaagatttgggcgctttatctcctagtagtagaggcttggacattgccggtcttcccatcaagaagttatctttcaacgcaagcactttgcgagaggcagaaacaccgcgcaagccttttgcccagatcatgccaggaaacaacgtctcaccgatgcctacgcggcccatctccagcgccacagaggaagagaacaaaacccccaggacatttgtaggagggctcaatgcgaaaacgccggcgacagtgacggctcctatgcagatggcgatgacaccagccgtggctaacaaggtcatagccactcctgcaacccttttccaggagaaggcagattcgccagcactgccagcggacatcgagtactcgttcgaagagaggcggctcgctgtttacctggccaggcaagtggcttaaactcggtcattcacgtagttgaaagctgaactgactgcgatttctcgtcagaggccaatgttacctgttggtcgatactcgatagtagtcggcctcgttcgtaccttgcagtactattctgattcatagccatatttgctacagctagtaaggatttatttgggtactctaatattgatctcaatccacatgtgttgaaatgaattggagtgtaaattaatttaagttacacttcaatctatctcaatacatgtggatttgggagttttagacccgtatcgtaagttgtatagcttcacctggttgc

SEQ ID NO: 400 - DNA, 1129 bp, Zea mays
gtcgtttcgctctcagttggcggttagctagcttgcatactagcatcaggtgccccttgccgagccgtacgtgtcgtcgtcgacgacgatggtggcggcgcccagcaagtgccggccgtcggcggcagcgctggtggtggcaccgccgggggcccctcggcgccagctgcggtgccggtgctgcgaggacacgctgggcgtcccgcgccgccggctgcagccgcagctgcacctgaagcagcaggcacctgcggcgacgaccgcccccgccgcggcgccgccgccgaggccccggcggatcgtgctggtgcggcacggcgagagcgagggcaacgtggacgaggctgcatacacgcgcgtcccggaccccaggatcgggctcaccgccaagggctggcgcgaggccgacgactgcggccgccgcctgcgcgacctcttctcctctggatcccgcgaccaggacgactggaaggtctacttctacgcgtcgccgtaccgccgcagcctggagaccctgcgcggcatcggccacgccttcgagccccaccgcatcgccggcgtccgcgaggagccccgcctccgcgagcaggacttcggcaacttccaggaccgggagcagatgcgggtggagaaggagatccggcaacgctacggccgcttcttctaccgcttccccaacggcgagtcggcggcggacgtgtacgaccgcatcaccggcttccgggagaccctgctctccgacatcgtcctcggccgcttccagcccccgggccaccgcagcaccagcggagacatgaacatcgtgctcgtctcccacggcctcaccctccgcgtcttcctcatgcgctggtacaagtggaccgtccgccagttcgagggcctcgagaacctcgccaacggcggcgagctcgtcatgcagactggagaaggcggcaggtacagcctcctagtgcaccacacgcccgacgagctcagggcgttcggcctcaccgacgagatgctgcaggaccagatgtggcagaagacggccaggcccggcgagctcaaccaccgcttcatgacaaacggacagtccttctttgatccatttactgtaatctactagttcttgacgaccgaccacatgtag

SEQ ID NO: 401 - DNA, 433 bp, Zea mays
tgttcttagtcatcgcacaagactcttgtcaacaagaccaacaacaggatgaggactgccgtgcatgctgcgctttgcattgtgcttgtgataatgtcttcaacactgtcatcttgcgaggacgatgagaaggtatctatcgcatgtgacacaggatgcaatgccgcgatctcccgtctcaaatgcttcctgatggcctattctgaagggaaagtgttggtcagcagcaactgcgaaacgccgaccaggtgcggctgcgtgtttcgtcacaaacaagatgcaacccttatcgccggcgacgttggcaacaaaaagggatattgatggcagacgtgtatttcttggttgaataatatatactgctagaattaatatgggcaccaacaacgaaatatctataatgttattcttcagtgtaatgcttccagcatgt

SEQ ID NO: 402 - DNA, 1414 bp, Zea mays
agttcccactccactcatcctcacgcgccgccgccaaccggcgagcaaaccgaacgaaccagcaatgccggcggccgatccccccgtcactgacgcggtccccgatgaagatgcggctccccgaccatctccacctccgccgccgccgcggccccggcccctctccctcgcctccgcgctcccattctggttctacttcgccgccgccgtctccctcctcgcgctcctcctcccccacctcctgcctccctcctctcccgcgcctctcccgcctctcctccgtggacacctcgccgcaggccgcttcctcaagctcgatccagcccccggcctgttcgccgtgacctcccgccccacggccgccgccggcgactcccccgcgcaccgcgtcctcgtcctccctggcctcgccgcgggctccttgtccttccgccgcgtcctctcgtcgctctcctcccgcggcgtccacgccgcggcgctcgacctcccaggccagggcctctccccggcgtcgcccgccgcgaccgcgcccgcccggaccagcgcgctgcgggagatcatgaaccgaggcgtgttccacgccttcgagcatctcgtgcagaccggcgaggtcccgtaccaggaggaggaaccagccgcctcggcggcgcggtctccgcacgcgcccgacgaggcggccgcggccgtcgcgcgcgccgcggaggcgctcggcgtgggccccgtccacctcgtcctccacgactccgcgctcgcggccggggccgcgttcgcgtctgccaacccgggggccgtgcggagcgtgacgctggtcgacgccaccgcgtccctgccggcgttcccggccgcggtcttcgacgtgcccgtgctggggaggctggtgctccgggtgccggcgctgttccgcggcctggtgcggctgtgctgcgtccggggggtcggcgccgaggaggcagaggcgtaccgagcagcgatgcgtggggaggggaaggcagaggcggtggtcgaggcatggaagtcgatgaaccacagcttccagcttggggagtggagggtctcttcggaggaggtgaggaggctgccgatgctggtgctgtggtcgggttcttggtcagatatgtggatcgacgaggggaagaaagtggcggctgcattgcctgacgccaaattcatctaccactccggcggccgatggcctcaggtcgatgcctttgaggaaatttcaggggtgatcaccgagtttgtaacctcagctgaggaagctggaagcagcaggtggtgacgttgagtaggatatatacactccttcgaggatcgttgagcaaatgtaacctggagcagttttcagaccttttagttggtgggtgcagtgacaagtgcaacttgagattttttgttcctggagagtttctgcttg

SEQ ID NO: 403 - DNA, 1711 bp, Zea mays
agatccgctgaggtggaacgcccgatcggcggagccccatccaccaccactccacaagatgcggggcgggacgctgcagatcaactggcacgaccagcagccggtgctcagcctcgacttccaccccgtctcccgccgcctcgccacagccggagcggaccacgacgtcaagatctgggaggtagcgtcggacggcaagctccccaccgccaccttcaagaccggcctggtccccaacaccaccgcccacagctccgcggtcaacgtcctccggttctccccttcaggggagtatctcgcctccggtgctgatggtggcggcatcaccctctggaaactgcatcccgctgacgacggcgaggcatggaaaattcacaagacgttactattccatcacaaggatgttcttgaccttcagtggtcgcatgacagcacatttcttgtttctgcatcagtcgacaacacttgcataatttgggaagctagtaaaggcacagtgcaacaaaagctagagggacatctgcattatgttcagggtgtggcatgggatcctttgggccagtatattgcttcactgagttctgacagaacctgtaaaatatatgcaaaaaagcctcagggcaaatccaagaacgcggagaggttgaactttgtttgccagcatacactagtgaaggtagaataccagaatcatgatgaatctaagccaccaaccaaatctcatttgtttcatgatgagacactaccatctttcttccgaaggttggcatggtcacctgatggatcttttctagtattgccagcaggcctttctaaacactcctccgaggtgattaatacagcttatgtaatgtccaggcgtgacctctcaaggccttcgatacaactccctggggcaagtaaagctatagtggcagtacgcttctgccctgtactattcaaaccacgtggttctaactcagatggtttcttcaagcttccttatagagttgtctttgctgtggctactttgaactctctgtatgtctatgatacagaaagtgttcctccaattctagtccatgctggtctacactatgctgccattaccgatattgcatggtcttctgatgctaagtacctggcagtgtcatcacgagatggctactgtactataatagagtttgagaatgaggaactgggacagcctcacatactccccggatcaaaggaagttgctaatgggaatctgacacctgagaccaagaagcctgtatgtgctgatagcatgaaggttgataatagtgccaacaagcttaagatggaagccagtcctgttgctgtaggagttagagcaccactgctgccaactgagaacatcaagagaacaggagagcttgccgaaggaaatgtaacctgtgaaaacaaggagccggtaacaatagacagtatggaagtagatgccgatgataccaaaggcaaggaggcaaccatacccgtggcagctgaagtgacaccgccaccagcggtaccggcagcgaagaacagcgcatctagtaagcctgctaagaggcgaattactcctatcgcaatcgactaggtagtagacgcagcagttagggttttgatgtgttatgtagtgatggcaagtactggatactatgtttaggctaccctgtaaagtcgtttgtgctgcggtgctcatcttctgctctagtcctcctgctcttga

SEQ ID NO: 404 - DNA, 1087 bp, Zea mays
atcggccgtagtatcttgctcctcgccctccatccgaacaacagcaggagcccgagcccgaacccgatattccgcattcctacccagcaatggtggcccttgtctaggtggacgcggtgcaagaggcgaagcgggggccgatggatgaggaggggcagcgaacgccgcagccgatggtggtcgcgcggaagcgccgccaagccacgccggatcacccaccctactgctggatgatcggcgaggcaaccgacgcgctggccgaggacggcggctcggaggaggactccatctctgcctttatccgcgccaggcaccccggcgtgccccccgcgcacgacaggctcctccggcactacctcggcaagcacgtcgccgagggcttcttcgtgcgaactgccacggggcggttcgagcgcagcccccaggagaacgctgatgaggaggagctcccggtggagcaggctgatcaggccggctcgtgcaagccggcgtccgttgggtcttcggtggtactggtagaggccaagcccaagcgtggccgaggcaggccgcggaaggatggctctccttcgacactggccgttgctgcaatgtcatcggttgctgttgccggcaaggacgaaatccatgcaccgtccttgaagcccaagcgccgtggccggcctcgcaggcaggcaggggcggaccacagggacaaggagcatgagcctccgcgtgagctggcactggtgatcctcggtgatagctctgccgcaccgatcatggacaagccatgcacaaccttggtccctccaaccacgccgcctgtggacggtggccagcctatcgacctggctctggcgaccactacagaggtgcctgtgcctgaacctgcggcaacgcccgccatggacaaggacggtgccgatgccgatgcttcttcaatcgaatgacagcatttgcacagcgcccacttcgccagagcctggcagctgggcttgcaagctggcactcgtgcctgctgctaatggtttttgattgctgacaagaaggatggccttacggaggctccatctctgcaacctacaaggatgttcatcagcatcac

SEQ ID NO: 405 - DNA, 690 bp, Zea mays
aactcctacctacgcagcagaggccagccacctccccgtcgctctcacgctcttcgtgcccgtcgcctcccctccgtctctccctctcccctcccgtctgacgcacatggcctccatcgccggatcttccgccctctccttcgccaggcccgtcaaggcaatcaacacaaattctctagctttctcaccgttgaggaagggcaacacattcctccgcctgcaaccaatgcctatgagatctgtttcctgcgctgccaagaaggatacaacagacaaggtttgtgagattgtgaagaagcagcttgctcttcctgaccatactgaagtttgcggtgaatcgaaattctctgaactcggtgcagattcactggacacggttgagattgtgatgagtctcgaggagcacttcgatattagcgttgaggagtccagcgcacaaacaatcgccacagttgaagacgccgcggacctcatcgacaagcttgttgctggcaaagcgtagttctgtacctcctctatcgttgtcctaccactctaggtctatcccttgatctaggtttctatggtctgaagatttgtgattttctccgcactgttgttgctatccccgtgtcgtaataatacgagatgttttaagcggttgaacattacggtggtgtaatcagagtaatctgttgctgttaaggtgca

SEQ ID NO: 406 - DNA, 2886 bp, Zea mays
gccggagctcggtaatggcggggttctagcgcggcggacttaaagatctagcctcctcttttcctttccattttctctctttcgctgctaccccctcacacccccacggcgatggtcacggagatggcggcgcgcggcggcgaggcggcggcgtttggcgcggagaccgaccgcggcgacttcgaggtgtttcgcagtggctccgcgccgcccactgtcgagggagccctgggcgccgccggggccgacggcggccttctcgtggacgacgacctccgcgccgacccggcgtaccagagctactactactccagtgcgcacctcaacccgcgcctcccaccgccgctcctgtccaaggaggactggcggtcctcgcaccaccgcctccgctccgcgggcttcggcgggatcggggacggcaggaggcagcagcagcaggcgtcggctgccgaggggactgtcggcctgcccgggatcgatcttggtcgccagaggagcttctccaccatctttcaggaagactcgtaccagcgtgatatggataggcatactgccagccacaatagtaatgacttactaggttcttctggaatacagtatggtctaaatcgtggatctggaactattggaggcctgcactctagcaatagtctacggagcttggatgaaattcagaacaatgatctgccatcaaacacatttgcttctattttagggtcatctctttctaggagtgcatctccagaccctgaacttgtgaggagggcccctagtccatccctgcctccaattggtgtgaaagttggtaacactgataagaagatcaatggtggttccacttctttccgtcgtagctcatccgcaatcggagaatctgatgatttggtggctgctttatctgggatgaacttatcatctagggcaatgagtgggcaaactatggaccagtctcagctctatcaggatgtcgataatgtccagaagttcctttttgatcgacagggtgaccaaacaactggaaatcagcagcactatatgagacgtcctgaacaaggacaatctaagttacccgatggatattctgccaatttggccaattcatctacaatgagaaaccagattaatgctggcagtttcacatcttttgacagtttgtctcttggatctgggtttgcttcccctaggattggttctagatcccctggagggactgtatcttctcgacaaaatttagctggtatgtctaacatgctaaactataatggaattggaagtccaactgcctcaccttctcttcagacttctattgatccggcatatatccagtaccttgctcagcttgcagctacctgtgatgatcctctaatggacaggggccatctaggaaattcttacatggacttacttggtactcataaagctaacattggccctttactccagtctcaaaaacaatatggttactatggcaatcttggatttaaccttggttatcctggaagtccattggcgagtcctgttcttccctcttcacctattgcgccaggcagtccacttaggcatggtgagcgcaacatgcgctttccatcaggcatgagaaacttcggtaattcctttggttcatggaattcaggcatgggtggaaagatggatgccaatttgatgccctcacttctggaggaattcaagagcaacaaaagtaaatcatatgagctctccgaaatagctggccatgttgttgagtttagtgccgatcaatatgggagccggtttatacaacagaagctagaaacagccagtactgaagaaaaggacatggttttttcagaaatcatgcctcaagctctcacattgatgactgatgtatttggaaattatgttgtccaaaagttttttgagcatggaagcactgcccagataaaggaattggccggtcagcttattggacgtgtccttgctcttagtcttcagatgtatgggtgccgggttatacagaaggctatagaagttgttgatttggagctgcagactaaaatggttgcggagctggagggccatgtcatgcgctgtgtgcgtgatcaaaatgggaaccatgttatacagaaatgtatagagtgcattcctcagcatgctattgagtttattatctcgacattctatggccaagttgtaatgctatccactcatccatatggttgtcgagttattcagagggttctagagcattgtgatgatcctaaaacacagcaaataatgatggatgagattctccagtctgtttgcttgctggctcaggaccagtatggcaactatgttgttcagcatgttctggaacatggcaaaccccatgagagatcagctattattgagaagctaattggccaaattgtgcaaatgagccagcaaaaatttgcctcaaatgtcatcgagaagtgcttagtctttggaaatcctgtagaacgtcaggttctgattggtgagatgcttggatccactagcgaaagcgaacctcttgaggtaatgatgaaagaccagtttggaaactatgtggtgcagaaggtgttagaaacttgtgacgatcagcagagagagatgatcctaacaaggataaagacacacctgaacacactcaagaagtacacatatgggaagcacatagtagcacgcgtagagaagcttgttgctgctggagagaagcgccttgggcttcaaccagcatgcaccgccgcctgaagggcaaactctctagttgtacagctaacagttgctaggtttgcactcacatttttttctctctactaaaaaccctatatgaaggccccttttggcctcgccggaaaataaacactgtatgtttgcgcgaagagtgtacattaattctgtagc

SEQ ID NO: 407 - DNA, 1362 bp, Zea mays
gcacagagagctagcatacatcgctagctcactttagcatatatattacataaatattggcatatataactaaactgaattgaggacgatatggcccgcttggtctcttccggaatcattggtaaggggcacaacatctttgacgatggcggattcggtgaagtccatgctgacccaattaaagtcgagcgtccgcacaagcgtccgccgcagaagcagaatgcggagaatggaacgacgacgaaggttgatgagccaaaggaattgcctaagcacgtgtgcttcaagggagacaacgggctgtacctgagcgctcggatggtggaaggctacccctacctgcagtttgcgtcggacgacataggcgatccaagtgtgaggttcaccacgtacaactacatgatcgatggcaagcgggtgatccgcgtcaagtcggaccacttcggcaagttctggcggcgcagcccgaactggatctggtgcgacacggacgacaccagcaccgacaaccgtgacaccctgttcgaggtcgtcagggtcggcgacgacgccgacgccgtgtacgggctccggaacctcggcaacaaccacatctgccaccggctgacctacgagggcaaggagagctgcctgaacgccagcatacccagcgtcaggaaggaggcgcagctgaagatcgaggaggccgtcctgctgcggaagatctacggcgtggactaccacctcaaggacgccaagatcctgaacaacaaggtgaggaccctggtgactcgagaggcggtgaacgccggcagcatgcccagcaagaacacgctgaccctcaagtacgtggtcagcaacggcaagatctgggacgccagcaggtccttgaggctgggcatcaaaagcagcttccaagctggagtccccgaggtcgtgaccggatcgattacgctggagagcgagttcgacaccagctacatctggggcgagaacaccgtcaacacggaggagttctccaccgactacgaggtcatcgtgcctccgcacaccgtcatcacggtgcgcatcctggccacgcagggcacttgccaggtccccttctcctacacgcaggaggatattttgactaccggggagaagaaggtcaccaagtatgaagatggcatcttccgtggagtcaacagctttggtttcaagtccgaggtcaccgagaggaagatcaacggcgaatgagacgatgcaccactgtgccaaagtctgcttatctatctatatctgcatcaataattcagccacgtacgctaccatctgcatatatgtcagtataggtggcgcatgtattgcttttaataattggtgtcatctaagccatgcaagcat

SEQ ID NO: 408 - DNA, 1773 bp, Zea mays
cacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaccacgtcttctcctcccgcccgcgctccctggtgtccgacatcatcatgtacggcgccaccgactcgtgcttcgcgccctacggcgaccacttccgcaaggcgcggaagctggtcaccgtgcacctgctcaacgccagcaaggtgcggtcgcagcggcccgcgcgggaggaggaggtgcgcggcgcgctcgacagggtgcgccgcgccgccgccgcgcgggaggccctggacatgagcgagctcctgcactccttcgtcaacaacctcgtctgccgcgccgtctcgggcaagttctccatggaggaaggccgcaacaggctgttccgggagctcaccgacatcaacgcgggactcctcggagggttccacatccaggactacttccctagcctgggccggatcgagctcgtcaggaaggtggcgtgcgccaagaccaggcgcgtcaggaagcgctgggacgacctcctcgacaagctcatcgacgaccatgcggccaggatggcaacccatcaggacgaggacgacgataaggacttcatatacgtcttgctgtctcttcagaaggagtatggcctcaccagagaccatatcaaggctatcttgatagacatgttcgaggccggaaccgacacctcgtacatgacgttggagttcgccatgacggagctcatacggaagccacacctgatgaagaagctgcaggaagaagtgcggcggaacgtgccggcggggcaggagatggtcaccgaggacaacctccccggcatgacctacctcaaggccgtcatcaaggagacgctccgcctgcacccgccggtcccgctcctcctcccgcactactccctggacgcctgcgaggtcgccggctacaccatcccggccaacacccgcgtcgtcgtcaacgcctgggcgctcggccgccacagcggctactgggagcgcgagaacgagttcgtcccggagaggttcctcagcggggacgtggccggcggcgtcgacctcaagcccaacgagttccagttcctggcgttcgggtccggccggaggatgtgccccggggtccactcggcgtccgcgaccatcgaggcgatgctgtccaacctcatgtaccggttcgactggcagctgccggcggggatgaaggcggaggacgtggacatgaccgaggtgtttgggatcacggtctcgaggaaggagaagctgctcctagtcccacaggctgcgtgaggatgatgatgatactagtgcaatgcgatacagggttttaaattagtaacaccaaaggctgtgttactgg

SEQ ID NO: 409 - DNA, 743 bp, Medicago truncatula
aaaccatggctacttccgagaatgccgtcgaaagcaagagttctcttaccaaacttgctccaattgaagcagtgttgtttgatatagacggaactctttgtgattctgacccaatccactattatgcttttcgtgaaatgcttcaagagattggtttcaatggaggcaatcctataacagaagaattttttattgcgactgttgctggcaagcacaatgatgacattgctttggatctcttccccggtgatcgggagcgaggtttaaagtttgtagaagataaggaagccatgtttcggagattagcagctgagcaactgaagccgttgaatggtcttgataaagtgaggaaatggattgaagatcgtggattgaagcgagctgcagttaccaatgctccaagaccaaatgcagaactcattctctcaaagcttggtctctcagatttctttcatgctgttattattggtgatgaatgtgaacatgccaagcctcatccagaaccctacttgaaaggtcttgaagctctcaaagcatctaaggatcacacatttatatttgaggattctgtttcaggaatcaaagctggtgtggctgcagggatgcctgttataggtatatctactcgaaacccagaagacttgcttatgggagcaaaacctgcctttttgattaaggattatgatgatccaaaactgtgggcagcattggaagaacttgacaagtctggttctcattaataa

SEQ ID NO: 410 - DNA, 2246 bp, Medicago truncatula
atcaatgatttggcgttgaatgcatcattagagtgttaattaatcaaatgcaaatggaattagcaacaatgagaatgagaaaatctttgatctattggatttgttttttggttattgggtttgttcaaattagcaaaagcaatggtttttatcttcctggaagttacatgcatacgtatgcaaatggagatccaatatatgccaaagttaattcattgacttctattgaaactgaattaccctttggttactatagtcttccttattgtcagcctcttggcggcattaagaaaagtgcggagaatcttggtgagcttcttatgggtgatcagattgataactcgccgtatctatttaaaatgaatgttaatcagtcgagttatttatgtactacggccccgttgaatgagcatgaggttaagctgtttaaacagagaacccgcgatttgtatcaggtgaatatgattcttgataatttgccggttatgaggtttgcgaatcaaaatggggttaagattcagtggacggggtttcctattgggtatacgccaactgatgggagtgcggattatgttattaatcatcttaagtttacggttttggttcatgagtatgaaggaaatgatgttgagattattggtactggggaagagggtatgggtgttattgctgaaactgataagaagaaggaatctggatttgaaattgttgggtttcatgttgttccttgtagtgttaaacgtgatcccgaagttatgacgaagttacatatgtatgataatatttcttcgataaactgtcccaatgagttggataagtatcaaccaataagagagcaagagaggatatcatttacatatgaagttgaatttgtgaaaagtgatataagatggccgtctcgttgggatgcttatttgaagatggagggttcccgggtgcattggttctcgattctaaattcactgatggtgatcttttttctagctggtattgtttttgtcattttcttaagaacagtgagaagggacttggcaaggtatgaggaattggacaaagagacacaagctcagatgaatgaggagctttctggatggaagcttgttgtgggtgatgtatttagggaacctggttgctcaaaactcctttgtgtgatggttggagacggggttcagattcttggcatggctggtgttacaattgtgttcgcagccttgggtttcatgtcaccagcatcccgaggaatgctgttaacaggtatgataattttgtatcttttcctggggattgcttccggatatgtaagtgtacgtctctggaggacaattaagggaacttcagaagggtggagatcgatttcctggtttgctgcttgctttttccctggaattgcttttacgattctaacagcactgaattttgttctttggggcagcaacagtacgggtgcacttcccatttccttgtatttcaaattgtttttcctctggttctgcatttcagtgccactcactctcattggaggatttttggggacaaaagctgagcaaattgaatttcctgtgcgaactaaccagattccaagagaaattcctgcacgcaaatatccatcatggcttcttgttcttggtgccggaactcttccatttggaacccttttcatcgagcttttctttatcctttctagtatctggcttgggaggttctattatgtttttggttttctgctggttgttcttttactgttgactattgtctgtgctgaagtgtcggtggtcctcacatatatgcatctctgtgtcgaagattggcggtggtggtggaaggcattctatgcatcaggctctgttgctctttatgtctttttgtactccattaactacttggtttttgacttgcagagtttgagtggacctgtctctgctatactttatatcggctattcgctgctcatggcaattgcaatcatgctttcaactggaaccattggtttccttgtctcgttctactttgtgcattatttgttctcatcagtaaagatagattaaggttgatctttttgctatctctcatcaactaaacaaaaggcatactggaaggagaattttgctcaattgttataacttctgcttgattctttttgtaactcgattgctttgtggcatgttgagtatggaaaacagatgctcctattgtgttaaatagttatatgattttatattgcaatgtaatctgcactttgttccgct

SEQ ID NO: 411 - DNA, 2289 bp, Medicago truncatula
tcataccaaccctaatcggaattgaaaatggcggtggaggagggaactggcggtggtggcacaactatcatcgacgagatttacgaattctgtgcgccgagattctttgatttcttgaaaggggaatccgatgatgatgttcgtagggctgaactttggtttcataccgctttatcttatgctccttctccattcatgcctaaaatcaaggctggtagatccattactgtagataccttatgtgattttagtgaagctgacaatatgccaaaggttgaagacagtgttcttgaatcaaatactcggccacagagcattactagcaaagtaaaggaagatgacagagccaaggaagaaaagcttacaattgttcctcacatgaattgtaccactaagaaagaggatgcaccatgctgcgaggccgaagaaaacagttcaacttctcttgaggatggtgttggtaagaaaatgagtaaaggggagatcttaaacacagcaacatccacaaggggatcatctgttgaagtaggaaaagatgcttgcacaccaaaaccagcattgcgaaaaagtgtcaatgccccttccactatttctaagaagcaacagaactctaagaaggtatccacaaataccaaaactcggttacaatcaggagccacgaagagcgctgcagggactccccacttcacccaagagaaccaagccattaaaaggcaaaaattagaaggagggaaaactagacagattctgaatctcaaacctcaaactttgcctcatgataagtcaaaactgggttactcttcaagtactagcaaaactcaaaaagaggacagaaaggtttatgttcgtgacacaccaaaaacaccagcagcaccatttaaatcaatggcagaaatgatgaagaaatttgagtctagtacgagagacctgccactgcccaacactctttcccattcaaaaccgaaactaacattgaccaagcctaagtcacctgaatttgagacaaatcagcgggttcgccctgctagagtgaagagcgctgctgagcttgaggaagaaatgatggctaaaatgccaaaattcaaggctcgaacactaaataagaagattctgcaaacttcaaccttgcctcccatgccaagaagtacaccccaaccaccagagtttaaggaatttcatctagaaacactggctagggctcatcaaaatacagattcagcttcaaaagcctcatcagaggtgtctcataaggagaactcatcgaaacctcatctcactgaacctaaacctccactactccaaacatcactaagggcccgcccaccaacagtgaaaagctcattagaaattgagcaagaggaacttgaaaagattcctaaattcaaggcaagacctctaaataaaaagatctttgaaagtaaaggggatattggaatattctgccatatgaagaaacatgttaccgaacctcaagaatttcactttgcaacaagtgagaggtttccaccttctacggcagtggctgatttatttgacaagctttctttgaagtctgaacctgcacgtaatacaattccaagaaccactactccaaatccattccatctgcacactgaggaaagaggagctgagaaagagaagaaactgtacatggaacttttgcagaaagaattggaagaggaagcaacaagggttccaaaggctaacccatacccctataccaccgactatcccgtgatcccaccaaagccagaacccaaacaatgcacaaaaccagagccttttcaattggagagtctagtgagacatgaggaagaaatgcaaagggaacaagaagaaagacttagaatggaaagagaagaagcacagatgagaaaatttaaggcgcaaccagtattaaaagaggacccaatcccagttccagagaaggtccgtaaaccccttacacaggttcaagagtttgatttacatttgaatcatcgagccgtggatagagcacaatttgatcagaagattaaggagaaagaagtggtatacaaacgatacagagaggaaagtgaagcagcaagaatgatagaggaagagaaggcactgaaacagatgagaaggacaatggtccctcatgctagaccggttccaaactttaataatcctttttgcccacaaaagacttctaaaacaacaaaacccaagtcaccaaacttgcgtgtactccaaagaagacggttcaatggttccacaacttcgagtcctgctactagcatgagatgaagacggtatcagatctga

SEQ ID NO: 412 - DNA, 986 bp, Arachis hypogaea
acatcatgggtgttaagggttttgtagaaggaggcatagcttcaatcgttgcaggctgttcaacccacccactcgacctcatcaaggtccgcatgcagctccaaggcgagtccaatccaacctccgtaccttccctccgacccgcactcgccttccaaaccggatcccgatccatccacgtctcaccacctccgcaaatcacccaacctcctcgcgtcggactcgtaaccgtcggcgtcaagctcgtccagcaagaaggcctcgccgctctcttttctggtgtctccgccaccgtcctccgccagacactatactccaccactcgtatgggcctctatgacctcctcaagcagaaatggtccgtcccttcccccgttcccggcggcgccaccaccatgcctctctcacgcaagatcgaggcagggctaatcgccggcggcgtcggagccgccgttggtaacccagctgacgtggccatggtgaggatgcaggctgacgggagactccctccagctcagcggcgcaactacaagtccgtcgtggacgccataacgaaaatggcgaagcaagaaggcgttgcttccctgtggcgcggttcatcgctcacggtgaaccgcgcgatgcttgttacggcgtcgcagctggcgtcgtacgaccagttcaaggaagcgattcttgaaaaaggtttgatgcgcgatggtttagggactcacgtgacggcgagttttgcggcggggttcgttgcagctgttgcttcgaaccctgttgacgtgattaagactagggtaatgaacatgagggtggagccaggggctgagccgccgtacactggggctcttgattgtgcgctgaagacggtgcgtgcggagggtcccatggcgctgtacaagggtttcattcctacgatatcgaggcagggtcctttcactgttgttctgttcgttacgcttgaacaggttcgcaagctcttcaaggatttctgatga

SEQ ID NO: 413 - DNA, 1574 bp, Arachis hypogaea
tgacgatgctcacccggatatctcacaggaagctttggacctccgcccgccgggttctccgcccatctctctgccgaacctcctctgctccgctgccctcacctctctctcactctcacaccttctcttcttctgcctttgctcttcgttctacaacttatgcttattttgatttcgattttctacattggaagaggcattgcttttctactcaacctgcactagaacttccggccggtaagatcgtggatgtgccgttggcacaaactggggaaggtattgcagaatgtgaacttctcaaatggcatgtccaagagggggactatattgaggactttcaaccactttgtgaagttcaaagtgataaagctactatagaaatcacaagtcgttacaaaggaaaagttgcacatgttctccatgttcctggagatattgtaaaggttggagaaactcttttgaagatattagttgatgagactgcattcccttcggcgactgtcggtgattcagaaattacaaagtcacttcattctgatcaagtattagtcaatgagtctgcatctgctatagcggctcttggtaattcaaataatgcagaattactagattctgatcttgaaaaaaggaaacgtgctgcagtattatcaacacctgctgtaaggagtctggcaaagcaacatggtatagacataaatgaagtatgtggaactggaaaagatggaagggtactgaaagaagatgtgctcaattttgctgctaagaagggaatcattgtaagtgtatctgctgttttggatgctgataatgtagagaagcctagaggagcagaaggatataccgtgacacctgagtataaatcaccatcagaggataggatacttcccctaaggggataccaaagagcaatggtaaaatcaatgtctctggctgccaaggtcccacatttccattatgtagacgagataaactgcaatgctctagtggagcttaaaacagcgtttcagaaaaacaatccttatccagatgtcaagcacacttttctgccaatattagtcaaatcactgtcaatggccctcaccaagtaccccgctttgaatagttgcttcaaagaggattcaatggaggtcatactcaaaggttcacacaacattggagttgccatggctactccaaatggtctagttgtaccaaacataaagaatgttcagtctctttcaatattggagataaccaaagaactggcaagactgcaacaattggcttcagagaacaagttaacttctgatgatatatctggtgggacgattactttaagcaacattggagcaattggtggaaagtttggttcccctcttctcaacctgcctgaagtctccattattgccattggtcgaattcagaaaattccacagtttgatggcaatggaaatgtgtatcctgtatcactcatgactgttaatgttggtgcagatcatagagtcttggatggagcaaccgtttcaagattttgcaatgagtggaaacaattaattgaaaatccagagctcctaatgttgcatttgaaatgatga

SEQ ID NO: 414 - DNA, 2153 bp, Pinus taeda
ctgccatggagcgacagcagcagcagcgacaagaattgcgcgcagaggagataacgaagtacgcgcacagcccagtgcactgtgcagtagcggggcgggattatccggcgcttcggcggatcctctcaacactgccgagattgcccaaggctggagaagtgaccacggaggaggaatcgatattggcagagcaacgggcggacatcgtgtctggttgcatagatcggcgggacgtcccggggcgggagacggccctccatgtagccgttcggcttggggattgtacagccgtggagatgctgatggctgccggggccgattggagcctccagaacgagcaggggtggaacgccttgcaggaagcggtgtgcgcgcgcgaggacgccatcgcaatgacgataaccaggtattatcaacccctcgcctgggccaaatggtgccgacgcgtcccccgcatcatagccactgctgggagaatgagagatttctatatggaaataactttccattttgagagctccgttatccccttcatagggcgcattgcgccgtcagatacttacaggatctggaagcgcggttcgaacctcagggctgacatgacccttgcagggtttgacggttttcggatacaaaggtccgatcagagcttcttgttcttaggcgagggcaccgaggacccgagattgtctgctggatcacttatcgtccttactcacaaagaaaaagaaatcagcaatgcgctcgagggtgccgggagtccgccatccgatgctgaggtcgcgcaagaggttgccctgatggcgcagacgaatttatataggcctggcattgatgttactcaggctgagcttgttcctcatttgaattggaggcggcaggacaggactgaaatggttggtccctggaaggccaagatctatgatatgctgcatgtgatgctcagtgtcaagtcccggagggtccctggggcgatgactgacgaggaactctttgcggcagagaatgataagtttgcggatgagccggtgggttatgaggagatgctgacaaaggaggagaaagaacagctggaccaagctctgaacatggggaattcggaggccatcgaagatgagggggccatattctctggccctgtggatcgggatgaatgccatcagaatggtgggttgtcgggttctgcaggggatcctgatgcctctgagtcctccgaggcttctgaagccaactgtgataaagataagcgaggttggtttgggtggagcaagaagatgacaaaaactgatggactgaagcgaacatcactgagttcacaaattaataagcttgataaacagctagagaaaccccttcctgaatgcaatggcagtggcactttagttaatgaggattcgacaaggatactaaggaagttccctaagttagctccagagagcagtcagaaatcagtcgaccaccaaccatctgaatttcagaaggatgatgctgtaggtagtagaaagggaaaagagaaggctaataaaagcattaataagaaagattcaagtaaaaagaaaaggtccagtggaacaaatgacattaagcaagaaagtgaatacaagaaggggttaaggcctgtgctctggctgacacctgattttcctctcaaaatagaggagtttctgcctttgcttgacattttagccagtaaggtaaaagctgtccggaggttgagggagctgttgacaaccaagctgcctcctgggacttttcctgttaaggtggctattccacttgtccccacaataagggttgtgatcacatttacgaaatttgaggaactgcaacctgtagaagaattctcaactcctctttcaagtccaggtcattttcaggatgcaaaagggaaagagacacaggcttctaattcatcagtttcatggatgtcttgggtgagggggtctcatagtcgtacatcaagtgaaccaacaaatttggaagatcatttgagagatgatttagatcctttttacataccaagtaactatacctgggttgacatgaatgaaaagaagcgcagaatgaaagccagaaagtcgaaaaacagaaaaggaaaagcacattcttctcggcttgcagatgggtcgttgactgatattgatgagtaataa

SEQ ID NO: 415 - DNA, 329 bp, Plantago ovata
aaaaaatggcaattagaaaatcaaacaagatgatgtcacaaaaggcgatgatcaagcacataatgaagagatgctcgagcttaggcaaacgccaaggctacgacgacgaagagcaagggctgcccctagacgtgccgaagggtcatttcgtagtgtacgttggagcgagacgaacacgatatatcgttccgatttcgatccttaacttgccggagttccagaacctcttacggcgagccgaggaagagttcgggttcgatcatgacatgggacttacccttccgtgtgatgaggaggtttttgagtcgctaacgtcacaattgtgatga

SEQ ID NO: 416 - DNA, 760 bp, Populus trichocarpa
tagccatggctcgatacgatcgtgcaatcacagtgttttcaccggatgggcatttatttcaagtggaatacgctcttgaagctgtccgtaaaggaaatgcggcggttggtgttcgtggtactgatattgtcgttcttggtgttgaaaagaaatccactgctaaacttcaagattctagatcagtgaagaagattgtatctttggatgatcatgtagcactagtatgtgctggattgaaggctgatgcgcgtgtcttgattaacaaggcacggattgagtgtcaaagctatagactcactgttgaggatcctgtaactgttgaatatataacacgctacattgctggtttgcaacagaagtatacacagagtggtggtgtgaggccatttggtctttcgaccttgattgttggttttgacccacacttgggtgtcccagctctttaccaaacagatccttcaggagcattttcagcatggaaagccaatgctaccgggagaaactcgaactcaatgcgggagtttttggagaaaaactttaaggaaacttctgggcaagaaactgtgaagttagcaatccgtgctttacttgaagttgtagagagtggggggaagaacatagaaattgctgtgatgacaaaagaccaagggctgcggcagctagaagaagctgagatcgatgcaattgttgctgagattgaagcggagaaagcagcagcagaagctgcaaagaaaggtccgccaaaagattcctagtagag

SEQ ID NO: 417 - DNA, 1154 bp, Solanum tuberosum
ggatccgctcctccattaactcgttctctgtaactcaacaatgagctgctcatcttctttgattcttccttccatttcttcaaatgggtttcgaagatttagtccattgaaattggataagtctagggttttcatgagtagcatttccgttggatcacgaattgccgccgtcgatgatgctctgttcactgattacaagcctaccaatgcttttctcttccctggacagggggcacaagctgttggaatgggtgcagaggctcagaaggtgcctgctgcagctgaattatacaagagagcaaatgaaatcatggggtttgaccttttggatatttgtattaatggtccaaaggagaagttagactccactgttctaagccagccagctatctatgtcactagcttagctgcagtggagatactccgtgctcgtgaggggggtcaacaaataattgattcggttgatgtcacatgtggtctgagtttgggcgaatacactgctctggcatttacaggagctttcagttttgaggatgggcttaagctggttaagcttagaggagaagctatgcaggatgctgctgatgctgcaaaaagtgcaatggttagtataattggactggattctgacaaggttcagaaactgtgtgatgcagctaatgaggaagttgatgaagccaacaaagttcagattgcaaatttcttatgccccggaaattatgcagtctctggaggtgttaaaggaattgaagcagtagaagcaaaagcaaaatcgttcaaagcacgaatgacggtacgtctagctgttgctggagcttttcacacaagttttatgaatccagctgtctcgagattagaagctgctttgggtgcaacagagatcagaactcccagaataccagtaatatcaaatgttgatgcacaaccacatgcagatccagatacaattaagaaaatattagctagccaggtgacttcaccagttcaatgggagaccacaatgaaaactctcctatcaaaagggctaaagaagagctacgaattaggtcctggaaaggttattgccggtattgtcaagaggatggacagaggtgctgaaattgagaacattggtgcctaagctttgtattgagagacatcatcggtgggaattc

SEQ ID NO: 418 - DNA, 1745 bp, Solanum tuberosum
aaggcacacacttctcttcgtctccacagtccacccactgatcagctcccggagattaacgaaatcggaaaaccaatccaactattttttgattaccgatcaaaaaaatgtctcagagccttaatccgaatccaacttacgacgtgataatcttaggcgcttcaggttttactgggaagtacgtcattagagaagctctcaaattcctcaatgttccctcttcccccttgaagaatttagccattgctggccgtaacacttcaaagctttcccaggctcttcaatgggcttcccgtccaaacccacctcccgaaatccccattctcactgccaataccactgacccatcttccctccgtgaccttgcttcacagactaagatcattcttaactgtgtcggaccgtttcgtctttatggtgagcctgttgttgaggcctgtgctgattctggatgcgattacttggatatttctggggagcctgagtttatggagaggatggaggtgaagtaccatgataaggctgtggaaaatggatccttagttgtttcggcatgtgggtttgattctattcctgctgaattgggcttgatgttcaattcgagacagtggctgccgccggctgttcctaacagtgttgaggcctaccttagtctagaatcggacaagagaattgttggaaatttggggacgtatgagtcagcggtgcttggtgtggctaatgtggacaaattacaggagctgcggcggagcagaccaaagaggcctcgtcctgtgattcctggtcctcctcctcctaaaggtccgttgatggaccacctaaaggaagttggtgtttgggctgtaaagttaccatcagcagatgcaattgtagtccgaagaacactttcatgtttggctgaaaatcctcatggtttacctggtgttaatgaaagcactgaacaagttgagaggagggagacattttggtcaagcataaagccagctcactttggtgtgaagatagcttcaaaatctccgttaggaattgttcgtttcattatagtcgggctgttcattggtctctttggtaaaactggtttatggaggtggctgctattgaaattcccttcattgttcagtcttggatggttcaggaaaaaaggtccaactgaagatgaagtggcaagtgctacctttaagatgtggtttgtcggacatgggtttagcgatggcagtcttgcatcacaaggaaacatgaaacctgatacagagataattacaagagtaatgggacctgagattggttatttaacaactccaatcattcttgtccagtgtgctctcattttgctcaaggaacgaaacaatcttccaaaaggaggtgttttcccacctggggttgtgtttggcccaaccgacctccaaaacaggcttcaacacaatggaatatcttttgatgttatttcaaagaagacaatctaactaaatggtagtgttcccttctattcacatgggaaaatttgaacttcctctaaagggagaatgatactagttacttatgctttcattgtatgtttttcttccagacgtttttctgaatgtttatgtgcttgcttaataccttaaggtgcttcctcgacatttttctttccgtatttagattactggataagctctactttgtttaacaatttgttaactcctgtggatcttgatatcaggagcttccactttacacctgtaaacttgctttaatggactgca

SEQ ID NO: 419 - DNA, 1194 bp, Solanum tuberosum
cttcttcactctgcaaatatggtgctcaaagtttcagttttgcttcttttctcatttctcttcacagcctctgctgttcgcccagctcctcctcttgaaggattacttccaaatggtaattttgaagagctaccaaagccaaaagacctcaagaagaaaacagtgcttcaaggtaaatatgctttgcccaaatgggagattaatggcttagtggagtacatttctggcgggccacagcccggtgggatgtacttcgcagtctcccacggtgtccacgctgtgaggcttgggaatgaggcttcaatttctcagacaattccagtcaagaaaggctctttgtatgcactcacatttggggcatcaagaacttgtgctcaagaagaggtgttgagggtgtcagtgcctcctcaaacaggagaccttcctttgcagaccctttatagcagcaatggtggtgatacttatgcttggggtttctatgccacctctaatgttgttaaagttacctttcataatcctggagttcaagaggatcctgcttgtggtccactcttggatgctgttgctatcaaagaactttttccgcctcgccctacaagagtgaacttggttaaaaatgctggttttgaagaaggacctcacctcttgataaactcttcacatggagttctcctccctcccaagcaggaagatttgacatccccacttccaggatggatcattgagtcactcaaagcagtgaaattcttggattcagctcatttcaatgtcccgtttggccaagctgcagtggaacttcttgcagggagagaaagtgctcttgcccaaatcattaggacggtccctaagaaggtctacgccttcacattcagtgttggtgatgcaaagaacggttgtcatggtgatatgatggttgaagcatttgctgctaaagaaacgttcaaagttcccttcaaatcacaaggcaaaggcagcttcaaaactgttagtttcaagttcacagctattgcagacaggaccagaattactttctacagctctttttaccacacaaagatcaatgactacggcgctctttgtggccctgttgttgatgaagttaaggtgacccctgttgcttagggtctctaaaagtactccaaaaaaagtgtttctcatagagtttttgcaatggtcatatcatactccccatga

SEQ ID NO: 420 - DNA, 1398 bp, Oryza sativa
ctgattccgtttccgtttctcctcccctcaccgactcgtcgtcgtcgtcgccacggtcgccggcggagaggagagaggcctcgtcttcgccgccaatggccgcctccgtccccaacggccactccgtcgccggcgaaggagggacgcccgcgccgccgccgtcctcctcctcgctggtgttcctcgggacgggctgctccagcgccgtgcccaacgcgcggtgcctgatccagccccccgacccgccctgcgccgtctgctcccagtccctctccgtgccccccgagctaaaccctaactacaggtgcaatacttctcttctgattgattattgccaagatgaagtcacacacaaatatattctaattgatgttgggaagacattccgagaacaagttctacggtggtttatccatcataaaatcccttgtgttgattctattattctgactcatgagcatgccgatgcaatcttgggtcttgatgatgttcggattgtacagccatttagtcctacgaatgatattgagccaactccaatttatctatcccaatttgctatgaacagcattgcccaaaagtttccttacttggtcagaaagaaactaaaggaaggggaagaggttcggcgagttgctcagcttgattggagagtaatcgagagtgatcttcagaaaccatttgtgacctcagggctagagtttgttcccctgccggtgatccatggcgaggactatgtttgtctgggtttcctttttggaagaaaatcaaaagttgcttatatatcagacgtttcacggtttcctccaagcacagaacacgcaatttcaaagtctggagagggtcagctggatttgctcatcttggactgcctttataggactggttctcataatgtccatctttgttgggatcagacactggatgctgttaagaggatttgccccaaaagggcattgctcattgggatgactcatgagatggaccatcacaaggacaatgaaacgttggaagagtggtccagaagggaggggatagatgtgcagttagcccgtgatggattgcgcgtctacattgatctgtaaatttgacaaagggcatttgcttcttcagtaacctgcattaagcttccagttgccgttactattcagctcctcttgataagaaactgaaaggagaaacggcaaatgctgctgctttgacagcgtactggtcatagttcaaactcactaggtacagtagaataattcatcaaacctggttccaaatattagtatttagtagtagtaataaaaggcaaagcagctgcttcattgcagcaccccacagaatcccagttcctgtatgtttgtcttgtgcaaaccacttgaagatttcttgtcaatgccagtgtcgtag

SEQ ID NO: 421 - DNA, 2721 bp, Oryza sativa
caacgttcgtctcctcttcccccgatccaaccaccaccaccttcttctcctcctcttccgctcgacgccatcaccacgcacttgagagagagagagagagagagagagagaaaccctaagcctcgcccgctatccagccaagcaccgatggcgacggacgcgaacccggaggcggcggcgccgccgccgcagttactggtggacgagggctacgagttctgcgcgcccaagttcttcgacttcgtctgcgacgagacggaggaggaaatccgcgccgccgagcgctggttcgaggcctccgccagccacgccccttccccgttcgctccgaggatcaaggagtcgagggcggaggtcaagatcgagagcctctgcgacttcaccgacgcggagccgattccgaaggaggtagcagtggaggaggcagcaggaagcgccgccaatccctcgcagaattctgatgggaatgtgcaacagaataaggacggctccatcaaacttgtccatgaagcaaatcccagtgaaaattgtgtcactgacggcgatcataagcaccaagaaagtgatgcaatgttggagtcgccaccagcagaggaggatgagaaggaatcgccaaaatccttcgagtttgtcccttccaatgcaaaatcagcagatgttgcttctagcacaccgaagattcagaggcctccacccgtcaaagctgtcactacggtgcctacctgtcccaagctgacagtgaagacagaagccttcactccgaaggtgcaggcaacgaactcctccagaggtcttgcacccttgactggctcaagggcacatccatctgctttgaagcagtcgatgagcgtcaagaggagtgtgatcaaatgtcctcgtgagttgctggctgggaaggccgctactgctgcgaatgaaatcgcacaagaaaatcaagctgtcaagagacagaagcttgatgatgggaggacaagacagatactgaacgtgaagacaaggaccctgcctcacaaggggagaggaggtggtctagcaggaagcaccgagatgagcctgtcggccatgaggaagcaccgtgacgattcacactctctcaaggaagtgactcactatatatcggcagcagagatggtaaagaagttcgagtctgggactagagagttggccatccctcacaacagatcgctttctcatgaggatgcagcaaccgcattacaaagaagaacaaagctgatgctaacaaggccaaaggaacctgagttccagacctcccacagggtccgtgctgtcagagtgaaaagctctgctgagctagaggaggagatgctagccaaaattccgaagttcagagcacggccgtttaacaaaaaaattgcggaggccccttcatttcctcctcttccaaggaaagctccacagcttcctgaatttaatgagtttcatcttaaaacgatggagagagctacacgacatgcagacacctgttccgaagcttcttccgtggggactatcaggagtcagagcagtaagccactgaccttgacagcgccaaaaccaccccaacttgagacagcattacgagctagaccaccaagggtgaaaagttctcaggaattggaactagaagaattagaaaaggctcccaagttcaaggcaaagccactgaacaaaaagattctcgagagcaagggtgatattggtgtgtttccacatctaaaggctcaaccaacagcccccaaggaattccatttctctaccgatgatcgcttgggtcctcctgcagttgtggatctatttgataagctctctctttgctcagaatcttcatatcatagcaagaaagatgtgcccagattgacaataccaaaccccttcaatttacatacagatgaaagagggcatgagaaagagaggcagctagctgcacaactgctgcaaaagcaattacaggaagagaaagccaggattccgaaggctaatccttatccctacacaactgactatccagtgataccaccgaagcctgaaccaaaaccatgcacgaggccagaaggctttcagttagagagtttggtgaggcatgagatggagcaacagaggataatggaagaaagagagaggatggagagggaagaggcccagaggagagtagtgaaggcacaccccataatgaaagaggatcccattcctcttccagagaaagagaggaagcctctcactgaagttcaaccacttaagttacatgttgatgaaagggcggtccaaagatcagaatttgacaatatggtgaaggaaaaggaaataacttacaagagattgcgagaggaaaatgaattcgcacaaaagattgaggaagagaaagcgttgaagcagctcaggaggaccttggtgccacaagcacggcctctcccgaagtttgacagaccatttcgtccccagagatcaaccaagcaggtgacgaggccgaagtccccacagcttcaggtcgaccaaagaggggcaagaaggcacgccttcatcagatgatccaactctccggctcatcttgttgtcgtctatcggttacccactggctgctgctgttttctcttctgttcttgacgtcaagatcatccccaattctcgcagcgattctttctgaccaatacataaataggccgatccaatcctgttatatagtcagtcaacacagctgacggcgtgtgtatgctcctttagggt

SEQ ID NO: 422 - DNA, 1192 bp, Oryza sativa
gcatactctcgcctctgaccccgagtccatctccccgtcccggcgtcgcctcggcctcgactcccgtctcctcgaggagttcgccccgtcgcctgcggccgatctccatccatcccgcgagcggcggtgcggtgttcctgctgcttccgcctccgggcgggagagggaggagcgggtgaccatggtgagcatggaggtcaccgatgagatgttcaagtgcatggaggttgggctggccttccgggactataatggaagaatcagttctatggatttccacagcaaggctacaaattacctcgtgacagcatgtgatgatgaatcaattcgcctatatgacattcaaaatgctgtgtgtttgaagacgattaatagcaaaaaatatggggttgagcttgtgtgcttcactgaaaacccaacttatgtcttgcattcttcaaaaaatggatgggatgattctctccgtctactctcactggtcaataactgttttttgagatatttcaaaggccatctagacagggttgtttctatctcattgtgctctgagaacgggaacattctctctggttcacttgatcgaacagttctcctatgggattcaagggttgaaaaagcacagggtttgctgcgtgttcaggggaggcctgcagtttcttatgatgatcagggtttggtttttgcaattgcatatggtggctacataaggatgtttgatgctcgaaattttgagaaggggccttttgatattttctctgtcggtaatgatgattcagaagccaatgtcataaagttcagcagtgatggcaggcggcttcttttaaccaccaaagctgggcgtgttcatgtgctagattcatttcatggcaataatatagcaacatacaacgtgaagccagtggtaagcaattcgacgctggaagcatcattcagccctgatggaaaccatataatatctggctctggtgatggcagtgtatatgcttggaatgttaggagtggaaaggttgctcgctggggaagcacagatagtgagccaccgctaattagatgggctccaggatctttgatgttcttgactgcatcttcggaactgtcttgttgggtccctgatctatctaagctgggatcctttactgttagtaagtaattcgaatggtacgagttgttgtttgtgtatgctcaggcctag

SEQ ID NO: 423 - DNA, 1226 bp, Oryza sativa
gattcatgcgatcgatgccgttccagctcaagaacggtcaccaccaccacggcgccatggaggggaagccgccggtgacgccgatgcagcagcagcagcagcatgcgccgccgccgagggtgtcgaggtttcggaggttgctggtgagggtgtctgcgtcggagaggctcgccggggatgggaaggagaggggggagaaggaggcggagaaggtctccgcctccgccgccggcggtgaggtggaggccgggtcggtggggctcgaccgcatggtgctcagcttcatggaggattccgcggccgtcgagcggccgcagcgcgggcgctgcaactgcttcaacggcagcaactacgaggagagtgacgacgaggagggcttcttcctcccctccgaccactcctccgcctccgcccccgccgccgccggcgacgccttggagtctctcaagggtttggtgcagagcgcgagcgtcgcggagcggaatcttctcgcggacgcgtcgaggatcgcggagaggtgctgcaagggatccaagggcaaggcggagtgccgccgcgcggtggccgacggcctccgcgcactcggctacgacgccgccgtctgccgctcgcgatgggagaagacctcctcgtaccccgcaggtgagcatgagtacatcgacgcggtggtcggcgaggaggtgaggctcattgtggaggtggacttccggtcggagttcgaggtggcgcggtcgaccaaggcgtaccgggcggcgctgcaggcgctgccgccgctgttcgtggggacgccggaccgcctcgggcagatcgtggccgtcgtggcggaggcggcgcggcagagcctgaagaagaagggcctgcacttccctccatggcgcaagccggagtacatgcgcgccaagtggctgtccccgcacgtccgctccggcgacaaggccgccgccgccgctaaaaccgtgacgtccactacgtcggcgacggcgacgccggtctcggcggcgagcttctccggcgcgttcgagctcctgttcgataggaaacagagcggggagatccccgccgcggagaagatcacggtagtggtgtcgccgtcgccgtggcgcccgacggaggaggcgagcaagaagaagccgccgccgtcgccatcgccgccgcagctgtggcagcagcatcagcagcctcccaaagcgaaggtcgtcacggggctcgccgccgtcctctgatga

SEQ ID NO: 424 - DNA, 869 bp, Oryza sativa
cggctatgaaggccgccgcctccccgctccgcgccgccctcctcctcttcctctcctcctcgccgtccccgcgtctcgcgctccccatgaacccctcctcctcctcctcctcccgcggcgccgcctcctaccactccaaggccgccgccttcgcctccccgcagcctcgcggcggcggcggcggccgaggggggcgacgcggcggcggaagaggccgcggcggcgatgggagcgaccgcatcgacgccctcggccgcctcctgacgcggatcttgcggcacatggcgtcggagctgaacctggagatgaggaccgacggctacgtgcgggtccgcgacctgctcaagctcaacctgcagaccttcgccaagatccctctcaagtcccacaccgtcgacgaaatcaaggaggcggttagacgggataacaagcagaggtttggtctgttggaggaagatggtgagctgctgattcgagctaaccagggccacacagtaacgactgttacttcagagagcttgttgaaacccattctatcagcagatgaagtctctgtttgtgtgcatggaacatacaggaagaacctcgattcaatcttgcatcaggggctaaaacgaatggcaaggttacatgtacatttctcaagtggcttaccgacagatgggggagttattagcggtatgcggcagagtgttaacatcttgatatatttggatgtcagtatggcactgcaagatggaatgaagctgtacatttcagacaacaaggtgattctgacagagggtttcgatggcgttgttcctgtgaagtacttcgagaaaattgaaacatggccagggagagcaccgataccatttgaaaaatagtag

SEQ ID NO: 425 - DNA, 642 bp, Oryza sativa
tcccatcaagagaaagaggcgtcatcaactttagtagaatctccagttccaattttccatggcgaccttggcgcgcgtctccctcccctctgtcctcctcacgctgcggcatggcgcaaccacccagggcttcgcggcggcgaggccggcggcggtagtggcaaagaggttgctcggatccgtcagatgcggcggcgccgccgaggccttgggcgcggacatggcggtgccgcggtcggtgccggtgcgcgtcgcccacgagctgcagcaggccggacaccgctatctcgacgtcagaaccgagggtgagtttgcaggtgggcatccagttggagctgtaaacatcccatatatgtacaaaaccggctcaggactgacaaaaaacacacattttcttgagaaagtgtcgactacctttgggaaggaggatgagatcatcgttggatgccaaagtggcaagagatccctcatggcagcatctgaactctgctctgctggttttactgctgtcaccgacatcgccggtggattttctgcctggaaggagaatgaactcccaaccaacaagtgacgttggcctgaaagattttctgcgtttctgaaacctaataatctgcagatgacttcacgctccgaattcat

SEQ ID NO: 426 - DNA, 1808 bp, Oryza sativa
gttcccgcgacagcttcgtgcgccgagctgaggcgatgtcggtggcgctgtacgcgcgtgggggtggctgcggcgcgaaggcggccgcagcgcggcgctcggggcgcggcggtggtgggcggaggcgcgccgcggtcgtgctgctgctcgcgctggcgtacgtggcgggtctgctcgtgttcgtgcttgcgggaggcggtggtgttggagttggagggcgcgtggaggtggggcgagaggtgggggtgatgacggtggcctcgctccggaggcggcgcgccgcggcggcggcggcgccgcagcccgggtcggtgtaccgcagccacctcgtgttcgagcggctctggccggacatccgcgacgacgccagctccgcctccgccgccgcctcgtcgctctcctccacttcttggcgtcgcagcatgttgatgacatcgcactatcagaatcctggggagctatggatgccttgtgtcaacaggaagctgattcgaccagagttgccaccttcaaatggttatctcatgatcgaagcgaatggtggtctgaatcaacagcgtctttcgatctgtgatgcagttgctgtggccagtttgcttaatgcaactcttgtgatcccagcatttcattttaatagtgtttggcgtgatcatagcaaatttggtgacatctttgacgaagaccattttattgagacactcaaagaacatgttagagttgtgaaggaattacctgtagatgttttgacgcgcttcgatcataatatcagcagcataccaaatatgagaactaaggcctattcatctccaaatcactatatgcagaaggtgcttccgaaattgctggagttaggggctgtgcgaattgccccattctcaaatagactggcacaatcagttccatcaaatctccaggccttgagatgttttgttaactaccaagcgttgagatttgctgagccaataagagttctcgcagaggatatggttgaaaggatggtaaaacggagtactttgactggtgggaagtttgtatcagtacatcttcgcttcgaagaggatatggtagctttttcatgctgtacatatgatggtggcttgaaggagaaaactgaaatggaaaatgctcgtgaaagaagctggagaggaaagtttcatcggcatggtcgagtgattaatcctgaggcaaacagaagagatggaaaatgtcctcttactcctctagaggttggtatgatgctgcggggcatgggatttgacaataccacctccctctatgttgcttctggtaaaatatacaatgctgaaaaatacatggcaccgcttcgacagatgttccctcttttggcaacaaaggatactcttgctttgcctgaagagcttgctgagtttgaggggcactcatctcgattagcggcattagattactcggtctgtcttccgagtgaggtctttgtgacaactcaaggtgggaacttccctcactttctgatggggcacaggcgctacctgtttggtgggaatgcaaggacaataaagccagacaaacggaagctggttttatctttcgatgatccgaatatcagatggaatcggttcaagcgccacatgcaggatatactacaccatagtgacatgaggggcactgcattgaggaaacccaatgattccatatacaccttcccaatgcctgaatgtatgtgccagcaagatgggatgatgtaggccttgtatgattcatgcacatacgtcgaggaggaggaaatatgcaattttgtacactctgtaatgatctgtaggtagccacca

SEQ ID NO: 427 - DNA, 2195 bp, Oryza sativa
atctcgctctttagcctgtagcggcggcggcgcgggggagatggagagcgtggcggcggcggcgcggtcgctgcgtgccggggtggagaagtcgcgggcgctggggcaggcgctggcgcgggcggggccgcgggtggaggagatccagctcgcgctgccggcgctggaggccgccgtgcgcccgatccgtgcgccgcgggccgagctggccgcggcggggccccacatcgaccgcgccgtcggccccgccgcggccgtgctcaaggtgttcgacgccgtgcacggcctcgagccgccgctcctcgccgcgggcgccgtcgccggggacctcgcgggttacctcgccgtgctcggccgcctcgaggaggccctcaggttcctctccgataactccggcctcgccgcgcagtggcttgcggacatcgtcgagtacctcggcgaccatgacctcgctgacccaaggttcctcgccgacctcgccgtcaccctcgaggggctcaagaaaccttccggtgacctcgacggtggcctcctggcggccgctctggacatgctcgaggcagagttccgccgccttctcgccgaccactctgcaccgctcccgctcgcgatgcagcagctgaacacaacctctgcatctactgccgcgccgtctctcatcccggccgcgaccgttcacaagctcagcctgattcttgaccgcctcattgccaatggcaggcaggaccgttgtttgtccgtgtatgctgatgcccgcggaggcgtggtgagtgccagcctccgtgcccttggcctcgattacttgcgaaacccggtcgacgtcgcgcaggcgttgggccctggagttgagttgtgggggcggcatttggagtttgtggtgcgctgccttcttgagtccgagcgacagctctgcaacaaggtgtttgggcagcgcaaggatgacgcatcagcgtgcttcgctgatgttgcagcgcacgccggcattcttgatttcttgagctttggtcgtgcggctgctgatgcgaagaaggaccccattaagctcctgcgtttgctggaggtgtttgattctttgaataagctaaggttggacttcaaccggttgtttggtggaaagaaggcgtgtgtagagattcagaaccaaacaagggaccttgtgaagttgttagtggatggtgctgttgagatctttgaggagttgcttgtgcaggtggagctgcagcggcacatgcctcccccacctgatgggggtgtgccgcgactagttagctttgtggttgagtactgcaatcgcctccttagtgagaagtacaggcctgtgcttgcgcaagttctcaccatccatcgcagttggcgcaaagagacattcagtgacaagatgcttgttaacgcggtgcttaacatcgtcaaggcccttgaagctaattttgatgtctggtcaaaggcatatgacaatgtgacactgtcatatctcttcatgatgaacacacactggcatttctttaagaacttgaaggctactaggttaggcgagcttttgggtgatgcgtggctgcaagagcatgaacagtttaaggactactatctgacggtgtttatgagggatagttggggggtggtttcaccgctgctcaaccgggaggggctaatcttgttctccaagggccgggccacggcaaaggacctggtgaagcagcgccttaaaacattcaatgcgagctttgatgagatgttccgtaaacaatctgcatgggttataccagagaaggacttgagggagaagacatgtggtcttgtggttcaggcaattgttcctgcttaccggagttatatgcagaactatgggccactggtggagcaggatgttagtgctagcaagtatgtaaagtacacagttgatggtttggagaagatgctcagtgcgctcttcattccccggcccaggagggctgggagcttccaaatcaggcacacaaatgacaagattaccagtgcgatgacaggcttttatcggagtgcttctacagtgaaatagctttggttgaagaaccaaatggttggttctactatttatgcaataatgggatatgtaacaatgattcattttcggccagtcagcaaattgctccacactggacgtgaggcccaatagtgaacctgtgatgagaatattggtggcatatgaacataggctc

SEQ ID NO: 428 - DNA, 2587 bp, Oryza sativa
cagtagctaggaagaaggcaagggaagggcatggcgacgctgccggacctgggtgtgtccgccttcatcaacatcttgggcgccttcgtcttcctcctcatcttcgccgccctccgcctccagcccatcaacgaccgcgtctacttccccaagctctacctcactggccagcgacgccaccaccctcaccctcatggcttcgtcaacctcgacctctgctcctacctccgcttcctcgcctgggtccccggcgccctccgcatgtcccagcccgacctcatccaccacgccggcctcgactccgccgtctacctccgaatctacacgctcggcctcaagatatttttgcccatcatgactgtcgccttgctggttcttattccagttaatgtctctggtggcacgttacttaatttacgaaaagaaattgtctttagtgatattgataagctttccatatcaaatgtcaaccctggatccaacaggttctttatccatctattaatggcatatgtgttcactttttggacttgctttatgctatacaaagagtatagcaatgtggcatttatgagattgcacttcctggcttctcagaagcgttgtgctgatcagttcactgtgattgttagaaacatacctcatgtttcaagccattcaacatctgaaacagtggatgaattcttccgtaggaatcatccagaccactatcttggtcagcaggctgtttataacgcaaacaggtatgctaaacttgtgaagaaaaaagagaggcttcaaaactggttggattactaccagctgaagtttgaaaggcatcctggaaaaagaccaattggaaggacagggtgccttggtttctgcggtagagaagtggatcaaatcgactattaccgtgctagaatcagcgagcttgataagaagcttgcatctgagcgtcaaagagttctcaatgacccaaaagctgttatgccagttgcttttgtgacatttgactcgagatggggagctgctgtatgtgcacagacacaacagtcaaagaatcctacccaatggctaactgattgggctcctgaaccgcgggatgtatattggcagaatcttgccattccatttttctctctcagtatccgcaagttcctgatatccattgcagtttttgctctggtgttcttctacatgatacctatagcttttgtgcaatcacttgccaatcttgagggtattgaaaaagttgcacctttcctaaggcctgtgatagacacaccagtggtgaaatccttcctgcagggtttccttccgggtttggctttgaagatttttctgtatatcctcccaacggttttgatgattatgtcaaaggttgaaggttatgtgtctttatcatctctggaaaggagggctgcttcaaaatattactacttcatgctggtgaatgtatttcttggaagcataatcgctggcacagcttttgaacagctaaatgcatttttccatcagccaccttcacaaataccaaggaccattggagtagctataccaatgaaagctacattttttatgacatacataatggttgacgggtgggctggcatcgcgaacgagattcttcgagtgaagccgctggtgatataccacctgaagaacatgtttattgtgaagacggagcgggacagggagagggcaatggatccgggcagcattgggcttgcagagaacctcccatcactgcagctgtattttcttcttgggcttgtgtatgctgtggtcacccccattctcctccctttcattatcatcttctttgccttcgctttcctcgtgtacagacaccagatcatcaacgtgtacaaccaagaatacgagagtgctgctgcgttttggcctcaggtgcactctcgcataatagcgagcttgctgatctcgcatgtaactctgtttgggctgatgagcaccatgaaggctgcctactccaccccgctgcttatctttctgccactcctcaccatatggttccacaagtactgcaagagccgtttcgagcctgctttccgcaagtaccctctagaggaagcgatggagaaggacaatctggagcgcacgtcggagccaaacctgaacctcaaatcgtacctgcagaacgcttacctgcaccccattttccacatgtttgagcagcagcagcagcaggagcaggagcagcaacgggaggagaaggtagaggtgcgaatcgacaaggcgcagcaacatcatcatcggcaggtagaggaggaagaggaggagagcaagagcagccaggctacaacacactactaccaccatcaccatgagcagaccacaacgacgacacaccaccattaccatcagcatgagcatatgagccactaccacatgggcccctccgacacagctgactcaccctcgccgccgcactttgtctaccattatggcgtcgacccttgataatcgcccagatagtctcttagcttctgaatcactagattgtttgttcttttgttttttccttttgtcaattgggggtgatatttttattcctctaattaacgaccgactggctgctgataat

SEQ ID NO: 429 - DNA, 1043 bp, Sorghum bicolor
agtacatggcactcggtggcctcgcgtcgcgctactccctcaccgacccaccgggcaccggcaccggcaccggcaccgcgccacggccgcgttcgtctcgacaggagccgatggccaccatcgcgccacggtcgcatctcctcctcctcggcctgacaaggccgcagcagccgacagcgcttcgtgcctgcgccgccttctcccgctcgcgcggcgcgccagtcccaccgcgggccgcgcagccgcggcgcgtcttcctcggcctcggcgccaccttcatcgaccaggtcacccgcatggcctccggcggcacctcgtcccgctctttcgttgccggagcgcggccgaggcagggggtttccccagtcgagcagattctgaagaatgtggagtggcccgacgagttccctttcaagcctgaggacttcagccgtttcgacgaatcatcagatactctgttctactcagttccacgttttgtcactcacattgatgaccaagcaatccgagctctcacagagtactactctgaagttcttcctccaattaatactcctggggcgaccattctcgacatgtgcagcagctgggtgagccattatcctcccggttacaaacaggagaagatcgtggggatgggtatgaatgaagatgaactgaaaaagaactcggtattaactgagtatgttgtgcaagacctcaatgtgaacccaaagcttcctttcgaagataacactttcgatgttatcaccaatgtggttagtgtagattacctgacaaaaccaatagatgtttttaaggagatgcgacgaatactcaagccaagcggccttgctataatgagcttttcaaatcggtgcttttggacaaaagctatatctatatggacatcaactggtgatgtcgatcatgcctggatagttggcgcttacttccattatgctggaggttttgaacctcctcaggcagttgatatatctcctaatccaggacgaactgacccaatgtatgctgtatgctcaagaaagaaaatagggtaataa

SEQ ID NO: 430 - DNA, 3041 bp, Sorghum bicolor
tcgttccatttccaacttcatcatttctttctttctttctttggtttcttcctctctatctctcgtctccctcctaccgaattaaaactctcgacctgccaagccgcaccgaaccctaggtcccgatccggcgtctcgcccgtgctgcttggatcggacgggtgtgttggatcggatcggcggcgggatgacgatcccgagcgcggaggggttcctccaggcgtcgagctgcctcccttgcacggcggcggaggagcgggaggtcgttgacgcgctcaccagggaggccgagaagaatgtcaagcacggggatctccgctatctcgtctcgcagagctggtggatggagtggcaaggttatgtgggcatattcagtcatggagagaatggcaccgagcagtttcctcaggctatgaatagacctggagagattgataactcgaagcttgtttcggcagaaaggatcaatggtagtgaagagccagagcttcaaaggaccttgagagaaggggagcactatactttggtgccgcaagaagtttggcaaaggctatatgaatggtataaaggtggaccagaaatccctagaaaagttatttttgacaatccaattgacaagacttacatagtggatgtctaccctctctgtctaaaactaattgatggaagggacagttgtcaaaaagttttcagaataagtagaaaggccaaagttcatgagctttactcaatggtttgctcactcatgtcagtagagcagtccgagattgtcatctgggattattaccaaaggtcaaagggcaaaaagttgcttaatcaaaatgagacactagaagaagctcaacttactatggaccaggagatcctcttggagatgaagctgggcgagagcagttcaggtttcagtacaagatccacaaatgatgaattagcattaattccattagaaccctccacatcatcattttctattgctggagggcctacattttcaaagggtttttcatctgggattggttctagtttttcacaagataatagcttcagtcctttattaagggatagtgaagatggttacaatagtctcagcaatggaactaaagatggcactcatggattgagtggattacataacttgggtaatacatgcttcatgaatagtgccatacaatccttggttcatacacctccactggtacagtactttttggaggactatacttgtgaaataaacacagaaaatccactaggccttcagggtgaacttgcgatagcatttggagagctacttagaaaactctggtcatctggtcgaacttctgttgctccacgtgcatttaaatcaaaactttctcgttttgctccacagttcagtggatataatcagcatgattctcaggagctacttgcgttcttgttggatggtctgcatgaagatctgaaccgtgtaaaaaagaaaccatatattgaggcaaaggatgctgatggccgtccagatgatgaatttgctgaagaatgctggaattaccataaagctcgaaatgactccataattgtagataggtttcaaggtcaatacaagtccacattggtgtgcccagtttgtaacaaaatctcagttacctttgacccatttatgtatttgtcgctgccattaccgtcaacagttactcggatgattactgtaactgtattcagtggtactggagatgttcttccaatgccttacactgtgactgtacaaaaaaatggaaactgccgagatcttactaaagcccttgctgatgtttgctgcttaaaagattctgagacattgttgcttgcagaggtatatgagcgtcggatctaccgttacctaacaaatccaattgagggacttcatagtataaaagatgaagatatacttgttgcatataggctccctgttggttatgaaaaacttttgaggttggagatcctgcatcggagggcagacagatttcttgtggagcctcagtttaatatcaacaggaagctcattgggtgccccattgtgacttgtattccaaatggttctactggaaaatctgatatttatgcggctgtatctgctgttttggttccatttgtacgagcaaaagcacatagccctgatgtgtctgctgtcaagttaaatggcaatgggccaagcctggatggtattgtactgacggataatggcaccaccagtgaggagggtctctctatatcaagatcaagtgaggatgataatgcagctgtcgatgagcttttaccgttccagctttcattgactgatgaaaaaggaagtataagaaatgctatagacacggattctaatcgtggtttaggactagttattagggttttgatggattggtctgagaaagagcatgggatgtacaatattgattacatggatggacttcctgaagtcttcaagcctggttttatgtcaaagaagacccggcaagaagcagtcaatttattttcatgcttggatgcttttctgaaggaggaacccctagggcctgacgacatgtggtactgtcctgggtgcaaggaacacaggcaagctagcaagaaactggacttgtggaggttacctgagatattagtagttcatttgaaaaggttctcatacagccggtatatgaagaacaagcttgatacatttgtgaattttccaatccatgacctcaatatgagcaagtatgtgaagctgacatcaagaggtgaccagcaccccatgtatgaactctatgcagtaataaatcattacggtggtcttggtggtggacactattctgcatatgcaaagctagtagaagagaacaactggtatcattttgatgatagtcatgtttcctctgttaatgaggatgagatcaggacgtctgcagcatatgtgcttttctaccgacgagttggaggttcaagtacggtggcaaatggtggtgcagtcgacattgaaatggttgattcgatagagatgtagttaagcctatgagtatatcatgtggaccgagatatggagctcagaa

SEQ ID NO: 431 - DNA, 864 bp, Sorghum bicolor
gcactcgtcttcttcctagcagagaaaaagcagaagacatacaaagatgtccaagatggcggagcagaaggcggcggccgtagacggactcggaggagccggggcggcggacgctgcgccggcgggggaggccgcggcggcgcgtgtgcggcccgttgagacgctcctgcgcgcggcgccgctggggctgtgcgtggccgccatgaccgtcatgctccgtgaccagcagagcaacgagtacggcaccgtcgcctactccgaccttgggggctttaagtacctcgtctacgccaacggcctctgcgccgcctactcgctggtgtccgcgttctacacggccgtgccgaggcccgccaccgtatcgcgctcctgggtcgtcttcctcctcgaccaggtgttcacgtacctgatcctggcggccggtgccgcggcggcggagctgctgtacctcgcctacaacggcgacaaggaggtgacgtggagcgaggcgtgcggcgttttcggcagcttctgccgtcaggcgcgcacatccgtagccatcaccttcggcaccgtgctctgtttcatcctcctctccctcatctcctcgtaccgcctcttcagcgcctacgaggcgcccccgtcgtcggcgctcggcagcaagggcgtcgagattgccgcatacccacgctgaagccgcgcgccggccttccatcgggggctctggagggagacgtggttgcagatctctattatatgtgtaggcgatcaagtaataagggcttatatttatatatataatacttcgttcatatagtagttgtttgctgctacatatgattagtacagtgctgctgctgctgctgctgctaaattgtgcttgac

SEQ ID NO: 432 - DNA, 697 bp, Sorghum bicolor
atcctcgagttggtccaagtccaacccaaccaccgtcgtctcgtctgtcctcgtcgcgtaattcagggagctggcggcgtctactgcttctaagctggagagagctgcaccagtgcgcggcgccaccgccggagagggcgacgagataggcatcgatccggggaacgagactccggagcagcgcaacaagttcctcgtcctccgcctctacgaggcgctcaacgcccgggaccacgccgccgtgcagtcgctcctcgcccccgacctcgagtggtggttccatggcccgcccaagcaccagcacatgatgcgcctcctcaccggcggcggcggcagctctggaggcttccgcttcgtcccgcgctccgtcgacgcgctcgtcgcccccacccccaccacctccaccaccgtcatcgccgagggccacgaggggcggtgctactgggtgcacgcctggaccgtgggcgccgatggggtgatcacccagctccgcgagtacttcaacaccgacctcaccgtcacacgcctcgccgccgtcgccgtcgccgcctccgccaagtgcgtgtggcagagccgccgccccgacagcgccaccaactcgctgccgggcctcctcctcgccctctgatctccaatccatatcagatcagatcagatcagatccatcacccaaagtcgtcgtcgtcgtcgtatatga

SEQ ID NO: 433 - DNA, 1208 bp, Sorghum bicolor
caggaatgaacggggaggtggaatgtagcgtgtgccatgcgaaggtgcaggtgccgccggcggtgtcgaaggcgtacgatagccaccggagcaccgtgtcgtcgcggcagcgcgcgctaaacgtgctcctcgtctccggcgattgcgtcctcgccggcctccagcctatattagtgtacatgtcaaaagtggatgggaaattcaaatttagcccaatcagtgtgaatttcttgacagagattacaaaaattatctttgccattgtcatgctattcatccaggctagacgtctaaacgtgggagacaagccactcctcacagtatcaatatttatgcaggctgctcgcaataatgttcttcttgcagtacctgcttttctatatgctatcaacaactatttgaagttcataatgcagttatattttaatcctgctagcgtgaaaatgctgagtaatctcaaggttctagtaattgctgtgcttctaaagatgataatgaggaggcgattttccataatccagtgggaggcccttgcacttctgttaattggaatatctgttaatcagctcaaatcgttgccagaaggttctagtgcactaggtcttcctgttgcagctggagcctacctatatacactattttttgtgacagttcccgcattggcttcagtttacaatgagaaggctcttaaaagccagtttgataccagtatttaccttcagaacttgtttctgtatggttatggtgcaatatttaactttcttgggcttgtgatcactgccatcatccaagggcctagtagctttaacattctggaaggacactcaaaagccacaatgtttcttatctgcaacaatgctgcacagggcatactgtcgtcatttttcttcaagtatgcagatacaattttaaagaagtactcatcaacaattgcaactatcttcaccggagtagcctctgctgtattgtttggccacacactgacgataaattttgttcttggaatttcaatagtaatcatatctatgcatcagtatctttctaatcaaattaaggacgaagtgcctagcagcaaagttgaaatggctgaagcccatgatcacagcagaaaggagcctagttatgtcaatgtgcctgattcagtggcaagtgaggctaaacaccgccatggatctgacgagaggcagccacttcttcctgtatgatga

SEQ ID NO: 434 - DNA, 1447 bp, Sorghum bicolor
tgttcaactccagtgattgattgaattccttcgcgaggccacgaaattggggggatttcttcatttcctcactggcttaaccggcaggaaagcagcttttttcgcgaggttctcggcttgatttcctcgtgcggagggccggccggtgcttgtacctctacctcggagcatgcgtcgcgtccgggtgtcctcccagcaggcccccgtccacaagctcggcgacgcccagatgaagctcacgcccaggttccgcctcgccgccacctccacctccacctcggatccagagcaccagcagcagcagccaccgtcgtcgtgggaggaggagcaggcgccgctgatcccgggcctgcccgacgacgcggcgctcaactgcctgctccgcctgcccgtctccgcccacgacgcgtgcaggctggtgtgccgccgctggcgcgtgctcctcgccgacaaggcccggttcttcgcgcagcggaggcagctgggcctccggacgccctggctcttcacgctcgcgttccaccgctgcacgggcaagatccagtggaaggtgctggacctgggccacctcacgtggcacgccatcccggccatgccgtgccgcgaccgggcatgcccgcgcgggttcggttgcgtcgctacccccggcggcgacggcgccgacggcgcgctcctcgtctgcggcggcctcgtctccgacatggactgcccgctgcacctcgtgctcaagtatgacatctataagaacaggtggaccgtcatgacacggatgctcactgctcggtctttctttgctggtggcgtgattgatggccgggtttatgttgctggtgggtatagcgcggatcagttcgagctcaattcagccgaggttcttgatcctgagaagggtgtttggcagcccattgctagtatggggatgaacatggcgtcgtctgactctgcggtgatcggcggcaggctctatgtcactgaaggatgcgcttggccgttcttctcatcgccgagaggccaagtgtatgaccccaagatcgaccggtgggaggtgatgccggttggaatgcgtgaagggtggacggggctaagtgtcgtcattgagggacgcctgtttgtcatttcagagtatgagaggatgaaggttaaagtgtatgatgcagaggcggattcatgggactcagtcagcggccctccgatgcctgaaaggattatgaagcccttctcggtcagttgtctcgacagcaagatcgtcgtcgtcggacgaggtctccatgtcgcgattggccatgttcagaaggaacctgctggtgatcctgatagcaggagttcaggctactccatttgctggcaagatgtggatgctcctaaggaattcagcgacctgacaccttcaagcagccagattctgcatgcttagctgctcgttgagtgagcgagaaccattggtaat

SEQ ID NO: 435 - DNA, 1671 bp, Sorghum bicolor
agaatataaccgccgccttgcgacaccgcctacccctctccctctccctgccccgagacccccaccacccccgtgcagcgccgcgcggccttcgacgccgcgcccgtgacccaaccagccgcctctccctctccctctctccacccgggtctccacgccgccgccgccgcgcatccgctcctccctgcccctctcggcggccggcagggcgggtgaggtcgcactcacgagatggaaagcaataatccatcacattctcagattgctgaagtgaagatggacatctcagcatcagcttctggagcagcagggtacaaattctgcaaaggtgctgcctgtgatttctctgattccagcaactcctcgaaagatgccaaggagagatccgcgtccatgaggaagcttataattgcagtgatcctttgcatcatattcatgacggtggaagtggttgggggcatcaaagcaaacagtcttgccatcttaactgatgcagcacatcttctttctgatgtggcagcatttgccatatcattattctctctctgggctgctggatgggaagcaacaccgcagcagtcttatgggttctttcgaattgagatccttggtgccttggtctccattcagctcatatggctacttgctggcatcctcgtatatgaggctattgtaaggctcattaatgagagtggcgaagtgcagggctccctgatgtttgctgtgtcggcgtttggattgttagtcaacattgtaatggctgtattgctaggccatgaccatgggcatggccatggacacagccatggacattcacatgaccatggtcatggtgattcagatgatgaccattcccaccatgaagaacaagaacagggccatgttcatcaccacgagcacggacatggaagttctattactgttacaacacatcaccaccaccaccaccactcaggcactggacaacatcatgatgttgaggagccactgattaagcatgaggctgactgtgagggtacccaatctgctgccaaagctgctaagaagcctcgacgtaatataaatgtacacagtgcttatcttcatgtgcttggggactccatccaaagcatcggagtgatgatcggtggggctatcatctggtacaagcctgagtggaagatcattgatctcatctgcaccctcatcttctcggtgattgtgctgttcaccacaatcaggatgttgcgcaacatccttgaagtcctgatggagagcacaccccgcgagatcgacgccaccaggctgcagagggggctctgcgagatggaaggggtggttgccgtccatgagctgcatatctgggccatcacagtggggaaggtgctcctggcttgccatgtgacaatcgcccgggaagcagatgctgatcagatcctcgacaaagtaattgggtacatcaagacggagtacaacatcagccatgtgaccattcaggtcgagcgtgaataggggattgtcttttggctgtcaggaggcataaatggcgtcacgtcttcactggttatcttatttgtgtcggttaaaactagttttttgcacctgggaagttcatcagggattcgagctttgatgctgggtagtgtcatctattactagtctattagtcggaggaattatttgggtggtggt

SEQ ID NO: 436 - DNA, 2560 bp, Sorghum bicolor
catccatccaccaggaaagaaaaaaaagcttcccaaccaattaaaaccccgctcgccgcaactcgccgccgtctcctcgccttccgcctccgcgcaccgactccaacgcctctcctcgtcggctgcccacctccgcccggcggccggagcagagaggcttaggttaccggcggcccccggcgcccccacttcgcggtcgagctggaggacacgcgtagcaacgccgggttcttctgcggcgagctgtggtgtggcctcatggagcccaagggcgagttggcccagaagcctatcgaagaagcaatcgacggcttgaagattgatgctagcaccaaggcaagcaatgtcaacttgcctgctaagaaagatgcaagttcttctgatgcagtatcttgcatttcctccggagatgcagctagtactgtgaaggaaactgaaatgaaccaagaaacttattttggggaccaagggatgtattactatggatattattatcctggttcatatggaggactggatgagaatggcaactttgttggatataatggcctagaggtgcacccagcagtggttcaagctgacaatgggtcatatctgtgtcatcttccggggtatgaaaatggatatgcttcttatagtccggttgttcctggaggcattgctagtgtggatggtcaatatgtcagcaaagaacaatattactccactgcaattccattacaggatctaagcacacctggcatttttgctcaaccaattgcttacggaactgaactagtacctgcatactcatgggacccttcttttgttcttctggatggagttcagggacatccagttggtgtgcatcaaacaaattatgctgcaagaccaaaatattcttctaataagcatgctattccttcttcgaaagctgcccgcagtgcaaaacccgcagcagatactgtcaaaggatcatcatcaggtctagaaactgtagcaaatgctgctaatagcagcccatcatcgaagggtgcaaataaggcatctggtgcttccataacaaaaggatatcttccatctagcaagtttgtgatgcatagtaataaccaaggaaaaatcagtgtttatcaaagcaaaggtatcaatgtgaaagaaagtggtagaagctggaacaacggtgagaagcttaagatgagaagtaagttaaatggacatggtgattctgaatctaatgagaacaaccacactgataactcaaaacacagtttgagccctcaatctgatgttggattgccaagttcagggggtgctaacgctagcataccttcacatgttgcaataagcaaaaatgcatataatctttcagattttgttacaaagtatgaacaagctctattctttgtaattaagtcttatagtgaagatgatattcacaagagtatcaagtacaatgtctgggcaagtactcctaatggaaataaaaggcttgacagtgcctatagacttgcacaagaaaggatggcagaaaaaggaaccaaatgtcctgttttccttttcttttcagttaatgctagtggtcagttttgtggtgtggctgagatggttggcccagtagatttcaaccggaacatgaacttctggcaacaggacaagtggaacggtttcttctcggtaaaatggcacattatcaaggatgttcccaatccacaatttcgccatataattttggagaataatgagaataaacctgtgacaaacagcagggacacgcaagaggtcaaattttcacaaggtacagagatgttgaacattttcaagaactttgcatgtaaaacatcaatactggatgactttgacttctacgaaaatcggcagaaagtaatgcaggacagaagaggcaagccgcttactacattgtttgatcacccattgccaaaagctgaaaaaactgcagaaatcaaaaggcaaacacatgccacagaattcggtagagccaagagtaatgaggggcagggcaacaatgttggggtggtgcatgatacaaccaagaaaaatgaggagcagagcaacaacgtttcagaagtagttgatgcagcctgtagcaacaaggagcaacccaacaaagttgcaacacaatgttgatgccatgagctagttgaactggggaatgagatagcctctggaatggacttcaacctgaatgataaatttgatgtgtacaatgtcaagaaaccatcatttgtcatcggttctcttccattttctcatgcaagcagaaaaggaaaaagaaagtgaagctatgggactgtcttcccacgagaaatgttcaatgactgggaaaaaggttctaagacacatttatgttgaggcccctggtgctaaggcattagagacccctccttgtctatttttttttttttatctcggagggtattttcttttcttgtgttgtgtcttttttttttcttctcttgttcttcctattacactgctgagattttgcgaagcagtatgcgctgtggtccaaagaagccagtttgctttatggctgggtgtgcttaacggagtgtttgttgct

SEQ ID NO: 437 - DNA, 1291 bp, Sorghum bicolor
gactcatctcgacgcggtagcgccacgccggcgtcgccgcgatgctcctcctcccggggcgtccagtcctcccctctccggcgctgccatactgcccctcgccgtctccatcccgtttccgtcccctcccctgcaccagcaacgcccccacctctgcttccaccgccgcgtccgccgacgccaccgcctcctcgtccttctccgtcgaagaatacctcgtgaacaggtgcaacctctaccccaacgtggccgcgcgcgtggctccggagctctccgccatcaggtctccctcgaagcccgacgccgtgcttgccttcctcgccgacgcgctcgagctctccccgccgctcattgccgtcgcagtggcccgcgacccgacgatactcacctgcagcgtgccaaggacgctcgcgccgcgcgcggacgagctccgcgcgctcgggttcaccacgtaccagatgggccttatcgtcgtgcgctgcggcgcggccgcgttccgctcacgcgcgctcgtctccagtgtccagttctggctcccgtacctgcgtggtcgcgtcgacaagctcgtcgccgcgctcaagggcaacccgggcctcctcaccgccgatctccggacggtcaagtctaccatcgcgctgctccaagaggaaggcaccctcaccgatggcgacgtcggctggttcgccctctcctactgctccaagctgcttgtcgcgagcccggacgaggtcgacaccgtcctggcccgcgccgacgagttcggcgtgccgcgtaagacgcgggcgttcaaggacgccatcatcgcggcgttcagcgccactccggagcggctcgcctggaaggccgcgttcttcagggacgagctcgggtggacggaggcgcaggtgaagacggcggctgcgaagatgccgacgctgatgacggtctccgcggagcggatccggaggaactgggagttcctgaccacggaggtcgggatggacgcggagcgcgtcgccagcttcccggcgctgctgaggtacgacctggaggggcggctcgtgccgcggttccaggtgatgagggtgctgcaggcgcggcggctgtggcgcggcagggacttcaacaacattgctgccatcacggaggaggatttcgtggccaagttcatcaggccgtttctggtccaagtcccagacctggccaagatctacgaggccgccgtcgtggagaaggaagaacagtagcggatagtgtataattagggatgaaaacggtacggatattttccgaccgtattagatctgtccgt

SEQ ID NO: 438 - DNA, 1382 bp, Sorghum bicolor
tcgccatgggaaccaagaatcttacacggaaccgccccgcttccatggcgacggcgtccaccacgctgctcctctccctcgccctcctcgccttcgcctgggcggcatcgccgtcgccggatgcggaggcgatctcccggttccaggagtacctccgcatcgacacggcgcagccggcgcccgactacgccgcggccgtggccttcctccggaaccaggcctccgaggccgggctcgaggcgcgcacgctcgagctcgtcgccgggaagcccctgcttctgctgcggtggcccgggcggcggccgtcgctcccctccgtactcctcaactcccacactgacgtcgtgccgtcggagccgagcaagtgggaccacccgcccttttccgccgccctcgatgaggcgtccggtcgcatctatgcgcgaggctcccaggacatgaagtgcgtggggatgcagtaccttgaagccatccgccgactccgttcttcaggatttattccagatcgaactattcatgtaatatttgttcctgatgaggagattggtgggcatgatggtgttgagctgtttgtttcatctaaggagttcaaagatatgaatgtggggttagtgcttgacgaagggcttccatctcctggggaggagtatcgggtgttctatgcagagcgtagcccctggtggcttaccataaaagcaaagggtgcaccagggcatggtgcaaagttgtatgatggcagtgcaatggagaatttaatgaaaagcgtggaggctatcaggagattcagaacatcgcagtttgatttagtgaagtctgggcagaaggctgaaggggatgttgtgtcagtgaattttgcatacctgaaggctggcacaccgacaccaacgggttttgtcatgaatctccaaccatctgaagcacaggtaggtcttgacatccggatgcctcctgatgttcatactgaagcactggagaggcgccttattgaagaatgggcaccttcctcacgcaacatgaccttcgagtttaaacagaggggttctgtcctggacaactttgggaagccagccttcacacctgctgacagctcgaacccatggtggccagtgcttggagaagctgttaagaaagctggcggtaaactcggtaaaccggaggtatttcctgcctctacagatgctcgctacttccggaagattggtttaccagcattcggtttctctcctatggcaaacacaccagtattgctccacgatcacaacgagttcctaagcaaagacgagtatatcaaaggaattggggtatacgagtcgatcatcagggagctggccactcacaacgatgaagccagagacgaagaatcgagggcagagctatgatga

SEQ ID NO: 439 - DNA, 1042 bp, Sorghum bicolor
aaatcactcgtccaagaacaccacaccaccagtccaccaccacaagtagagatttcgtcttggagagccaccaccaatggcttgttccactgcatctttagcggcgacgctgctggcgttggcgctgatgttccaggcctccctcgcggggaggaggctcaccgcgctcgtgcaggagccggccatcaccatgaagtaccacaagggcgcgctcctgacgggccccatcgccgtcaacttcatctggtacggcgacttctcggcgccgcagcgcgcggtgatcaccgacttcgtctcgtctctgtccgcgccgccggcggcggtgcggccggagccgtccgtggccacgtggttcaagacggcgcgcaagtactacgccagctccaaggtgcggttcccggcgcttcgcctcggctcccacgtcgtcgaccagaactgctccctcggcaagcgcctcacggagagggacctcctcaggctcgccgccaagggtggcccgagccgcgccatcaacctggtcctcacggccgccgacgtggccgtggacgggttctgcatgtcccggtgcggcacgcacggcgcgtccccgcggtcccgctccggccggttcgcgtacgtgtgggtgggcaacccggcgtcgcagtgccccgggcagtgcgcgtggccgtttcaccagcccgtgtacggcccgcaggcggcgccgctcaccccgcccaacggcgacgtcggggtcgacggcatggtcatctcgctggcgtccatgatcgtcggcacggtcaccaacccgttcggcaacgggttctaccaggagggctcggctgacgcgccgctggaggccgcaacggcgtgcgccggcgtgtacggcaagggcgcgtaccccggctacgcgggctcgctgctggtggaccaggctagcggggccagcttcaatgccaacggggcccatgggaggaagtacctggtcccggcgctcgtggacccggacacgtcgtcgtgcgccacattggggtagatttcgctggtcgtaattaacggttgttag

SEQ ID NO: 440 - DNA, 1308 bp, Sorghum bicolor
gatacagcagaaacggccacacgaaactgatcaagctaggcattagcattatcggcaatgggcgagttgatccctgggttgccggaggaggtggcgagggagtgcctcgtccgagtgggcttcgaccagctgccggtggtccgccgcatctcgcgccagtggaaggccgaggtggagtcgcctgactaccaccgccagcgccgggcggaggggctggcgcgcccggtgctcgcgctggtccaggcgcagccaacagcgccaccggctgacgacgctggtccggtggcggacaagcactcgacggcagcagcaggctcgggaggaggcccagcgaactcgtaccggatggtgttgctggacccggtggaaggacggtgggcgccgctgccgcccctgccagggccaagcgagagcctgcccctcttctgccaggtggccgccgtggacggcgggcaggggaggaggaagcggctggtggtggtcggcggctggcacccggagacgtgggcgccgacagacgcggtgttcgtgtacgacttcctgacgggcgcgtggcggcgcggcgcgcccatgccgggcccacgccggtccttcttcgcgtgcgcggccgtcggcggcgccgtgtacgtggccggcggccacgacgacgagaagaacgcgctccggtcggcgctggcctacgacccggaggccgacgcgtgggcgcagctcccggacatggcggaggagcgcgacgagccccgcgggctctgcgtcgccggaaggttcttcctcgtcgtcggcgggtacccgacgcaggcgcagggccggttcgttggctccgcggagtgcttcgacccggcgacgtccacctgggcgcccgtcgacgacctagtcgaggacggcgtgtgcccgaggacctgctgcgccgcgccgccagggtctggctctgagcgcctgtacatgctaagtcgcgatgggcacctcgtggcgcgcgacggcggcgcggcgtggcgaccggtggcgcaggtgcccgaggacgcgcgcaccgcggcgaccgtctccgtcatcccggacggccgcgtcgtggtgattgggtccgggtgccacggcggggaccagaccgtgtacgtgctccgcgaggaggccgggaaaggcgcgtcctggacgcgcgccgccgcaccgccggagttttccgggcacgtgcaggcctcctgcttccttgaaatctgaggtggaatgtacatgtacgtacatagtagacactacgtacttctgccactactactcatggctgtacatagcaaatcaagcagaggagcagtatag

SEQ ID NO: 441 - DNA, 770 bp, Sorghum bicolor
tgccgtccagagagctagagcgctagagctagagcacagctatccccgccatggcggccgcggcgcgcgcgatcatctgcgagctggcgccgcagaaggtgtcgtcgtcgacggcgtcggggcccgtggcgccgaagaagcgcgacgccgggacgaaagtggtgctccagccccggctctgcacgctgcggtcgtacggcgccggcagcggcgtggtgacgcggaggattctggccggggaggaagacggaagcggagccgccgactcgggcggctccgcggcgtcaccgttcttcgcctcgctcgccgactacatcgagagctcccgcaagagccaggacttcgagaccatctccggccgcctcgccatgctggcgttcgcggcggcggtggccgtggagacgacgacgggcagctcgctgttcaagaagctggacacgatggagatcgaggaggcggcgggggtgtgcgtggcggtggtcgcctgcgccgcggcgttcgcgtgggcctccagcgcgcgcaacaggatcggtcagatgttcacgctgggctgcaacgccttcgtcgactccctcatcgacaacatcgtcgaggcgctcttctccgagggcgagctgcaggactggtccgacgacatataaacaagcacatatgcacacatatagagattagcagatagccagatactgtaatagacagtacgtatatacatatagtcaagtatttatagtaattaagtaggtgaagctgttaagtgagatccacgcatt

SEQ ID NO: 442 - DNA, 1121 bp, Sorghum bicolor
gacagatggcgccgcagtctcggttgctgccgccggcgttgcagatgcttcgccgctgccggtgccgtgcctcgcgctcccacttctctaccgcgcccactctcgtctcgccaccatccaaggccgtggtctacgacgagcacggcccacctgagcaggtgctgaggacggtggacgtgccaccggtggaggtcggcgaccgcgacgtctgcgtcaggatgctggctgcccccatcaacccctcggacatcaaccgcgtcgagggcgtctaccccgtcaggcccccgctccccgccgccatcggaggctacgagggcgtcggccaggtccacgccgtcggccccgccgtcaccgccccgctctcccccggcgactgggtcataccgtccccgccatcgttcgggacctggcagacgtacattgtcaaggatgagaacgtctggcacaaggtccgcagcgatgtacccatggagtatgctgccaccatcaccgtcaacccctcgaccgcgtttaggatgctccaagactttgtaaaactcaatcctggtgattccattgtccagaatggtgctaccagcatcgttggccagtgtgttattcagcttgctaaagtacatggaatccacactatcaacattataagggacaggcctgggtcagaggaagcaaaaaacaaactcaaacaacttggtgcagatgaggtgttcacagaatctcagctagacatgaagaatgtcaagagcttgctgggtgccatgccggagcctgcattaggatttaactgtgttggaggaaatgctgcttctctaatactcaagcttttgaagcaaggaggcaccatggtgacttatggtggaatgtccaagagacctgtcactgtccctacttcatatttcatttttaaggatctttcgctacgagggttctggctccagaagtggctgaactcagataaaacagaagactgcagaagaatgatagactacctcttgggccttgtgcatgaaggcaaactcaaatacgagatggagtcgatttctttcggtgagttcagcttggctctggagaaggccctgggcaaacatggaagccatccaaagcaagttatcaggttctgatga

SEQ ID NO: 443 - DNA, 2972 bp, Sorghum bicolor
ctcttctcagcttgccatcctcccggcacccggccacaaataagagcaagatgccggcccctgtcgctgcctacccggccaagatggcatgctgtctccagctccaccttcttcgccgctcggcccctgctccactccctgctcgggtcctcctcctgctctccaccccgcgcctgcgcctgcgccccgtccgagcgtctcccggtcccggctcgtccccgcccaactccttcgctggctggtcctccgatagtgccgatgacggcgccgacaaatctactctagggttcggcccagcaggaggacttctaggacctggacttgctgcctttttcttcctcgccggccttacctttgctgccgtctccatcagaagcagtggcaaccacgcagctgcaaaaatgcaaaacttgcctgcagagactgctgccacggaatcttactctgattatcactcccacaaagaggatgatgctatcagtgtcagggaagaagatgcccaagcttccttaccaacggattgggaggaaaacaatgacagccttgatgaaacaaaaagtacagatgaattcctggcgcctcttctacagtcaaacgaggaggttcctggggtgcaagctgaacatgaagtggggcacccgttgcagaacactgaacctgttactaacggtaatcatcttgtcggtgaagaagtgcagcagtttgacaatctcattgcatccgatggtaatcaaaatccagcatcacctcctctgcccatctcatcagaatatgctcaggtttcttttgcaccatctagcacacttgatgctgcagacccctcggagggaattcctaacgtagaagaaacatcagatctcaaaatggctttgccagaaaacgagcatttggatgaaactttaacttcagatgcaatggtgctagattcagatggtgttgtgctcatccaagatatcgctgacagtgccgttgctgctgcatttcacccagaagacaaaggtgtcgagcagaacccacaaactcatgacaaagatgaattttctccatccggattgcctgattatatggaacatgtaagtgccgaagagatgcatccacttggatcaaatgagttatctatggctacagggactagtgagccaggagatggggaggaaactatagtagaagatctgtatgaaagagaaagtgaattagaaaaccaaaacaaaccattcaagtccacaccacctgaccaatatttttcttctcctggaattcctgccccatctatagtatccactgcttcacaggtgcccgtggggcagattgtggttccagcttctgttgacccaacccaggaaaatgctatagctgcactgcagattctaaaggtgatcgaacccagtgctcgagctggtgacttgtgtacccggcgcgagtatgctcgatggttggtagtcgcgagcaattgcctttcaaggaacactttctcgaaagtgtatccagcaatgtatattgataatgtcactgaacttgcatttgatgatgttacacctgaagatcctgatttccccttcatacaaggcctagcagaagctggattgatttctagcaagctttcaagatctgatatgaatatcccagaagatgttcatgacaatcatatcttgttttcccccgagagtcctttgtcacgtcaagaccttgtgagttggaaaatggttctggataggaggcaactgcctgaagttgacagaaattgtttgttcaaagtatctggctatatagacatcgataagataaacacagctgcctggccagctttggtcgctgacttaggtgctggagaccagagcattacagctctttccttcggtttcacaagacttttccaaccgaacaaacctgtgacgaagggacaagctgccctagcaatttcaactggtgattctggtgaagtggttctggaggaggttgctcgtattgaggcagagaaaatagctgaagcagctgtaaatgcacatggtgccttggttgctcaggttgagaaagatcttaatgcaaggtttgaaagggagcttaaggaggaaagagaaaaggtagagacccttgaaaaactagctgaagaagctaggatggagctggataggttgagggaagaaagagaggaagagaagaacattctgctcaggggcagagctgctgttgaatctgaaatggaagttctgttgaagttgaggagtgaagtagaggaacagctgcagaatgtactgagcaagaaggtggaggtctcctttgagaagagtaggattgaaaaactccaaaaggaaattgagaatgataacttggctgttgtgcaacttcaatatgagcttgaagtggagaggaaggcgctatctttggcaagggcttgggcagaggaggaagccaaaaaggcccgggagcatgcacgagcccttgaggatgcccggaaccaatgggagcgtcaaggaatcaaagttgttgttgaaggaggactccaggatgacgcttcagcaggagtcacatgggctaacgctggcaaagaacatccagttgatgaggttatcaaccgggcagaatctttgctggagaagctaaagtcaatgtcagctgagatgaaagtgcggtctcgtggtgcgctggagagggtgatgcaacacgtgaggtccttcattgcaagcctaaagcagcaagctgcagatgcaaggcagtggtgttccgagtttggggcttctgctgcttccaaggcactcatggtatcagcagaagtgcagggcagtgtatctgcgtttggtgcaacccttggagataagtcgaagagggtaatggaagagtgcaaggacggcctggaaaagttttcacacagattcaagacatcagactagagggaggctgtgtcgcctctgtaccaagaacaatagtaaattcccttggaataaatttttggggtggtgggtgttacagagttt

SEQ ID NO: 444 - DNA, 1714 bp, Sorghum bicolor
aacgaaacgaggtactgggagctggagcgaggacgaggagacgagggaaaggatgcagcagctgcaaccgaagcagatgcactgggtgagggccgactcctccgacttcgggttcgggggcgaccgccccgccccccgcagcgggcacactgcggtgagcattggcaagtccaaggtggtcgtcttcggcggattcgccgacaagcgcttcctcgctgacgtatccgtctatgacgtcgagaataagctgtggtacactcctgagtgcactggtaatgggtcggatgggcaggccggcccaagcccaagggcatttcacatagctgttgtcattgactgcaacatgttcatctttggtggccgttctgggggcaagcgtttaggtgatttctggatgctagacactgacttatggcaatggtcggagatgactggctttggtgatttgccgtcaccacgagagtttgctgctgcttcagccataggaaacagaaagattgttatgtatggtggatgggatggcaaaaagtggctttcagatgtatacgtcatggacacaatgtcactagagtggaccgaattagctgttactggatctgtgccacctccaagatgtgggcattccgcaaccatgattgagaagagactgcttatatttggaggcagaggtggagcagggccaataatgggtgatttatgggctttaaagggtattactgaagaagacaatgagacgccaggttggacacagttgaaacttccagggcaatcaccctcaccacgatgcggtcattcagtaacatctggtggaccttatctcttgctgtttggaggacatggaactggcggttggctaagtagatatgacgtgtactacaatgaatgcattattttagacagggtgtctgttcaatggaagcgcctaccaacaagcaatgaacctcctccacctcgggcatatcattccatgacttccatagggtctcgatttcttttatttggtggctttgatggaaagaatacatttggtgatttgtggtggcttgttcctgaagatgatcctattgcgaaacggaacatagttcttaacatcgattcaaacagcaaacctagcactgtgaccggtgataaccagcaatccaacttaaaggagtcacaagctctggagaatccagtaacagaattggccaaacgaatgggaattccactttctgaggaagtttcggcaagttttattgacgaagtcaatgataaagaacttgcggaattgtcatccaggcttgctggtcaatcgcttccagctactgaccaggttgcatcaattcaggtacttcgtgatcattggaaaagttctccagcaagctcactacaactgcaggaactaggacctttgctgagggactatcaacgtctcatcctgcagcgctattcgggaaatccattgccagcttttcatgaaatggaagctctccgttttttccatttgaaaagtgcttcacagttgcgcatggatgacattcccgtcttgttgagcgagtatggaaggctgctttccacatgagatggcatcttgcaagttgtgcccttttgcttggttctaacagaacgtttgcttcatgtaaattgcggaggattttctggcctgccaaaagcacactcgtggagccattccttgccatcagttagtctgttagtgcaagtcattgtcgcatag

SEQ ID NO: 445 - DNA, 340 bp, Sorghum bicolor
cgtggttcagcttcgggtgaaggggatggcgctgtcgtctcgccgcatggccgccgctcccttcctcgtccttgtgctcctcctcgtcgccacagagctggggacgactccggtggcggaggcgaggcactgcctgtcgcagagccaccggttcaaaggcctgtgcatgagcagcaccaactgcgccaacgtgtgccagaccgagaacttccccggcggcgagtgcaaggccgagggcgccacgcgcaagtgcttctgcaagaagatctgctagctagtgctagccttggcggacaggggcaggtccggtcgtcggcatgcaattcaaagctagccgacg

SEQ ID NO: 446 - DNA, 2091 bp, Sorghum bicolor
ttccaaggtggttctgcatacgcagtatcttttgcagtaatcttgatctgcgagcggccagaactggatgatggctacttattactcgagccagggcagtgaaagggactcacagaacatgtattctagagaacccagcaatgcatcctatcctatgtcgtcggctctagggaacttgctttatctgaacaatcctgcttctggaccatacacagagttcagtggcattctacagtcccagcagaattgcatggagatgcctgaacctggccatccttcagtgatgtcccaagactcatctgcaagggagtccgacatgcttggttcccaccagggtcagcgctctttcggcctagtcaaagatatgaagaacgagatgttgatgcatatgatggatgggtcacagagcagtacagctgatctcatccatgatgatgcccaaaatggtatccagcttgattttggtgttctgaacaaccacggctcgtcgaacattccctcagtgcaaggccaaggtttatctctcagcctcaacacacaaatcctggcaccttccttgccatactggtctgtcaaatcagatatgttgtcgccacactcttaccatgacagtcttcgagtcgatgacatccgaatgaagagtatgcagtctgagtcctcacgagcaatccggaactcaaggtatctgaaagcagcacaagagctgcttgatgaagttgtgaacgtttggaagaacattaagcagaaagcccagaaagaacaggtagaagcaggaaagacggatggcaaagagaccgagggagggccgaaaagtgagggtgtgtcctctaatccgcaggaatctggtgccaatgcagcaccggagctttctactgctgagaagcaagagcttcagaacaagatggcaaagctgatggcaatgttggatgaggtggaccggaaatacaagcactactaccatcaaatgcagagtgttgtttcgtcttttgatatggtagctgggcctggagctgccaagccttacactgcagttgctctccagacaatctcacgacacttccggtgcctgaaggatgctatcaatgatcagatcaatgtcatcaggaagaagctcggggaggaggaaagttcatctggcaaggagggcaaactaactcgtctccggtacatcgatcaacagctcaggcaacaacgagctttccaacagtatggcatgatcccacaaaatgcttggaggccacagagagggcttcctgaaaactctgttaccattcttcgtgcttggctctttgagcatttccttcacccgtaccctaaagattctgaaaaattgatgctagcaaggcaaacaggcttgacaaggagccagatttcaaactggttcatcaacgcccgtgtccgtctctggaaaccgatgatcgaggacatgtacaaagaagagattggagatatcgagcaagactccaactcttcctccgacaacacgccaagaagcaagggcaagatggtatcttctgaagacaaggaagacccgaggagttgtacgcctcgggtctgcgagagcagtcagctgagcgagtcaagaggcagcatgaggaccatgaacgccgtcggcggtggagcagccatgggattccagaacgagcccaaccctgacgacaccttcatgaacctgatgctgaaggaccaacgatcaaacggagaagaagatggcggcctcctcctccacaatgccgtggcgcagcatcaagatgagaacgcccggttcatggcgtaccacctggcggaacttgggaggtacgggaacggcaatgtgtcgctcaccctggggctgcagcactccagcagcagcagcctctcggttcccaacgcccagcagagctttcctggtgtcggtgtcggcgtcggagacgatgacatctacaacgccgctgctcccctcggtgtcagcgtggcgtcgtcggactacgagacgatgaaccagatggatcaacggcaacggttcgagcagtcaccccttctgcatgattttgtggcctgaagaatgctcatttgctcatacatcagatgatttgtatttagcacctgccg

SEQ ID NO: 447 - DNA, 1155 bp, Sorghum bicolor
tagtagcagctaggggttgtcggcaggcatccttatgaggcgcttcctgccggccggaggcggcggcggcggcggcggggagccgtcgtcttcctcctcctcgggcgggcaacaccagcacggcggcgggctcgcgggcgagagggcggcggcgggcctgcggtaccgaggaggcgacatctcgctggggcacgggcacgacgacggacatcgtcgtcatcagtaccacctcggcgccggcgacgcggcggataggcagaacgacgggtccatggacatgctggcgcggcacagcagctcgccggtcggcttcttctccaacctcgtcatggacaacgggtacccacgctcaaataaagccggagtcagtggtggcggcgaaggtcagcgtgatccttcaacggccaacaacaatagtggaagtagcagcagcggccggaagatgaagccgtcgtcgtccgggttcaacttcgccggcgggacgcagcagcagggccagcagcagggcgccgccgggggccacctctcgcggatctccgaggacggctgcgccagcttcccggccggcggcctggtgggcgaccgcgctgcaggtggccgcggctctggcgagagcagcagcggtggtgctgccgcggcggcgcgctcgtactccggcgggttctccattgttgggccgtgggaagagtccagggacatcattaccaccctcggcgcatacgaccctcagtttagcggcgccatggcgggtacggcgctggagatggcgggcatggacaggtacatgcagctgcagcaggaccaggtgccgttcaaagtgcgcgccaagcgcgggtgcgccacgcaccccaggagcatcgccgagagggagaggaggacgaggatcagcgagaagctcaggaagctccaggacctcgtgcccaacatggacaagcaaacgagcaccgcggacatgttggaccttgcagttgagcacatcaagggcctgcagagcgaactgcaggctctgaaacacgagcaggagaagtgcacctgctgccgaaagcgatagcgattcacaacagggagggcatagaacacagaaacgcgtccatctttaacggttactgctaccttcaatttccttgatgtgaggaattgtacatggatgaagcc

SEQ ID NO: 448 - DNA, 1665 bp, Sorghum bicolor
gccatggagatggtcctggactggcgctcgctgggctccctgctagcgaccgtcgtggtgttccgcacggcgctgcgcgacttcctgccgccggaggccgaggcgctgctgcgtcgcttcatcgcgtgggtcgccgccgcgttccgcccgccccgcgacaccatcctcatcgacgaggcggacgggccaacggggggcgccaacgacctctacgactcggcgcagctctacctgggcgcgcgctgcctcgccaccgcgccgacggtccgcctccacaagccgcgccagtcgccgcgccccgtcgcgtcgctcccggactcgcacaccacccacgacaccttccgcggggtccaagtcaagtggacctccaccgcgcgcgccgtcgaccgcggctccggcggcggaggcgggggtgggtacggtaacccgtacaacatgttcggccgcggcggccatggcggcgaccagcgcggcctcgagctccagttcccgcgccagcaccgggacctcatccaccaccactacatcccgcacctcatcgacgaggccacccggatgcggctcaagtcgcgggagcgacggctctacaccaaccgcgccacggggcccggcgacgaccaccaccgcctctggacgtcgcacgccttctcgcacccgtccacgttcgacacgctcgcgctcgacccgacgctccgcgaggagatccgcgccgacctgctgcgcttcgccgcgcgacgggaccactacgcgcgcgtcggccgagcatggaagcgcgggtacctgctccacggcccgccgggcacgggcaagaccagcctcgtcgccgccatcgccaacctgctcgagttcgacgtctatgacctggagctcaccacggtgcccaccaactcacacctccgccgcctgctcgtctccaccacgcccaagtccgtcgtcgtcgtcgaggacatcgactgctccctcgacctctccgaccgcaacaagaagaaaaagaagggcggtcttggcgccgggggcaacggcggtgccgacaacgacgaagacgccgcggcgcagctcgccgtcatgtcgatgtcgccggccgccgccgcggccatggccgtaatggggcgggaatccataagcctctccggggtgctcaacttcgtggacggcctctggtcgtcctgcgtcggcgagcgcctgatggtgttcacgaccaaccacccggagcgcctggaccgggcgctgctccgcccgggccgcatggacaaaaagattgagctcggctactgcacgccacccgcgctgcgcgtgctcgccaagaactacctcggcgtcggcgacgagggctgcgaggacgccgatgaggaccccgacaccgtgaacaccctcatggccgaggccgagggcctgctcgcccccgacgaggtacaaatcacgcccgccgacatcgccgaggtgttcatgggctgtgacggcgctggtgccgccgccgggctgaggaagcttgtgggcgagctgcaccggaggcgggatgctgccgcggccacggccgtagtagcaccgggtgaggagacgccggagtgaaagccagccagggatcctacgtggcgcgcaaccatgcatggctgcctagtcagcttccattactttgacgccttgacggtggtttgtttatgatag

SEQ ID NO: 449 - DNA, 1433 bp, Sorghum bicolor
gcgtcatggcggagcgcctcgccgcctccctcctccccgccgcctcgccgtccccgtccgcccgccgcgcgacggtcgcagccgcggccgccgcctctttcccctccccatgctccgcgcgcgcggggctgcgcctacgctcccgccagcccctcctctcgcactcgcagaaggcggccgggcgcgggcgtggcgtgcgggtggtccggtgcatggcggcgtcggacgcggcgcagctcaaggccgcgcaggaggacatcaaggagctccttaagaccacatactgccaccccatcctggtccgtctggggtggcatgattctggtacctatgacaagaatattgaggagtggccacaacgaggtggagctgatggaagcttaaggttcgatgctgagttgagtcatggagccaatgctggtctgattaatgcattgaagcttatccaacctatcaaggacaaatacccaggtatcacttatgcagatttgttccagttagcgagtgctacggcaatagaggaagctggtggcccgaaaattccaatgaaatatgggcgggttgatgtcacagcagctgagcagtgtccacctgaagggaggcttcctgacgctggcccacgtgatccggctgaacaccttagggaggtattctatagaatgggccttgatgacaaggaaattgttgcactatctggagcacatacacttggaagatcaaggcctgaccggagtggctggggaaaaccagaaacaaaatataccaaggatgggcctggtgagcctggagggcaatcatggacagttgagtggttgaagtttgataacagttacttcaaggacatgaagtttttgagccaacttccctcggaagagcagaaggaacaggatcttctagttttgcccacagatgctgcattatttgaggacccatcattcaaggtatacgcggaaaagtacgcagaggaccaggaagcgtttttcaaagactatgctgaagctcatgctaagctgagcgatcttggttcaaagtttgatcctcctgagggattctcactggacgatgacatgagcactgcacctgcagacgaaaagacggaagaagatatctcttttgtagcagtggcaccgtcaccagtggctccagaacctgaaccagcagcagaacctacaccagaaccagtagcagcggcaataacaacagcgacagccgatgacaacaacggcgcagctccacagccggagcccttcgtcgctgccaaatactcgtatggaaagagggagctgtcagagtcgatgaagcaaaagatcagagcagagtacgaggggttcggaggcagcccggacaagcccatgcagtccaactacttcctcaacatcatgatcctgatcgcagggctggcgttcttgacgtctctggtcgggaactgatga

SEQ ID NO: 450 - DNA, 3134 bp, Sorghum bicolor
cgcaaatgctcctctcattctccccgcacccttcccctctcctcctctccttaccctcctcgactcccgcctgcaaaccccacgcccgcctccgccccgtccacgcctccgcctcggcgcccccctcgccggagctgctcggcaagtccgcgctccgccgcatctccgagaagctacgtagcctcggctacctcgagaccggctccgagacccccactccggcccccaacaagagcggggacgccccctcccccggcgagatattcgtgcccaccccggcccagctcccgcgccaccgcgtcggctccaccatcgacccgagctgggccacgggcgacggcgaggccggctccgcggcgcggcagcggaggaggggccgcgggcgggatgcgtcggggtcagcagcttcggcgccgccgtccgcggcggagctggcgctgccgcgggacgagctgcggcggctgcaggggatcgggatcagggtgaggaagcggcttaaggtggggaaggcgggtatcaccgaggggatcgtaaatgggatacacgagcggtggcggaacgcggaagtcgtgaagctcaggtgcgaggacgtctgggccatgaacatgaggcgcacacacgagattctcgagaggaaaactggaggcttagtcatttggagatctgggagtaccatcatattgtacagaggaaccaactataagtatccttacttccattacagtgaaagggtggatagttttcttgacaaagaatcatcagatctgagcagttctggggacgaggatgaggaggatgagactagttcacaacatgatagcagtcacgaggaaagtagtgagaatcctgttgtagcatgcacagaacagattaatgctggagaggggaagagtcagactgtaggatatttgaatcagagcttaagtagagagaaagatacaactcacccgatatcatctaccaaacggcttgtttttgatacaaatgagggaaatttagatattagaactggagctccaaacgaacagcatgcgagattgcaggaaaacactcgtgctgatcgtcctagtaaatttggtcctagagaacgctcatccttagtggctggtgttggatctccaaataagtttcgattacagttgcctggggaggtcaaacttgcagaggaagcagataaattactggatgggttgggcccaaggttttctggctggtgggggtatgatccccttccggtggatgctgatttgttgccagctattgtgccaggataccgtaggccttttcgcctacttccttcaggtgttccgcctaagctaacagacagggaaatgactattcttaggagactagctcatcccttacccttccactacgcactcggaagaagcagcaaccttcaaggattggctgcatccatgatcaagctatgggaaagatgcgaggtagcaaagattgcactcaagagagatgcacacaacactgacagtgagctcataactgaagaaataaaggacttgacaggtggaaccctattatcaagggataaggagtcaattgtattctacagagggaaagatttcctccccccggctgtctctctggcaatagaaaaacgcagaaagctgggcagttctacaatctacaagccgaagcctgacattgaagaaaacatgcctactcaagatgactctgtactgaaggtatcaaatgatgtctcagtacacattcgtgaagagggaacttctgtcacagaggttagagcaaaatctcttaatactgttgcgaagaatgttgaggccagattatctcaggccatagcagagaaagagagagctgaaaaacttcttgaagaactagaaaaggcatctccgctttcaaaggctgaagttagagagactatatcagaagatgagaggtacatgttaaggaaagttggattgaagatgaaacaatttctgctgctagggaggaggggagtttttgatggaactattgaaaatatgcatcttcattggaagtatcgagaacttgtcaagattatatgtaaagaacaccgccttgaggatgtggaatatgctgctcgaactctagaggcagagagtggtggtattttggtggcagtggaaaaagtgagcaaagggcatgctataatagtatatagaggaaagaactaccagaggccatcaaaactcaggccaaaaactttgttgagtaaaagagatgctttgaagcgttctgtggaaaaccaacgttgtaagtcccttaaggttcatgtgcttaagctgtcaaagaacattgactacttgaaggatcagatgaattccagctactatcacaaggacatgcatgatcctagtgtcaactctggaacactacagcagcatgacgaagaagtgcctgaagttgctcccatgagttcagagcctgaggttgagtgtgcttcagttgagatggatagagccttaaatttaacaaagtctggagtccctgtggaagatatgcagagcaaagtctgtttcgacaagctagaagatgattcttctgcggctgcaggtccatgtctgactgggagttcaagtgcttcactcagcaatctgatcagacatcaaaaccaacatagctctactgtgacattcagtcctgatagtcactgtgaaaatgattcaaaagatgtggatgggataaaattggatgtggaatcttcttctgtattgcctttgagaggtacaccactctcaaatcaagaaagacttgtgctaaggaagcaggcccttaaaatgaagaaacgaccggtactttccatagggaggaataatgtcatcactggagttgcaaaaacaataaaaacacacttcaagaagcatccccttgctattgtgaacattaagaacagagcggatggaactccaattcagcagctgatatcagaactagaggaggcgacaggatcggttctagtgtcacgagaaacaaacaaagtgattttgtacagaggttggggtgcagaagtggcccaggaaagctcaaaggagagcagcgcagatgaaggcgaaaaggaggtcatatcacctcagctccttgaagctatcaggttagagtgtggattgctccctggcgactcagagtagtag

SEQ ID NO: 451 - DNA, 2006 bp, Sorghum bicolor
gttgctctctctcctcggtcctcgcccccgcccgcgtcttccagggcgcccatgagctgaggccgccgccgatggggccgccccacgccgcgcaggaccccgtgccgtcgccgtcgccgtcggacggcagcggctccggctcctccaggcgccgcctccgccggctcgaccgccgcaacgcgtccaagcacatcggctacacagcccccaactactgccagtacccgccgtccccgcagcccgccgcctccgcgccggggtccgggccggcctcgctcgccgcctccgtcgcctgctccctcgacctcgtcaacagcttccgcatcggcggcagcggcgacgggggcggggacctccgcttcctgtgcgagagcctcggcctctccgggcccgacgacttcgccatcccgctggccgactgggaggcgcacaaggccgttcgctcctccgcctccgcttcgagctccccctcctccgcacgccccaaccacgactcccctcagcgggactcaccgctctgtcaggtgggtgccgaggagcccgcccaggctgcggacgccgacccggagctaccggccgcaacggggagggacggcccaatcgaagctccggagcggccggcacgcctggatccgccgcccgagtccacctgtccggatgcgaggagggcagctggggagggaggaatcaagggcgtgcgcccgccgccggtgctcaagccgccgccttcgatggcgctgccagctgtctgcggggtgggatccacgtgggatatcttgcggtcgttcgcgccggatgagaaagaggacgcccccgcgagcagatctgaccgtcgttttggacaccgggatgcagtggagaaggatgacgacgagaatgcggcggtattgttaaatttggacgatcttgggctggaggagtcgtctgagggcttcactggcacttcttcactatcaacgaccaacgatgacgagacctcaagcaccaccacagaatccatgttctatatctcgccgaatgggaggtttaggaggaggatccggtcatggagccgaggggtgctcctgggtagtggctcgtttgggacagtctacgagggcatcagtgatgagggtgtcttctttgctgtcaaagaagtaaacttatttgatcaagggagcaatgcgaagcagtgtatcattcagcttgagcaggaaattgcacttctgagccagtttgagcatgagaatatagtgcagtactatggaacagacaaagaagattcgaagctttacatctttcttgaattagtgacccaaggatcccttgcatcattgtatcagaaatatcgcctgcgtgatactcatgtctctgcatatacaagacagatccttaatgggttgatttacctccatgaaaggaacattgttcatagagacattaaatgcgcaaatattctggtgcatgccaatggatctgtgaaacttgcagattttggactcgctaaggagattaccaaattcaatgcagttaaatcatgcaaaggaactgtttattggatggcacctgaggttgtcaatccaaagaagacgtatggacctgcagctgacatatggagtcttggttgcaccgtcctagagatgttgacacgccgaataccctatcctgacctcgaatggacacaagctctatacaggattggtaagggggaatcaccagcaattccaaatgctctttcaaaggatgctcgtgattttataagccagtgcgtaaaatccaatccagaagacagaccatcagcatccaaactgttggagcatccatttgtaaacaagtcaataagatcagtacggtctatgaggacgatatcttcacgatcaaattcatctacacgtggcatcaattaatgggtcgttgattatctattggacagtggcagaatgatattggtccgcgcaaatcatgcggagctagccgaaagggagtgttgttttgcctggagctagtattgtcaacgctcaacagca

SEQ ID NO: 452 - DNA, 1278 bp, Sorghum bicolor
ccttacccctattgcgcttgccgcttgggccccccctcccgttcggcgcattcgcgttccgcacccgcgaggaggccggagcagcagccatgggcgtggaggaggcggggcgcgccgccaccggcaagaagctggcgctggcgagcatcggcttcgcggacgtccgcgtgggcgccgccgtgcccgggggtgccggcgtgtacaaggacggcttgctcgtcgtgggcctgcccgtgcccaaggacgacggcctcgacgccgccgcccgcgtcgtcggggacctcgccgccaggctgcccgacgttggcgccgccgctaggacttttctgaggaatagagaagtcgcagaattcgtgagtggagcattggctggtgcaatgactaaggctgttcttgctcccttagaaactatcaggacaagaatggttgtaggtgtaggatcaaaacatatttttggtagctttgtggagattgttgaacataatggctggcaaggactctgggcaggtaatacaataaatatgctccggattatcccaactcaagcaattgagctcgggacatttgaatgtgtcaaaaggactatggcatcagcacaagagaaatggaaagaggatggatgcccaaagatacaacttggcaatttgaaaattgagctgccatttcacttactatcgccaattgcaattggaggtgcggcagctggaatagctagcactttagtgtgccatcctcttgaggttcttaaggatcgcatgactgttaatcgtcaggcttatcctagtattgccattgccatcaacaagatctaccggactgatggacttggtggtctttatgctggcctctgcccaacgttggttggcatgcttccatatagcacatgctactatttcatgtacgagaccatcaagacttcctactgccgtgcacataaaaagaaatctttgaaccgtcctgagctgctgatcattggggctctttcaggtctaactgcaagcacaatcagcttccctctagaagtggcaagaaagcggctaatggtgggatccctacaagggaagtgcccaccccacatgattgcagcattagctgaggtggtccaagaggagggcgtcaagggtcttttccgaggatgggcggcgagctccctgaaggtcatgccgacgtctggtgtcacctggatgttttatgaggcatggaaggagcttcttttgggttcacggctccatgcctaagcaggaacctgacgaagtcaggctcttgcattgttacaga

SEQ ID NO: 453 - DNA, 556 bp, Sorghum bicolor
acggagctagcaacaatcactgcagtacacagcacatttgcaaagttgtagttcatcaaacgtagcggctaggtgtagcgctatatatagctccatctgctgcgacgacatggcgggcaccaccaggaggagcaggaagtcctcgtcgtcgagctcatcggcgcagcagcagctggctgccggcgcgctgcttgtggccgttgtcgtgttggtggcggcgtcgtcgtcgggcgtgctggtggcggtggaggcggtgtgcgacatgagcaacgagcagttcatgtcgtgccagccggcggcggcgaagacgacggacccgccggcggcgccgtcgcaggcgtgctgcgaggcgctggcgggcgcggacctcaagtgcctgtgcggctacaaggactcgccgtggatgagcgtgtacaacatcgaccccaagcgcgccatggagctccccgccaagtgcggcctcgccacgccacccaactgctagccatgctaataataagctaagcaagggcgctggcctggctagcattgccctacgttgtactacgtgtgttaa

SEQ ID NO: 454 - DNA, 770 bp, Sorghum bicolor
ccgcgatgggcagcctcggcgccgacgcggagccgcagggcgcgaggcggcggccgcggttcctgtgcctgcacgggttccgcaccagcgccgagatcatgcgcaagcaggtgctcggcaagtggcccgccgacgtcacggcgcgcctcgacctcgtcttcgccgacgcgccgttccccgccgagggcaagtccgacgtcgacggcatcttcgacccgccctactacgagtggttccagttcgacaagagttttatggagtacaggaatttcgacaagtgcctggcctacatcgaagagctgatgataagagatggccccttcgatggattgatgggtttctcccagggttcctacctatctgcggcgcttcccgggctccaagaacaggggcttgccctgactagagttcccaagatcaagtacctcatcatcatcggtggcggcaagttccagtccccgacggttgcagagaaggcgtacgccaacaaggtggcatgcccctcgcttcacttcattggtgacaacgacttcttgaaagtccatggtgaaaagctcatagaatcattcgtggacccattcctcattcgtcacccaaagggccacacagttccaaggctcgatgacgagagcctagcggtcatgctccgtttccttgagaagattgagggggaagtacttgagtattcatccaaagataagattgagggggaggtacttgagtattcatccaaagatgtcaacgaaaatgaggaagtgtgcttgtgatga

SEQ ID NO: 455 - DNA, 1266 bp, Sorghum bicolor
cgagtacttccgtcatctcctcaagcccgtgacgtagcttctctctctgctctccatctgctgctgaataagcttgctgctttaggttcttctccattacaattgaagtgggagaacttcccattcatctgaaatttctgctggtagttctgtccggtagttgtttcatttgttcatgggggacaaggttaatccctggtgccattggcataatcctccatggaaattcaacactgaaggttctggcggcaatctccgcccacctgatgttgggcttgttaacaccaattcggtggcattgcctgcatatctgaacacagttgctgcacctgtgccatttttcacagcatcaattgctgagagacctctttcaatagctccaagatatgccacaacattggcaccaagtttggagttgcctgcactgtatccctcacgtaagagacctctagttttctaccagaaggaaaaccatgctcctagtgcagctcctttgctgagcaaagggccactggatcctgtgccagagctccaaggtagcaacgagactaatgtaactgatgttggagcagaagaaactgagggtattcatgagaactcagatgagatcaatgcactcctggactctgactcagatgaagggtatgaaaaactgcaagaactcgacagagtcagaaggcaatctgctgcagagaatgacaccctgagcgttgagtcagtgggcagtgctggtgctgccgcaggttctgcaccaccagccaagaagagaagactcagctcctgtactgacaagtctgttgttgacactgccagttcagcaaggcctgatcattccatcgagcagaagcttcttgtgaacgactgtgatgcgcagtcatgctgcgtcggtgaagtggaaagtgaccacaagttttctctgggggaggtagaagcagcagaaggtgacagccccgatgatcagaagcgaagaagagagaggatccaagagactgttgctgcgctcaggaatattgtccctgggggcattgccaaagacgccactgctgttcttgatgaagcaatctgttacttgcagtatctgaagctgaaggtcaagacgctgggagccgtctccctctagctcctggacaattgtgatttagttctcaaagccgcttgcttctgctgttctacatatacgaagtatcacattggtaataaggtgaagatgccaaagatagctcaggttggtgcttcaggacgcgccagaggtgaataacggaagaa

SEQ ID NO: 456 - DNA, 1001 bp, Sorghum bicolor
gcgccatggctgctgcctcctccccaacctccccgcccccgccgccggcgaccgacgtcgccgctccaggcctccccgatctctcgatcccctacgacctggccactcgcgggcagtggcaggcgctcttctcccacctctcccacccggcccacacgccgcatccgcaccaccgcctcctcctctccgctctctccgccctctccctggccaagctccgacgcttccccgacgccgccgcgctgctcgcctccctccacccggacccggcctgcccgccgccgcccttcctcatccgcctcctccatgccctcctcccactcttcctccccgaccgccccctcgcgctcgaccgcctctacacgctcctctcctccgtccgcgcccgccccgacgccgggcaccccgagtggcgccgccgcgacgcgctcgtcgcgtccgtcctcgccgccgaccacctctcccaccgcgagttcgacgtcgcgctcgcgctcctcgccgacatcgccgcccgcgagccgggcaacccggtgctcctctcgcgcctcgcctacgcgcacctccagatcggcaacctcggcgcggcctcagccgcgttccgccacgtggagtccgtggccgccgcgtccgaggaccccacgcggcatgccaacctcctagcccgcaaccgcgcgctggagtgcatcgtggccaaggactacgcggcggcggtgcgggagtacgagcgctgcatcgaggcggaccccgcggatgccgtggcgctcaacaacaaggcgctgtgcctcatgtactcgcgggacctcggcgacgccatcaaggtgctggagggcgcgctcgagagggttcccacggcggcgctgaacgagacggtggtggtcaacctgtgcagcatgtacgagctcgccttcgtcaaccacggcgaggtcaagaggagccttgctgagtggatcgccagggttgcgcccgacgacttcgacacctcctgcacgcgcatgtagtag

SEQ ID NO: 457 - DNA, 801 bp, Sorghum bicolor
gtttgctcgcaatccagccgcctccgccatggccaagacgaagcaagggaagcgggacgtcgacgcctacaccatcaagggcaccaacaaggtggtccgagtcggggactgcgtgctgatgcggccggcggacacggacaagccgccgtacgtggcgcgggtggagcggatggagtcggacgggcgcggcggcgtccgggtgcgggtgcgctggtactaccgccccgaggaggccaagggcggccgccgcccattccacggcgccaaggagctcttcctctccgaccacttcgacacgcagagcgcgcacaccattgagggcaagtgcatcgttcactccttcaagagctacaccaagctcgacaacgtcggcccggaggacttctactgccgatttgactacaaggccagcaccggcgcattcacccccgaccgtgtcgccgtgtattgcaagtgtgagatgccttacaacccggatgacctcatggtgcagtgcgaaggatgcaaggactggttccatccgtcttgtatgggaatgaccattgagcaagccaaaaagatagatcattacatgtgctcggattgtgctaaagaaaatggtgcaaagagaccctcaaattcatatccagtttcacccaactctgattctaagattgaatcaaagaggcgcaagagataaaatgctgtggcagaagcatccctggcaaaggagatgcgatatttatggtgtcagctcctcattactggtgcatattgagatgttgagatgtacactgcgagagaagagccaagccaattgta

SEQ ID NO: 458 - DNA, 2217 bp, Sorghum bicolor
ttacatccctcggctcctaaacccccaacgccgacgagacgtgccaaagccgacgccccccccggcacgcaccggaaagcgacgcgcctccaccgcccccgcttgccgcctcccttccataccggttaccacctcctcctcgggacgcggagcgcccaaccgcgggcatctggcggtggcggcgtccgcgccaccttgaacttgaatcaagcaagcgccagtgcgactgggcgggcatttggaaaggcggaagcgatggtggcggcggcggcgctggacgcaatggcggggacgcgttgggggcggtggctggggctggtgacggcggtgtgggtgcagtgcatctccggcaacaactacaccttctccaactactcgcacgcgctcaagacgctcatgggcctgacgcagctgcagctcaacggcctctccgtcgccaaggacgtgggcaaggcgttcggcctcctcgcggggctcgcctccgaccgcgtcccgacctggctcctcctcgccatcggctccctcgagggcctcctcggctacggcgcgcagtggatggtcgtgtcccggaccgtcgcgccgctcccctactggcagatgtgcgtcttcctctgcctcggcgggaacagcaccacgtggatgaacaccgccgtgctcgtcacctgcatccgcaacttccgccggagcaggggccccgtctccggcctgctcaagggatacgtcggcctcagcaccgccatcttcaccgacacctgctccgcgctcttcgccgacgaccccgcctcgttcctcgtcatgctcgccgtcgtgccggccgcgatctgcgcgctcgccatggtgttcctccgcgagggcccggccgcagccgccgccgcgggcgcggacgaggaggacgacgggcgctgcttcgccgcgatcaactcgctcgccgtggcgatcgcgctgtacctcctcgccgcggacctcacggggctcggcggcgacggcggggtcgtctcggccgtcttcgtcgccgtactcctggtgcttctcgcgtcccccgccaccgtgccggcgctcctggcgtggaaatcctgggtgaagacccgcaaggccgcgaacgccgacctcgaggaggcggactccttggcggcggcgaccgcgccgctccttctcgcggcgaaggcggcggggaggactgaggaggagcaggaggcgcgggtccccggcgagcggccgcggctcggggaggagcacacaatcgcgcaggcgctgacgtcgctggacttctggctgatgttcgcgtcgttcctcatgggcgtgggcacggggctggcagtgatgaacaacctggggcagatgggcgtggccatgggctacgtcgacgtctccctcttcgtctccatgaccagcatctggggattcttcggtcgcatcgcctccggcaccatctccgagcacttcatcaagacacgagctattccccgcccgctgtggaacgcggcctcgcaggtcctgatggccgtcggctacatcgtgatggcgctggcgatgccaggctccctcttcatcggctcggtggtcgtcggcatctgctacggcgtccggctggcggtcaccgtgcctacggcgtcagagctcttcggcctcaagtactacggtctcatctacaacatcctcatcctcaacctgccgctcggctccttcctcttctcaggcctgctggcgggcctcctctacgacgcggaagccaccgcggtgcccggcggcggcaacacctgcgtcggcgcacactgctaccgcctcgtgttcctgatcatggcgctcgcctgcgtcgtcgggttcggcctcgacgtcctgctctgcgtccggacgaagcgggtgtacgccaagatccacgagagcaagcggttgagtaggtccgccgtggcgcagagggttggttagctagttgctacgcacgcagctctgtggaagctcaagaaaatagctcgcatcaacaacgttggaactctgaagaagcacctccgcaattttgtgtgcgaatatctttgaaaagaatttttgtgtgtgaattaaggggccattcatgtctcttattctttggaaaaagatggatgcatatcaatttgattggtttccactgagtattgattgagagggttgcaggcttaattggtagaaccccttgagttcagtgtggtgtttattctgtagtgtacatagcgtttccgttaa

SEQ ID NO: 459 - DNA, 4290 bp, Sorghum bicolor
catcgtgtcgtctccactaggcacgtcctgaaaaccttgcgggcctgtactggaagcaggcaggagcgatcccacaggccacagcgcggctcctcgtcgccgtcgcaaccgatttaggtggagatggaggcggcgtcggcctccgacgaaaccctagccgccgtcttcgcccagctcaagccccacaccgtcgctctcctcgacctcctccgcagtcgccgccccgcctccagctccgcctcctccctccgcgaaatggccgccttcctccgcgccgccccggccccggcgctgcagctctgcttcgattatacagtgtttccacttctcctgctcctggatgcggcggtgcagtgcaggaagcaaagcaatgcgccggggcagggttcagggggcattgatatcagtgatgccgtcgccgaagttgggttgacctgccttgaggtcctcctcaccaagtgccgcctcacctctgtcaatcagatggtagcaatgctgaaaaagttgacttccggagctatgctttcaccttcagaggcttcagaggaattccgtggtgcaattataagatgcttcaaggccttggttttgcagctacagccatgcttggacaatttttgttcttgcaaacaaggaacattgttacctacgaccccaaccagtacaggcttggaggttgtaagtgtatcccgctcaaattactctgcacagccagaggagtgcttgcttgcattcctgcagtcacaaaatgcttcagctgctgtaggacattggctctcacttcttctactagcatcagaacttgaggcatcaagagggcaccgtggaagtgcagatgttaggaaggaatcattgcacactctgcgcatccttattggcaaggtaggctctgctgacgcacttgcctttttccttcctggaattgtcagtcgccttgggaaggttctctacacagctaaggctatgattagtggtgctgctgggaattctttgagcactgaacaagccattcttggattgactgaagctttgatgatagtcctaaatgacaaggaaaatcttagtgcacttggtaagcacatgaatgagaatcattctcattctcctggtggcagcggttcaactgagcatgtattgcagatgcttcgccagttaccaaccaaaagtttatctgacgagataggccatgatgagactacagatgactctatctccaatgtcaataattcctttgctgatagaaaggcactacatgtgaagcggaacaaaaaatggcttgaggaaacaactagtaatgttgataaattgctttgtgccacattcccacatcttgctcttcattcatctgagaaggtgaggaagtcggtggttagcggtgtaaaagggcttttgtctagttgcagttctacattaaaaagaaccaagatgctacttttggaatgcttatgtgttctggcatgtgatgatgctgcagctgtgtctgaggctgcacaagatgctcttgattatcttttcaaccagggccacaatcttgtaacagaaaatgagatttctgatacctttactaggctggttgaaaggctaccacaggtggtacttggaagcgaggagacaaccgcactttcacatgctagaatgttgttggctctgaccttttatgctggccctcagtttctgataaatcatcttcactgttctcctgttattgctgctcgtttctttgattgtttgggtttatgcataggtcatagctcacagttttctggttccatggacaagctaattgtttcgaagccactatctattgggtatctttattcagttgctgagttgaagagtggtgcctatgctaaagatacaactaacaaatctctgcatgccatgtcgacatctgcagcctccaaaatatctgttatccatgataatgctttgccaaatgcattacttggtacagttgaatatgagttgccccatgtgcctccatggttttctcatgctggtagtcagaagctttacggggttcttgctggaataattagacttgttggcctatcaacagtttcagggaaaggaactgctgcatccttatctctctttgttgatattctgctcgatcaatttaggaggttgagcactgagctgagagaaaaaagtatttacaaagatggtctgcagcggtggtacatgaaaagtgaagctggacaaacattacgccaagcaagttcagctgtctgcatgctcaatgaactcatgtatggtttgtcaggtcgatcccttggtatgtttttacaacttttcaacaatagatcagcacagatgtcaaggacagtttgtcagaaaaatcaactgcttgcttgtgttgaacataatggagttactaatgaaagagaagtgtggggctttaatgaacaaaagggcactaaagacaacattcttcattgcattggcagtattctgcatgaatatgtatcaccagaagtgtgggatcttccaacagagaaggacactgagctacgcctaatagagttgaacctgccattgcacttctaccgtgatacaactgcgctgcacacggttgtgcttgaaggaattggagtcttgggtgttcttcttggtcaagattttgcacttagtgggtttatgcactcttccctttatcttctgctccgtgaacttatcagttcaagtgctcagataagaactgcgtctgatgctgtcctaagagcccttgctactgctggcggttattgttcggttggccagtttgttgttgcgaatgcagactacattattgattctctttgcaggcaattgcgtcacctggacctgaacccccatgtccctgatgttcttgcttccatgctgtgttacattggtgcttctcgtgatatcttgccattcttggaagaaccgatgcaagcagtttcttctgagctagaggttcttggcaggcatgatcacccacatttaactgttccatttctgaaggcagtttctgagatttccaaggcatgtagacatgaatctacttgtttgccagatgaggctcaatcattttatgtgaaggtcagttctgagggtcaagaagtaaaaaatacgattgagaagagaatggaatccagtgcaatatctgaaagaatgaatgttgatgctcgaccttattttatgagcttggaatactgggaggatttactttgtaagctaaatgagatgagaagatataggagaatagttgggtctcttgcaggctcttgtttgtcagctgccatcccgcttctctcttcgattaaggaagcagcatgtcttgtggcccttgacattgtggagaataccactatatctattgccaaggttgaggaggcttataagtgtgaatgtcaaagcaaaggagttattgaggaggccatccagtttctttcatttgacgagcttcttgatggtacagatgccactgaagatgtcgatgaaaataggctactcccagcaatgaataaactatggccttacttggttatctgtctaaggaacaagatctcagtgccagttgttaggaagtgcaccgaagtgttgagtagagcaattatcatatctggtggcgatttttatgtacgccggtttcataaggatggatccattgtttggaggttgctggctttatctccattccgacgaacatcaaagatggatgaaaaagcaatcattttaccatatagggatacctcgcttacctcagaggaaccaatggctgagatctccagccaaaagattcagattgcagtcctggacatgattgctgcaatatcttcgaacaagagaagtgctgttgcactagaaagtgtactaaagaaggtatgtggccttgtggtaggcattgcctacagtagtttgacaagtttgcaggaagctgctataagggcactggcaggccttgcctgtatggatgctgaccttgtctggcttctcctggcggatgtgtactactcactaaaccaaagggaacctttactgcccaaccaagatctagcgctggtatcagatcttttgccccctccaatgtcttcaagagaatacctctttgtacagtatggaggtgagggtgttaggtatgatgtagatccctcatctgttcatgaagtgtttagaaggatgcaggatgtgtgatcttgtgtgacatgaaagtcaggttcctgatcctttgtctatctgtaaccttggtgaggtttttttgtcatgctagcatcctttgtcacacattgaacataatattgcctgctacagagaatgcaaaca

SEQ ID NO: 460 - DNA, 1005 bp, Sorghum bicolor
ccggagctgtttcttcgtcgcaggaatgggcaagaatggcacccagtacgcagtgctggacgccttcacggcggagccgttcaggggcaaccccgccgcggtgtgcctcctccaggacgccgccaaggccgctgacgagcggtggatgcagtccgtcgccgccgagttcaacctctccgagaccgccttcctcctccgggactcctccgcgtctggcgccgccccgcggttccagctccgatggttcacccccgccgctgaggtggagctctgcggccacgcgacgctggcctccgcccacttcctcttcacatccgtcctcgcggagcacgagacgctcatcgagttctcgaccaagtcggggattcttaccgccaaaagggttcctgcgccggagagcacgggcgtgtcaggcgaggggaaactgttcattgagctggatttccccatgattgaccttgttgattgccacccttccgagctgccgtccatccccaagaccctgaacggagcctccattgtcagcgtttacaagtcaacgacggccggtgacctcattgtggagctttcatcaggaaaagaggttgctgatatcattcctaacattcatgaaatcaaaatatgttcaggcagaggaattattgttacagggccagcgcctgctggatctggttatgacttcttcagtcgtttcttctgcccaaaatttgggatacctgaggaccccgtttgcggcagtgcacattgtgtcttggcaccttattggggtgggaagctggggaaacacaaattgacggcatttcaagcatctccacggagtggaatcctatacctggagttagaagctgcaggcaggagagtgcgaattcagggagaagctgttactgtgatgactggtaccctcctagcgtagccgctcaataatgaacttcgcggtcttcagtttggttgtgcggcatgattactctgcagcaaggaataaactaattctcatttcacccgtcg

SEQ ID NO: 461 - DNA, 914 bp, Sorghum bicolor
tccccatggctatcctcgccgtcgcctctccgctcaaaaccctaaaccctagccaggcggaccacagccgcatccgcctctcctcttccctcctccgccttccgctcccggtgccacgatggcgccgcctccggtgctccgcgcagtacagtgaggcggcggcggcgccgcccacgtcgacaacgacgccgcggccggcggagataccctggagcaaggagctctgcaactcggtgcgcctcattgggactgtgggcaccgaagtcgagctgcggcagctgcccagcggctccgctgttgcgaggggccgcctcgccgtatggaagtcggccaccgaaactacatgggtaactctacaattctgggatgatctggctattgttgcctctgagcacgttaagaagggtgaccggatatttgtttctggacggcttgtgtcagatactgttgatgaggggcctgagaagcggcatgtttattacaagcttgcagttcaacagttgaatttcatcgagtcccagccagttcgattatatgaaccagaggcaagccaggatgccccaggtggaaggcgtgctgattattttaactctacctctaattcaactgaggataagaatagggataatatgagctcttctcgatcaactgaagagctgtggcaagcgttctttgctaaccctcttgactggtgggataacaggacaaataagaagaacccaaggtatccagacttcaagcataagcacactggtgaagcactatgggttgacgggaggaacaaccccaactgggtcatctctcagctggctgttttggactcaagaatgagttctctgcaagacaatgggagaaaaccagtctcttatatgtatgctgatgagttcatgacattggacggcaatcggtagtag

SEQ ID NO: 462 - DNA, 1180 bp, Sorghum bicolor
aaggttgaagaggcagatcaagcgagctctaatagttttcatggatatggagcagggctgcaagacggctcacgggtgggctgccagggatgcctccggccacctctccccttacagcttctcagcaaggattcagggggacgccgacgtgacgatcaaggtgctcttctgtggcatctgccacacggacctccacgtcatcaagaacgagtggggcaacgcaatgtaccccgtcgtcccagggcacgaggtcgtcggcgtcgtcacggacgtcggccatggcgtcaccaagttcaaggctggggacacggtgggcgtgggctacttcgtcgactcctgccggacctgcgagagctgcagcacggggcacgagaactactgccctgacctcgtcctcacctccaacggcgtggaccaccaccaccacggcgccaccaccaagggaggcttctccgacgtgctcgtcgtcagccaggacttcgtcgtccgcgtcccggagagcctccctctcgacggcgccgcgccgctgctctgcgccggggtcaccgtgtacagccccatggcgcagtacgcgctcaacgagcccggcaagcacctcggcgtcgtcggtctcggtggcctaggccacatggccgtcaagttcgccaaggcgttcggcatgacggtcaccgtcatcagctcgtcgcccggcaagcgcgacgaggcgctcggacgccttggcgccgacgcgttcttggtcagccacgacgccgcgcaaatgaaggcagcagcggccacgttggacggcatcatcgacacggtgtcagcggggcaccagatcgtgccgctgctggcgctactgaagcccatggggcagatggtggtcgtcggcgcgccaagcacgccgctggagctgccggcgtacgccatcatcaccggcgggaagcgggtggccgggaacggcgtggggagtgtcgccgactgccaggcgatgctggacttcgcaggagagcatggcgtcaccgctgacattgaggtggtgcagatggactacgtcaacacagcgatcgagcggctcgagaagaacgatgtgaggtatcgcttcgtcattgacgtcgcgggcagcaagatggaggagaccgttgcttaattaggtgcccggatgcggcgcggttcgagtcattgtcgtgtgaaatcgtag

SEQ ID NO: 463 - DNA, 1080 bp, Sorghum bicolor
caccggatctattggtcgttccccggcgccgacaaggccaaaccctagaaccctgccaagatgaggtcgctgcgagcggcgcagaccctagtctcccgttccctcctctccgcgcgccatctaaacggcgcagcctcccccgccacggccgccgccgccgcgggcgcgcggtggtgcgccacgccggcgccggtgccgccgccccgttcgccgcttccgtcctcgagggtgatgcctgccggggttgccggcgcagtatccttctcccttaccttcgctactgtagcggtggcggaggccaaggccaaggagcggccgcagccggatctgttgccgcagaacgtggtgctgtaccagtaccaggcctgccccttttgcaacaaggtcagagcctttttagactatcatgatataccatacaaagtcgtggaggttaatccattgagcaaaaaggaaatcaagtggtctgattacaagaaagtcccaatattgacagtagacggtgaagagcttgttgattcatcagatataatcaatatactacagcgcagaatcaaccctgatgaacccactaatgatgaggaagcaaaatggcgaaggtgggttgatgaacaccttgtgcatgtcttgtctcctaacatataccggacaacttcagaagctctagaatcttttgactacattgcaaaacatggtaatttcagttttactgagaggtttgccgtgaagtatgctggtgctgtagccatgtacatggtatctaagaagctaaagaagaaatacaacataactgatgagcgtgcttcgttgtatgatgctgccaatacatggatcgaagccctgaatggaagagatttcctgggtggctccaagcctaacttggcagatcttgccgtcttcggtgttctaagacctatacggtacttgagagcaggaaaagacatggttgagaatactgaaatcggtgattggtaccaacgcatggaagttgcagttggagaaccatcaagaatacaggatgcagaaggaaactagaattttgacaagacattcttttaaagaatttagtggaacctgtgc

SEQ ID NO: 464 - DNA, 1105 bp, Sorghum bicolor
gtgtgaagaagactgccacaagacaccgcatcgggcaccagcaccaccaccacctttaattcctgcctccggccgtccagccaccctccccacgacgtccaccccgcaggtttgccagcagcccagccccatcgtcgagccgcgagctaccagtcgagcgcgcgcggcagcggcagccctgggttcgatccggccgatcgatcgcatacggcacctacggatgctccacgcatccgtctcctgagatctcgatcgattgctccatggggagcggcaaggcgtcatccccggccccgccaggcgccgccgccgccgccgctgccggcgggagcggctcgccgtcgccgccgggcggcgccgtctgctgcatgtgcggcgaccgcggcctcctgcccgagctcttccgctgctccgcctgctccgtccgctcccagcacacatactgcacggatcggtatccgaaggtggagtcgtacggcacctgcaactggtgcctcagggcggatggggccgtggcttctacttctaactcgccgagatccgccggcaaagcggctgcccggccgccggctcctcatcatcacggcggtgacacgacgaccggcggcagcggaagatcgccgaaggttgttgccgctcgtggcgactttgcgtcttccaacctgagcaagcctatcaagaagcagccgcagcagcagcatgcgcagcggctcttgctgcggcggtcggcgtcggaccttggcacccgtgtcgtccgcaacgaccacgacgcgccaccgccgccgtcgcccggcgtcgcgcgtggcaggccgagggtccggaggtacaagctcctagaagaggtgatcactagctagctatagccatataccccgtgtggtatatcgatgtcgatcgtggatgacacgatcgagtgcgtgtgcgtgtattaggtgtataatacgtgtgtgtgtgtgtatgtgtgtgtataggggtagacaactagacatggcatcttgcggtgctgccatgcatgcatggagatcgatcgagcagtgtatcgtacgtactacgtgctgatcgatctcaggtgtgctgatcgatctcaggtgttaatcagggtgct

SEQ ID NO: 465 - DNA, 3437 bp, Sorghum bicolor
gtgtcatctctcctgaggaaccggcgcggcgatggccggggggcaggcgcccgaggcgtcgcccgggcggtaccagcgccgccgcgacgagatcgacgacgacgactgcgccgacgtgctcggcatcgacgtgcgtggtcccgacgctgacccgttcgacatccccgccaagcgcgcccccgtcgagcggctgcggcgctggaggcaagctgcgcttgtcctcaatgctaatcgacgattcagatacacacttgacctaaaaaaggaggaggagaaggaacaaataaggaggaagataagggcccatgcccaagttatacgggctgctttacttttcaaagaggctggggaaaagcagaatcctgacacagaattgccagaaattctcccacgtgggtttggaattggagagcagcagctgacagtgatgactagggatcataattattctgctctgcaagaatatggaggggtcaaagggctcgcaaatttactgaaaaccaacctagagaagggaattcatggcgatgaggcagatttgtcatgcagggcaaatgcttttgggcctaacagatatcctcgcaagaaaggaaggagcttttgggtttttctttgggaggcctgccaagacatgacgctagttatccttatcatagctgcagtaatttctctagtactgggcattgcaactgagggtatcaaagaaggctggtatgatggcactagtattgcatttgcagtctttcttgtgatagtcgttactgctgttagtgactacaagcagtcgctgcagttccaacacctcaatgaggagaaacaaaacatacaagtggaggttattaggggtggtagaaggattcaagtatcaatatttgatatcgtagttggtgatattgtggctttaaaaatcggtgatcaggtcccagccgatggcgttgtaatcagcggtcgttctcttgccatcgatgagtccagtatgactggggaaagcaaaattgttacgaaggatcagaagtcaccctttttaatggctggatgcaaagttgctgatggttatggtaccatgttggtaacggcagttggccttaacaccgaatggggtttattaatggccagtatttcagaagacaacaatgaagaaactcctctgcaggtgcggttgaatggagtagcgacattcataggtatcttagggctttctgttgctgctgtggtcctcgtagtcctctttgcaagatattttacaggacatacaacaaattcagatggctctgttcagtttgttaagaggcacacgagtgtgaaatctgcaatatttggttcaataaagatactaactgttgcggtaactattgttgttgtcgccgtacctgagggcttaccgctggctgtcacactaactctggcttattccatgcgaaaaatgatggccgacaaagcactggtgcggaggctttctgcctgtgaaacaatgggttcagctacaactatttgtagtgacaagactggtacattaacattgaaccagatgactgttgtgcaatctattgtcggtgaagtaaagctgcaacctcctgctaatgttgataaactgtcacctactgtggtctcacttctacttgaaggaattgcacagaatacctcaggcagtgtgtttgaggcacaggatggcagcatcgaggtaactggttcaccaacagaaaaggctatcctatcttggggtcttgatcttcgtatgaaatttgcggaggagagatcacgatcttctataattcatgtctctcccttcaactccgaaaaaaagcgtgccggggttgcagtggttgcgagagattcggatgttcatgtacactggaaaggagctgctgaaattgttcttgccttatgcacaagttggctcgatgtggatggctcagcacatgtaatgacacctgataaggctgatcaactcaagaaacttatagaagatatggctgagcaaagtcttcgatgcattgcttttgcttatcgaaatcttgatctgaaggttgttccaagtgaggagcaaataatcaactggcaattgccagataatgagttgattcttattggaattatagggatgaaggatccttgtcgccctgaagtaagagatgctgtcgaactgtgcaaaaaagctggtgttaaggtacgaatggtaactggagataatctgaagacagctagagcaatagctcttgagtgtggaatactcgatgactcagaagcatctgcacaagctataatagaaggaagagttttccgtgcttacgatgatgctgaaagggagaatgttgccgacaagatttctgtgatggcacgatcttctcctaacgacaaacttctccttgtaaaagctcttaagaaaaaaggccatgttgtagctgttactggtgatggaacaaacgatgctcctgcattgcacgaggcagatattggtctttctatgggcatccaaggaacagaagtagctaaagagagctcggacataattattctggatgacaatttttcttctgttgtgaaggtggttcgctggggtcgctctgtttatgcgaatatccaaaagtttattcagttccagcttactgtaaatgttgcagctcttgtcatcaatgttgttgctgctgtttcctcaggaaatgttcctctaaatgctgttcagcttctctgggttaatctcatcatggacacacttggtgctcttgctttggctactgaaccaccaacggatcaacttatgaggcagccacctgttggaaggagagaacctcttgtgactaatatcatgtggagaaacttgtttattcaggctgtttttcaagttgctgttcttctgactctcaactttaggggtcgggatcttttgcatttaactcatgacacactagatcactccagtaaagtgaaaaatacacttatattcaacacatttgtcttgtgtcaggtgtttaatgaggtcaattctcgtaaaccagaggaactgaacatctttgctggagtttcaagaaatcatcttttcttgggagtagtaagcataactgttgtgatgcaggtgataattattgagttcctcgggaaatttacgtcgacagtgagactcaactggaagctttggcttgtttctgtagttattgcttttctaagttggcccttggcttttgttggaaagttcattccagttccgaggactcaattgaaggatatcatcttaagatgttggcctaaaagcggcgagagtgcagaacaacaggatcaggatgacagaacagcacatccgccggtgtgaagctgtgcttgggcaacttttcaaaattatcatatgctgaaatattgtagagagctggtgcacatagatggtgttggctaattttggatgctgatttcttctaaccatgcttaccttgttccctggctat

SEQ ID NO: 466 - DNA, 366 bp, Sorghum bicolor
actccacgtcaatccacaactcaaaagtcgcaaggcgagcaatttgcaaggcgatgagcttgaggtacatgagccgtgtgggcgcgcgggcggcgcaggcggtgcgggagagcacggggaggtcggtcaaggacaaggcgcagtcgtcggcgtcggcgtcgatggcgaggagcggcggcggcagcaggccggcgccggccgccgggtcgtcggtggagtcgggaagggcgagcgccgcggcggtggccaggaggaaggcggaggaggagaagcggcgccgcgccgagcaggcgctgcgcaccgtcatgttcctctccatctgggggcccaacacctagtactagtaggagcatcttgtgtagcgtg

SEQ ID NO: 467 - DNA, 1340 bp, Sorghum bicolor
gctcgattccttgatcctctctctctctcgccggccggcgcgcccgcccacatggtggagtcggaaggcgaggcggaggcggcgtgcgcggcggtgctgacgccgccgctgtcgctggaaggcggcctcgcggcggagctccgccctgccaacatcgtccagcgtgtgctcagcctcttccgcaacgtccgcccgggctcggacctctcccacttccagctgccggcgacgttcaacctgcccaagtcgcagctacagctatacggagagggggtgtactgcgtcggcgacgacctccttggccggtgcgcgcgtggcgccgacagcctcgaacgcctcgccgccgtggtggcatggagcatctccacgacgcggccgcccatcttcggcttcgcgccctacaacccggtgctcggcgagacccaccacgtctccacctcctccggcggctccaccctcaacgtcctgctggagcaggtctcgcaccgccctcccgtgacggcgctgcacgcggcggacgcgcgcggcgacgtccgcctcgtgtggtgccagagcccggcgccgcggttccacggggccagcgtggaggccgcggtgcgcggcgcgcgggagctccgcctgccccgccacggcgagacgtacgtcgtgggctgccctaacctggtgatccgcctcctcccgtcccccggcgtcgactgggccggcgacgtccgcgtcgtctgcgccgagtccggcctcgaggccaagctcagctactgccggacgcggcgctcgttcctcgggttcggcggcggcgacgcccgctgcgtcaggggcaggatcttccgctcgtccgcgcctgacgagacgctgtgcgaggtcgatgggttctgggaccggcaggtctccatcaaggacgtcgctactggtgaggtctccgtgctctacgacgcacagcgagccattggtgacctcgccacgcccgtcgtgcaagaccagaagggcgtgtcggcgtcggagtccgcggtggtctggggcgaggtgagcgacgcgatcttgaagaaggactgggagacggcccggcaggcgaagcggcgggtggaggacacggcgaggaggctcgccaaggagaggaacgagaggggggaggtgtggacgcccaaacacttctcgctgtcgcagaacaaagacggcgactgggagtgctggccgctggaggagacggtgccgccggcgcctattgttgtcccctcttcctcatcctcctcatgacactactagtagatcattagtacttctacagcactacatgttgattgacacttcactgatgatatacgacgaacgaacctgaatgaatc

SEQ ID NO: 468 - DNA, 1247 bp, Sorghum bicolor
caaagatgtatcaccaacatcagggcccgagtgagctcttcaccacgagaacatcctttccaatggagcagcatctgtttttgcgtggaggaaatgcccaaggagattctgggctggttctctcaactgacgctaaaccaaggctgaaatggacacctgagttacatcagcgatttgtagatgcagtcaatcaattaggtggagcagagaaagctactccaaaaacagtcatgaggctcatgggaattccaggactcaccttgtaccatttgaaaagccatctccagaaatacaggcttagcaagaacctccaagctcaagcaaatgtcagtacatcaaagaatgccataggatgtacatccgttgctgataggattcctggaacaagcgcagctacaatgagcagtacaaatgtcgttccacaggcagagaagactattcaaattggtgaagcacttcagatgcaaattgaggttcagaggcagctaaatgaacaacttgaggtgcaaaggcatctacaactacgaattgaagcccaagggaaatacctgcaggcagttttggagcaggcacaagagacacttggaaaacagaatttgggtcctgcaaacctggaagatgcaaaaataaaaatatcagagttagtttcacaagtatcaactgaatgcttcagtaatgcgattacagatgtaaaaggaagttcaagtgtgcatagattagagcccagacaaatccagtttgttgaaagttcaacaaatagttatttgtctgtggctgaaggattcatcaaggagcacagactacagcaccatggagtactaaaagcatatgatgatagttcattattttgcagaaaaagatctcatgaacatgagacccagtttgcccttaacagaagcctaagtgagcgtaggatggctcatttgcagaatgaggaaggatacagtaaagcagagtttgggtatgaaagtgacacagaaatggcacatgagtatgctgaacctcaaaagaatggtggaggtagcaccaccagttcggcgtcaggaagcaaagtagatgcagagaagctatatctggaagaacaaaactgcgcaagacaggcagttgaataccccagagaaagcaagctagtagattttgagcatccgtgctctgggaagaaacttgatctgaacacccacaatgtcgatgacactgatcaagcttacagacattttgacttgaatggcttcagctggagctgatga

SEQ ID NO: 469 - DNA, 6100 bp, Sorghum bicolor
agcagcaccaacttcatcaccctgcgcttgcgcgcggcaacaccgtaccaaagcgcgccgtcgggatcggcgggaatggcgagcggcggcgccggcccgtcggggccggtgcggtccacctcccaaacccggcagcggacgatggggcggatacccacgcgcgcctacaccatgcgcccggacggattgtccggtgaggacggccccggttttgaggaggaggagctcgtgccctcgtcgctcgcgcccattgtacccatcctccgggccgccaatgagatcgaggaggagaacccgcgcgtcgcctacctatgtcgctttactggattcgagaaggctcatcttatggacccaatctcaggtggacgtggagttcggcaattcaaaacatacctcttgcataggcttgaaaaggatgaacatgagacaaatcgcaggcttgctacaactgatgcaaaggagatacaaaggttctatgagcaatactgtaaaaaatatctagaggaaggtcatgacaagaggaaaccggaggagatggctagacactatcagattgcatctgtcctatatgatgttctgaaaactgttacacctggcaagaatgagtatgataagtatgctaaaggggttgaaaaggagaaagcatccttctcacagtacaatattctaccacttaatatttctactccaagacaaccaataatggaaattcctgagatcaaagcagcagtggcgctccttcgtcagatggatgaccttccaatgccaaggattgaattaacacaaagctctgatggaaaaacagtgcctgatgaaatggacaaacctttggtccaggatttgcttgattggctttggcaaacatttggatttcagaaaggcaatgtcgagaaccaaaaggagcatttgattttgctccttgcaaacattgacatgagacaacagggtacttcccaccatagtgggagacatgttcacgtgatacatagtagcacggtgatatatttgatggacaaaattttccagaattacaactcctggtgtcgatatttgcatctggattcaaacattataatcgcaagcgatgcctccacacaacggccagagcttctatacataggactgtatttactgatatggggtgaagcttccaacgttcgcttcatgcctgaatgtctttgctacatcttccaccatatggcaagagatttacatgacataatatctgatagaagagaaggaccatttgagccaccattccagcgagaggggagtgatgatgcatttctgcagctagtaattcagcccatctatagtgttatgcagaaggaagctgcaaggggcaaacatggtacagtgagccactcaatgtggagaaactacgatgacttgaatgaatacttttggtcaaaaaaatgcttcaaaaaacttggatggccaatgaatccaacagctgacttttttgcggacaccagagccaagaatgaaactgagcaacatgatcatgtgattagccgaagaaggcaacatgatcatgtgattagccgaagaagggcgtcaaaaacaaattttgttgaagttcgtacatttttgcatctattcagaagttttgatcgtatgtgggccttctttatattggctttccaggccatggtaattattgcctggagctcttctggggcactttcttctatatttgaaccagaagttttcagaaatgtattaacaatctttataacagcagcattcctcaacttccttcaagccacgctagagataattctcaactggaaggcttggaagagcctggagtgctcacaaaggatacgatatatcctgaaatttgctgtagctgttgcctggttgataattcttcctactacatactcaagctctattcaaaatcccacaggccttgtgaagttcgtcagcaattggataaatttgcagaatgaatcaatttataattatgctgttgccctttacatgttaccaaacatattcagtgccctgtttttcatgtttctaccaattcgacgggtcttagagcgctcaaattctcgcattataaggtttcttttatggtggacccagccaaagttatatgttgctcgaggcatgtatgaagacacttgctcacttcttaagtacactacgttctggattctactgcttatatgcaagctcgccttcagttattatgttgagattgcacctctagttgaaccaaccaggataatcatgtcactggaaaggccgccttacgagtggcatgaattcttcccaaacttgcggcataatttaggtgttgtggttactgtatgggctccaattgtcatggtatacttcatggacacacaaatatggtatgccattttctccacaatttgtggtggagtatatggtgcattcagccgcttgggtgagatacgaacccttgggatgttaagatccagatttgaggcaattccaagagcattcggcaaaaaacttgtacctaatcatggtagtcgcttgaaacgagatgaggaggacaaaaacccaccctttgataagtttgctgacatatggaatgcgtttattaactcattgcgagaagaggacttactaagcaatagggagaaaaatctattggttgttccatcatctggtggtgaaacaagtgtttttcagtggcctcctttccttcttgccagtaagattccaattgcacttgacatggcaaagagtgtcaagaaaaaagatgaagaactcatgaagaggataaagcaggatccttatactgagtatgctgtaatagagtgttacgagacattattagatatcctttacagcattatagttgaacaaagtgataagaaagttgttgatagaatatgtgaaagcatcaaagatagcatccaccggagatcactcgtgaaagaattccgattggatgagcttcctcagctaagtgttaagtttgataagttgctagatctactgaagaaatatgatgagaacgatcctgtaaacaataacacacagattgccaatctgttacaggatataatggaaattatcacacaggatattatgaaaaatggacaaggtatattgaaggacgagggccaaaaacaactgtttgcaaatttaaatctggactcattgaaggatgttgcttggaaggaaaagtgcattaggcttcaattgttgttgacaacaaaggaatctgccatatatgtaccaacaaacttggaagctcggcgtaggatcaccttttttgcaaactcactttttatgaaaatgccaagggcaccacctgtccgtagcatgatgtccttcagtgttttaactccatatttcaaagaggaggtgctcttttccccagaagatcttcgtaagaaaaatgaggatggtatatcaatactgttctacctacggaaaatatatccagatgaatttaggaacttccttgagaggatagattttaaaccaaaggatgaagaagaacttaaagataggatggatgagatctgtccttgggcgtcttataggggtcaaacactcaccagaacagtgagaggaatgatgtactacaggaaggcacttgaaatccaatgccttcaagatacgaaagatcctgctaaatttgaccaagacggattaatagaatcctatcaagagttgcaatctagtattgaaatggcacaagctattgctgatatcaaattcacctatgttgtctcatgtcaagtctatggcatgcaaaagacgtccaaggattcaaaagacaaaagccgctatcagaatatcctcaatctcatgataataaacccatcactacgagttgctttcattgatgaggtcgaagctccaaccagaaatggagcaactgagaagacgtattattccgttcttgtcaaaggtggtgaaaagtatgatgaggaaatttaccgcataaagcttcctggcaaaccaacagatattggagagggaaaacctgaaaaccagaatcatgctataatcttcaccaggggagaagcacttcaggccattgatatgaatcaggataattatatcgaggaagcatttaaaatgagaaatgtgctggaggagtttgagagtagaaagtatgggaagagcgaacccactatattaggcctacgtgagcacatttttactggaagtgtttcttcactggcttggtttatgtccaatcaagagaccagttttgttactatcgggcaaagagttctggcaaatcctctcaaggttcggttccattatggccacccagatatttttgatagactcttccatatcaccagaggaggcataagtaaagcttcaaagactataaatctgagtgaagatatcttttcaggttttaattcaaccatgagaggaggaaatgttacacatcacgaatacatgcaagttggtaaggggcgtgatgtggggatgaatcagatttctagcttcgaagctaaggtggccaacggcaacggtgaacaaacattaagccgtgacatttatcggcttggacgcagatttgacttctacagaatgttatctttctattttactacagttgggttctattttagcagcatggttactgtgcttactgtctatgtgtttttgtatgggaggctttatctggttatgagtggtctggaaagatctattatgctggatgcacggaatcagcagaatgtcaaggctctcgaaaatgcactggcttcacagtctattttccagctaggtttgctgcttgtcctccctatggtcatggaagttggcttagagaaagggttccgcacagcgttaggagagtttgtaatcatgcagcttcagttggcctctgtgttcttcacattccagcttggcaccaaaacccactactatgggagaacaatactccatggtggtgcaaaatacagacctacaggccgtggattcgttgtgtaccatgcaaagtttgctgaaaattatcgtatgtactcccggagccactttgttaaaggactggaactcttgatacttttggttgtatatctagtctacggaagatcctatcgcagctcaagcctatacctatttgtcacctgctccatgtggttccttgttgcttcatggctcttcgcgccatttatcttcaatccatcgtgctttgagtggcagaagactgttgatgactggacagattggaggaagtggatgggtaaccgagggggtattggcatgtctgtggaacagagctgggaagcttggtggttaagtgagcaagatcacctcaggaagactagcatccgagcccttctgttggaaatcatcctttcacttcgatttttgatctaccagtatggtattgtctaccatctgaacatagcagatcaccacaaaagcattatggtatatggagtgtcatgggtggttatgctccttgttctagtagtgctgaagatggtttcaatagggcgacagaaatttggaacagacctgcagcttatgttccgcattctcaagggccttctcttccttggctttgtctctgtgatggcagtcctatttgtcgtcttacaccttactatttctgatgtcttcgctagtatccttggatacttgcctactggatggtgtcttcttctgattggacaagcatgctcaccattgattaggaggaccatgctatgggactccatcatggagctcggaaggtcatacgagaatataatgggtctcatcctcttcctgcccatcggtttcctgtcatggttccccttcgtctctgaattccagacacggctgctgtttaaccaggcatttagccggggcctccagatctcaaggatccttgctggtcaaaagggtattggcgagttcgagtttgagtgaccactaagcttgggcagcgaaccaagttcactttcatatatttgtttccgatgatcgatttttgatctgtactctgtagtgtactttcatcaggtttactactttagtccttggaggtactggtttataggtgtatgatctgttgtaatatatacgtatatcaatatcatattactttctatccacacggtctgaattgaccattacaatatgggtgcaa

SEQ ID NO: 470 - DNA, 1389 bp, Glycine max
agcagtggtggaagggttgttgagaaggggttttagaagtccacatttttcagatttgattcgcgttcctcttctctcttctcatcatcaatggcgacccccattcctccccctcctgccgccgccgccgccgccaccaaggtcgattacttgaaccttccatgtccgattcccttcgaagagctccatcgcgaagctatgatgtctttgaagccagatctttttgagggcatgcgttttgatttcaccaagatgctcaatcagaagttctccctcaatcacagcgtgttgatgggacctactgaggttccttctcagtccacggagacaattaagattccaactgctcactatgagtttggctcaaccttcattgatcaccctaggttgttgctctggggcagaattttgactgatgggaggctcaatgccagagtcaagtgtgatttgtccgaaaatctcacttttaaagccaatgctcagctcacaaatgagccgcatatgtctcatgcgatgatcaactttgattacaagggaaaagactataggacacaatttcaacttggtaatggagccttgctaggagctagttatattcagagtgtgacacagcatttatcattgggtggggaggtattttgggctggtcagcatcggaagtctggtattggttatgctgctcgctacaacactgataagtcggttgctacagggcaagttgctagcactggaatggttcttctaagctatgttcagaaggtatctgagaaggtttctctagcatctgagtttatgtgcaactacttgtcaagagatgtcacagctagctttggttatgactacatccttagacagtgccgccttaggggaaagattgattccaatggctgtgtcgctgcttttttggaggagcggttaaatatgggtctgaattttattctttctgcagagcttgaccacaggaaaaaggactacaaatttgggtttggtttgactgtgggagaatgaataaaccgaactggagctgtgttttcattgctgtacccagcttagcaagctttcttgcatctttttccttgttggagatttttctttccaaaaaagaaaagaggaaatatcgtttgtgtcgggaaacactatttacaatccacaagtagctgcagaattttcaatagtcatcaatttatttggaacttgggcagaaaaaactcgatttatttggatctattgccctgttttcccttgagggggatgtagagtgatatcagtttaatccatattgtgagatcaatttccataatgtttctagtgctcgtgtatctatccctgtcctatacttaagtttaaatgacccatgcatgcatgggatggaatcgtcgcagcaagaat

SEQ ID NO: 471 - DNA, 428 bp, Glycine max
ggatccacagaatgggtgtggtggtgatcgacggcagcaccgtgcgcgacttcgtgaacgacgaggcggccttcgcgaagagcgtggacgagcagttcggggtgctggacctcaacaacgacggcgtcctctcgcgctcggagctccgcacggccttcgagtccatgcgcctcatcgagacgcacttcggcatcgacgtcgccacgccgccggatcagctcgcgaagctctacgactccatcttcgacaagttcgacggcgaccggagcggcgccgtcgaccgccgcgagttccgggatgagatgaggaagatcatgctcgccatcgccgacggcctcggctccttccccatccgcatggtcctcgaggatgatcccaatagtcttcttcagaaagctgcagatctcgaagcttccaagacctgatga

SEQ ID NO: 472 - DNA, 3126 bp, Glycine max
ttcttgttagtggcctccttgtttttcaatggctaacccaacacaacctaatgttgggttcacccctgagagagagatttcaaaccctgagaagagtccaattccgccccctccaagttttgtagcctcatcacccggttttcctccaccaaaattgcatttacagcaagatcaagcctcttcccgttccgttaaaaccccaaacgttttatcaccagccaatggggttaccactggcagtcctgttcctcacttgagcacccctcctggaccacctgtttttacttcgccggtccgtccagctgctgttccttttcgcacatcacctgcattgcctcagccacttgcattttctccaggctcttctttgccaacatcatcatcgccgctgcaattttcaaatggaacatttgagtcacagcaccaagtttctgatagtatagaggaccatgttcccttgggagagtcatcctttgttcttttttcagctcataaggtattgaaacagaagaaacaagctaatgtacccagtttgggttttggggcattggtctctcctgggagggaggtttcagtgggccctcaggtaatacagcgtgatcctcatcgctgccaaagctgtggtgcttatgcaaatatatattgcaacatattgcttggatcaggccagtggcagtgtgttatatgtcggaaactgaatggaagtgagggggagtacattgcgcatagcaaggaagatcttcacagatttccggaattatcttcacctatgtttgactatgttcaaactgggaacaagagacctggttttgttccagtttctgattctagaatgtctgccccaattgttcttgttatagatgaatgtttagatgaaccacacctacaccatctacagagttctttgcatgcttttgttgattctctcccgccgacaacgagattaggaattatactatatggtcgtactgtatcagtgtatgatctttctgaagaggctatggcatctgctgacgtgcttcctggggacaaatcaccaagtcaagaatctttgaaagcattgatttatggtactggtatatacttgtcaccaatgcatgcttcgctggctgttgcacattccatattttcatcattgagggcatataagttgaatgtaccagaagcttctcgtgatcggtgcctaggaactgctgttgaggttgctcttgctataattcagggcccatctgctgatctgtcccgagggttggtcaaaaggtcagggggaaatagtagaattattgtctgtgctggcggaccgaacacttatgggcctggatctgttcctcattcttttagtcaccctaattatccttacatggaaaagacaggaattaaatggatggagaatcttggtcatgaggctcatcgacacaatactataattgatattttatgtgctggaacatgccctgtaagagttcctatcttacatcctcttgcaaaaacatcaggtggagttttggttctgcatgatgattttggggaagcctttggtgttaatttgcaaagggcatctgccaggtcagcaggctctcatggtttgttagaattgcgcacgtcagatgatattctcattactcaagttgttggtcctggggaaggttcacgtgtagatacccatgaaacatttaaaaatgacactgctctttatattcaaatgctaagtgttgaggaaacacaaagtttctctctctccatggaaaccgaaggagatatcaaaagtgattttgtctttttccaatttgcaattcagtattcaaatgtgtatcaagctgatgtgtcgagggtcattactgttagactggcaacggtagatagtatttctgcgtatcttgagagtgttcaggatgaagtggccgctgtactcattgctaaaagaaccctgttacgagcaaaaaaccattctgatgcaattgatatgcgagcaacagtagacgaaagaatcaaggacattgctctaaaatttggctcccaattacctaaatcaaaacttcatagcttcccaaaggagctttctctcctaccagagctccttttccatctcaggagaggaccactattgggaagtattattggccatgaagatgagaggtctgtgctgaggaacttgtttctgaatgcatcctttgatctatcactcagaatggtagctcctcgttgtctaatgcacagggaggggggaacttttgaggagctaccggcgtatgatcttgctatgcagtctgatgctgctgttgtactcgaccatggcactgatgtcttcatttggttgggtgctgaacttgcagctgatgaaggaagaagtgctgctgctctagctgcatgtaggacattggctgaagagctgactgagtaccgatttccagcacctcgaatccttgcatttaaggagggtagctcccaggctcgatactttgtctctcgtctcattccagctcacaaggatcctccttatgagcaggaggcaagatttccacaactgaggtcgttgacatcagaacaacgaacaaagctgaaagccagttttgttcacttcgatgatcctagtttctgtgaatggatgcgaagtttgaaagtggtgccaccacaaccaagttgatgatggagaccatctaaagggtcttaggcgctgcatgttccaactcgttcgttattctttgttaagttggtgaagtcaagtttgcttgcatgatttggggaacacaatgagatagacttttgcctcatagcctcctcccattcattttgttcacttccaaaagatttttaggtgcaaaaaagagtttttttttttatattttttttggggggcggcggggggtaaggaatgactgtgacaaagaaaattttcacaatttacggttaagatgttaccgtagagcaataaaaggatttctcgttatttatatttataccacttgttggttgccaagtgtttttattcaatctctttctttagtctctcatagtctcattcctagtgcctgattgttttccattttgtgcacttgattttaattttaactatcgaacatgagtgagatgccttttaactattgaacatgattgagatgcgtttaa

SEQ ID NO: 473 - DNA, 1043 bp, Picea glauca
aagaaatgggggcgtttgcatgtgtgggtttgcttttcttcattgtattgtcctcagttgaagcatggaggccatggcctcaatatttcaatcagactactactgctttgggactgaaacagcagcccaataaggcagatttgcagttcggggcttcgaagaagcatgaagggtcctcgccatatgtgaatatgaggtaccatatgggccctgtgctgacttctgctatcaatgtccatacaatttggtatggaaggtggagtaagaaggagaagagggttatcaatgagtttctgctatctatctctaataatacgaagagcccttctgtgggtcagtggtggcaaacggtccagctctatactgatcagactggtgccaatattagcagaaacatagttattgctaatgagcacgaggattactactcccatggtaagatactgagtaggctgactgttcaggaagtgataaagaatgccataaccaccaagagtagtccccttcccattgatcccaagaatggtctttaccttctcctcacttctagtgatgttgctgtccaggacttctgcagagctgtctgcggatttcattattttacattcccatccattgtaggatacacactgccttatgcgtgggttggacactctggaaaacagtgcccggaagtctgtgcttatccttttgcagtgccaagttacatgactggaatgaaggcattcaaggcccctaatggggatgttggtatcgatgggatgataagtgtgattgcccatgaattggctgagctttcgtcgaatcccctgatcaatgcctggtatgctggtgaagatcctactgcccctactgagattgcagatctctgtgaaggcctttatgggactggaggcggtggatcttacactggacaagtccttacagacaaatttggggccaattacaatgtcaatggcattaggaggaggtatttagtgcaatggatatggagtcctattatgagtgcctgttctggaccaaatgcattggatagctgatga

SEQ ID NO: 474 - DNA, 2923 bp, Helianthus annuus
ccctaacactatcacagaaatggcgggaggaaataccggtggagagaaccgtcccaacgagtcgccgtcatcgtcagatcacggcggaaacctaaattccagtcagtttaacggcaatccaccgtccacaccagattctcctacctctgctggattcaacacagatcagcttccgttcaacagccgtacgtcggaaaactactcagattacgacgacgatgaagccgctgtcgatccggatatcatccctgacgaaccagaagatatcggtgatgaagaaggtgaaggtgaaggcgaagacctgtacgacgataattacatcaatgattaccggaggatggaagagcacgatcagtatgaatcggttggattggatgaatcgcttgaggacgagagagatctggatcagattatggctgatcgtagggctgcagagatggaacttgatgctagagacggcgttgcttctcaacggaagctacctcatctgcttcatgatcaagacacagatgatgaaagcattcgtccttcaaagaggactagagctgattttagacctcctcctagtccagcatttagcagtggtggtggcggcggtggaggtggtgatgacccacccactactgatcagacagatgatgatatgtttgatgatgatgataacgatgaaggtgagttcgagatgtatcgtgttcagggaaccctaagggagtgggttactagagatgaagtgcgtcgttttattgctaagaagttcaaggaattcttactcacttatgaaaacccaaagacccatgatcatgattatcttacacaaataagggaaatgattgcagtcaacaagtgcagtctggagatcgactataaacagtttatatacacccacccaaatattgccatctggctggcagatgcaccacagtctgttcttgaggttatggaggaagttgctaataaagttgtatttaatataaatccaaattacacaaagattcaacaaaaaatctatgtcagagttaccaacttacctgtttatgaccaaattcgcaacataaggcaaatccatttaaacactatgattcgcgtaggaggtgttgtgacgcgaagatctggagtttttcctcagttacagcaagtgaaatatgactgtaacaagtgtggggccgtcttgggaccctttttccaaaattcatattcggaggtgaaagttggctcctgcccggagtgccagtcaaagggaccgtttacagtcaacattgagcagactatatatcggaattatcaaaagcttacccttcaagaaagccctggcattgttccagctggcagattgccacgatacaaagaagtgatacttttgaatgatctgattgattgtgctcgccctggggaagagattgaggttacgggaatctacaccaacaactttgatttgtcactgaacaccaaaaatggattccctgttttcgccacagtgattgaagcaaaccatgttacgaagaaacaagacttattttcagcgtataaacttacccaagaggacaaagaagaaatagagaggttgtctaaagatccacgtattggagaaaggattgtcaagtcaattgctccatcaatctatggtcacgaagatataaagaccgcaatcgcgcttgcgatgttcggaggtcaagagaaaaatgtgaacgggaaacataggttgcgaggagacataaacgtgctgctgttgggtgatcccggaactgcaaaatctcagtttttgaaatatgttgaaaagacgggtcaaagggcagtttacacaactggaaaaggagcttctgctgtaggtcttacagcagcagtgcacaaggatccagtcacacgtgagtggacccttgaaggtggggcccttgttttagctgataaagggatatgtctaatagacgaattcgacaaaatgaatgatcaagatagggtaagtatccatgaggctatggaacaacaaagtataagcatatctaaagctggaattgtaacttcacttcaagctcgatgctctgttattgctgcagctaatccaattggaggaagatacgattcctctaaaaacttctcacaaaatgttgaattaacagatccaattgtctctagattcgatgttctctgtgttgtgaaggacgtggtggaccccgtcatggacgagatgcttgcaacgtttgtggtggatagtcattttaaatcaaaaccgaaaggtgctaacttggatgacaagtcggtcaacaattctcaggaagatattcacgacactgccatgttagcagatcctgagatactttctcaagacatgttaaagaagtacatcacatacgccaagttaaacgtattcccaaggttgcatgatgctgatttagacaaactcacaacagtctatgccgaattaagaagagaatcatcgcatgggcaaggagtaccaatagctgtaaggcacatagaatcaatgatccgaatgtcagaagctcatgctcggatgcatctcaggcaacatgtcactcaagaagatgttgacatggccattcgtgttctgcttgactcgtttatttccactcaaaagtttggagtgcagaaggcccttcaaaagagctttaaaaagtatatgactttcaagaaggatttcaatggaattgtgttgcatctacttaaccaactggtgaaagaggcgctacgtttggaagagatagtttccgggtctaggagagatgttacacatgtggatgtgaaggtggccgacttgcaaaacagggcgttggattacgaaataaccgatctgaaggagttttttacaagtacggatttcgagcgtggtaactttgagctggatgaagaaagaggtgtgataaggcatctgcttgtaagatgaaccaagtgttgtatggttgaaacttag

SEQ ID NO: 475 - DNA, 1330 bp, Helianthus annuus
cctcttactaaccattcccaaccataaccatgaaagactcaccaaaaccatggaaaccacactgttgttcatctgaaagcaaggtttcattcagctttagccggtgcaggccctcgagatcagagttttccaagaatgtagcaccatgtccatcttttagacgcttgtctttctcggaccttagcaggtcttcttctatgcgcattaatgaagacatagcgcaggcttttgggccggatttgattgactttaaattgagtgagttacgagccatgactcagaatttctcgagcggttttttgttgggtgaaggtgggtttggtaaggtgcataagggctatgtggatgagtgcatgaggactggtttgaaggctcaacccgttgccgttaagcttcttgatattgaaggactgcaaggtcatcgcgagtggcttgcggaggtgatatttcttggtcaacttaagcacccgaatttagtgaaactgatcggctattgttgcgaagaagaagatagacttctcgtatatgaattcatggcgcgtggaagcttggaaaatcatttgttcaaaagaatttctgtttgtctaccatgggggatcagaataaaaatcgcgataggcgcagcaaaaggtcttgcgttcttgcatggtgccgagacccctgttatatatcgcgacttcaaaacatcaaacatcttacttgattctgagtttaatgccaaattgtctgattttggactggcaacaatgggtccagaagggtcaaacactcatgtcaccacaagagtcatgggcacatatggatatgctgcccctgaatatgtcaacactggacacttaaccacgaagagtgacatctatagttttggagtggtgttgctagaactgttaacaggaagaagagcaatggataaaaacaggccaaaacgcgagcagaatcttgtggactgggccaaaccgtacctgactagcagcagaagaattcgtgcagtaattgaccctaggttgggaggtcaatattcagttagaggggccaaggagatggcccttttagcattgtattgtgtgagtccaaatcctaaagacaggccaaagatgccttcaataattgaagtccttgaaagtgttaagcatttcaaagacatggcaatcacttgtggacaatggccccctgcttcacaaaagacctcacgaaacgcggtttattcgccaaaagatgcgaaagagatcaacggggggcggatttactggaaacagactcctgttaagaccgtaaggtcaagagggtaattaaccgacatgaagattgagtagagcggaagaagaacatg

SEQ ID NO: 476 - DNA, 765 bp, Helianthus annuus
catcagcccacatattcttcacatttcaaaaccccattatttctgtgcgttggtcgttggagatttgactaaaaaaaaaaaggaagcgttccctccacgcgccgcccacgagcctataaatacaaccaccaacccacacaatcctcattgcaatttccaccgtcaatatgcagactctgcaacagaaagcttccgaatggagcggcgttaagcaggaagacgcctttgctattgaccaagttaatctttttgacaaattagggctccaacctttcatcaatctatctactgatttttacacaagggtttatgatgatcaagaagagtggtttaggtctatttttgccgattcgaagaaggaagatgcaattcagaatcaatatgagttttttgtgcaaagaatgggagggcctcctttgtactcccaaaggaaaggtcaccctgctttgataggccgccaccgcccttttccagtgactcataaggcggcagagaggtggctacaccacatgcaacaagcgttagataacgccactgacattgatcaagaatcaaaaaccagaatgctaaatttctttaggcatactgcatactttttggtggctggaaatgatctaaaaaatgaaagccaaggacctccaccttgtaagcatggaaataacgaaccagctgcagattaatttttttttttttttttttgggttcagaaaagaagtgatttaaacagatttgttacccaaaagggacacaaatgcatgtaccttc

SEQ ID NO: 477 - DNA, 842 bp, Helianthus annuus
ggatcccatccgatcatggccaacattagggcttttttcatcctcgctcttcttcttctctcttcttctttcttccttcaagttgctaggtctcagtctgatccggacgcagaagcggatgccgaacttgtggcggaaactgtcgaggaaggaagtcatgttggtgacgatgttgaggatatcggtattgggaattataatccggctcctggtgtggaaaccgtgtcggttttccctaaaaactttgcgaaattggtagtagcagggcaagaaactgaacttttgattggattgaaaaacgaaggagaacaaaacgttaaggtttttgctgttcacgctagtgttcatcttcctttcgatcatcggatgttggttcaaaacctttctacagtggctttcaacgatgcatcagttcctgcttcagttcaagctacatttccctatacatttgccgtcagcaaattcttgcagcctggaacatttgatcttgttgggacaatagtgtacgagatcgaccaactaccataccagaacgtattctataatggcacgattgaagttaccgaagccggtggtcttgttagcgttgagaccgtgttcttggtgtcacttggacttgctcttcttgtgctcttcggcttgtgggtccgcactcagctacagtctctttccaagaaaactaagaagataaccaaggtggaagttggaacccgaactgttgatgcatcaatggacgagtggctgcagggaactgcttatactcaatcacaatcgaataaactgaagaagaagaagtagaggagtagttttcgatgttgagcaaaggtagtcggttggaattc

SEQ ID NO: 478 - DNA, 725 bp, Helianthus annuus
caatatccacattcaaatcaaaccaaaaatgtctcttgtgacaaaagcaattagggaaagtgcatcagaaatttatcatggtgatgcaatttgtcaagaaaaatcaaaggaattactaaccgaaatgggactacccaatggtcttttgcctttagaggacattgtggaatgtgggtatgtcaaagacaccggttttgtgtggcttatacaaaagaaagagaagaaacacaagtttgaaaagatcgggaagcttacaacgtatggaacggaggtaaccgcatatatagagaagtttaagataaagaaactcacgggtgttaagtctaaggagcttttgatgtggatcacactgagtgagatcactcttgataatccgcccactggaaagatcaactttaaggccacttctggcctttacagatcttttccagtatcggcttttcaacttgatgatgtgaagaaagatgttggaggcgcgagtgtggctaaggatgcccaagtgaaggaggtttgagctagtgaagaagtttaatataatatataacaatatgaagtaatatttatgatcactttcattttatgatgtaccatcttatcaataattatagatctaatgcatcatgacttttgtttcaaacatgaagagtaaatgtttttgtgtcactacaaaatagttatcttgcaaaatatgcttaattatcaagaatcagtcaagtttgggtcgt

SEQ ID NO: 479 - DNA, 1770 bp, Helianthus annuus
acttctattttcatcaattttcagtgaaattgattctttttgctcatggcggaagagacgttgaacaccacggcggctgcggcggagtctacggcggtgacggcggaagttgccgtggctccagaggcggagaaggttgaagaagctgcggtggtggtttgtgaaaaggatggatcgccggagacggagaagatctctgaatcgacgtcgtttaaggaggaatcgaatgttgccggtgagcttcctgatccggaaaagaaagcgttagatgaattgagacttatggttcaggaagcgcttaataagcatgagttttctgctccgccggcagcggcggcggaggagaagccggtgaaggaggaagttccggcaaaggaggagaaagctactgctgttgttgaagaagaagctaaggcttgtgctgaggccgccggaaaggatgaatcgactccgtctcaggcgacggcggtcacgccggaagttgtaccagtgacggaggttccggaaccggagaagacggtgtctgaaacggagacagaagttaccgaaccggagaaaaatgtgaccgaaccggagaaagaggtgctggaaccggagaaggaggtgccagaaccggagaaggagacaactgaaccggagaagaaggtgactgaaccggaaacaaaagagaaaactaccgaaccggcgtctgaaccggaaccggaagaagtttcaatttggggaataccgttactagcggacgagcgaagcgacgtcattctgttaaaattcctgcgagcacgagacttcaaagtaaaagaagctttcacaatgctcaaaaacgtcgtcgcatggagaaaacagttcggaatcgaatcactgttgtcagaagatttgggaacagaacaagaaaaagttgtttacatgcatggagttgacaaagaaggtcatccagtatgctacaatgcatatggtgagtaccaaaacaaagaattgtacaatgaaacgttctcaactgaagagaaaaggacaaggtttctgagatggaggattcagtttctcgaaaagagtatccggaagctcgattttagtccgaatggagtgtgtacgattgttcaagttatcgattttaagaactcgcctggaccgtttaagtgggagcttcgtcaagctactaatcaggcgcttcagttgtttcaggataattatcctgaattcgttgcgaaacaggtgtttatcaatgtgccttttctgtacttggctttctataagattatcaatccgttcttcacacaaaggaccaagagcaagtttgtgtttgctggaccttctaagactgctgaaaccctcttcaaatacatagcacctgagcttgttccagttcaatatggtggactcagcagggaaggcgaatttgtctctactgactcagtcacagaagagatcatcaaaccttcaaccaaacacaccattgagatccctgctcctgagagttgcacattggtatgggaggcaagagtggtggggaatgaaatgacatatggagccgagtttgtgcctgtgtctgcagacagctacaccgtgatcgtgcagaaatcaagaaagcttgcagctgccaccaatgagccggtgatcagcggccagttcaaatgcgatgaaccaggcaaagtggttctgacctttgacaaccaaacctccaaaaaaaagaaggtcctgtacagaagcaagaccaaggtgactgaatccatcaagtgctaaagccagaaccaaggcaggggatgtttgttgtag

SEQ ID NO: 480 - DNA, 2582 bp, Helianthus annuus
cataaccgcttcttctcctccgcattttcctgaattccggcgactattgcggggggagagattcgtatccactcgtaacacaattgcttcttctgtatgtcagtagattgtacgcactgcaacttttacggtggatttggtgagcttgctaaccctctgcaatggccgcaacttcgcaaaaggcgtcgcattcttcttccgatgattccgtctccgttcaccgccatgtggtctccgatgactggcggaacgatgatcagaacatgccgatcaagagttcttccattgtttcgttgattaatccgactgattctaacgccaatgcttctgccaaaggaatccaaattctcacaagggctcaaactagccatcctttggatcccttatcagctgctgaaatcaaagttgctgtggcaactgtaagggcagccggagcaacccctgaggtgagagatggtatgcggtttgtggaagtagttctgtcagaaccagataaaaccgttgtcgcactcgcagatgcatactttttcccacctttccagccttctttattaccccgaaaaggtggagctataatacctagtaagcttccgccaaggcgagccaggcttgttgtttacaataaaaagtcaaatgagacaagtatatggattgttgaactgtctgaggtacacgcaacaactcgaggtgggcatcatagagggaaagttatttcatcgaaaactattcgggatgttcagcctccaatggatgctgtggaatatgctgaatgtgaagaagttgtgaaagattaccctccctttcaagaggctatgaagaagaggggcattgaagatatggatctggtgatggttgatgcttggtgtgttggctatcatagtgaagctgatgctcctagccgcagattagcaaaaccccttatattctgtaggacagaaagtgacagtccgatggagaacggatatgcacgtccagttgaaggcatctatattctcgttgacatgcaaaatatggttgtactagaattcgaagaccgtaagcttgttcccctaccacctgctgatccgttgagaaattacactcctggtcatactcgaggtggagttgacagaagtgacgttaagactctacaaattatccagcctgatggaccaagtttccgtgttaatggacaatacgtcgagtggcaaaagtggaattttcgtattgggttcactccaagggagggtttagtaattcattctgttgcatatgttgatggtagtcgaggccgaagacccatagctcatagattgagctttgttgagatggttgtgccgtatggtgatccaaacgatcctcattatagaaagaatgcatttgatgcaggcgaagatggcctcgggaaaaacgcccactctcttaaaaagggatgtgattgcttgggttatatcaagtactttgatgcacattttacaaacttcactgggggcgttgaaactatagaaaattgtgtatgtatgcatgaggaggatcatggaatcctttggaagcaccaagactggagaactggtttagctgaagtaagaagatctcggcgactcacagtgtcttttatatgcaccgtggctaactatgaatatggtttctattggcacttttaccaggatggaaagattgaagctgaagttaaacttacagggattctcagcttaggagcactgcagcccggggaagttcgaaaatatggtacaactattgccccgggtttgtatgcaccagttcatcaacatttttttgttgctcgtatggacatggcagttgattgcaagcctggagaagcatacaaccaggttgttgaagttaatgtcaaagttgaagaatctgggaaaaataatgtccacaataatgcattctacaccgaggaaacattgcttaaaactgaatctcaagcaatgcgtgattgcaatcagttatctgcccgtcattggataattcggaacacgaggaccgtgaacagaactggacagctgactggctataagctcgtaccaggttcaaactgcttgcctctggctcgtccagaggccaaatttctaagacgggctgaatttttgaaacataatctttgggttactccttgtgcacttgatgaaaactttcctggaggtgaattcccaaaccaaaatccacgtgtcggtgaagggctcgcctcgtgggtcaaacaaaaccgttctcttgaagaaactgatatcgtcctttggtatgtgtttgggatcactcatgttcccaggttagaagattggccagttatgccggtggagcacattggctttatgcttcagccgcatgggttcttcaactgctcgcctgcagttgatgttcctccaggagcctgcgagtcggatgtgaaagacaccgagcataaagaaaccattgcttccaagcctgtttcaaatggtttgattgccaagctttaatgtaatcatcatcaacaaagtcgactttttttatcgccccttatctatttaccatgtcgtttaaacctttttaatttgtatgattttagacgctagactttggttgtgtaatcatcatcaggc

SEQ ID NO: 481 - DNA, 1873 bp, Helianthus annuus
cttctgtatccgatcccaacacacccaagaccaaacaatgggtcgaatcaaagacatattcgtcactttcttcaacaacagatggctcgtttttgttgcagcaatgtgggttcaatcgtgtgccggtatcggctacctgtttggaagcatatctcctgtaataaaaagctcattaaactataatcaaaaacaggttgctagattaggtgtagctaaggatcttggtgacagtgttgggtttttggccggaagtatgtcggagtttttaccgatgtgggcccttctacttattggtgctgttcagaactttgttgggtatggttgggtctggcttgttgttaccggcaaagctccgatgttgccattgtgggttatgtgtttgctgatatttattgggacgaacggcgaaacctacttcaacacagtggcattagtttcatgtgttcaaaactttcccaagagtcgcgggccgattgtgggcatactcaagggatttgcagggttaagtggtgcgatcttgacgcaaatatacgcgttgattaactcaccggataaagcgtcgcttatattcatggttgctgtcggtcctacgatggtggggatttctcttatgtttattgttagaccggttggtggtcacaggcagcttagaatatcggaccggtcgagtttctctttgatctactgcgtgtgtctcgttttagcggcgtatttaatgggggttatgcttgtggaagacttggttgatctgaaccaaactatagttcaaatattgacatctattttgtttgtgctattagtgcttcccattgggattccgttatggttgactttttcgtctgacccgagaccctcggaagaagaacctcttatatccgaatcgcaaaacaaagaccaacccgaatcgtcacatgatccaaatgagattatattcagtgaggtggaagatgagaagcctgcagatgtagattcgcttccggctaatgaaaggcaaaaaagaatcttgcagttacagtcaagattggcccaagctgctgcggaaggggcggtgaggattaagaggagaaagggcccgcatagaggcgaagactttgacctgacacaggctttgatcaaggctgatttttggctcctgttttggacccttttacttggttctggctcgggtttgactgtgatcgacaatttgggtcaaatgagtgagtctttggggtacgataacacgcacatatttgtttccatgatcagcatttggaatttcttgggccgtgttggtggtggctatgtttctgagatcgttgtcagggactacgcctatcctaggcccgttgctctagctgttgcgcagggcttaatgtcaatcgggcatttattctttgccatgggttggcccggtgcaatgtacatcggtacccttttgatcgggctaggatacggggcacactgggccattatacccgctaccgcatctgagttattcggggtcaaaaagtttggagcgttgtacaatttcctcacccttgcgaatcctgggggttcactagtcttctctgggctcattgctagctatatatacgactctgaagcggagaaacaagctaaggaacgtggtgaaatcatcataaagtcaacttcttctatgcttaccaaactatttgaaacggatgacgccctaaaatgcacaggttccatatgtttctttctgacttacatgctaatgtcgggactctgtatcatagctctcatcctaagtttgatacttgtgcgccgaactaaaaccgtctaccaaaacctctacgggaaaacccgaacttgaaatccttcaattgatgaaatgatcaaaagtatcaaataccaggcgtatctcgtctag

SEQ ID NO: 482 - DNA, 1330 bp, Helianthus annuus
ccgacaccttatcatcatcatctccaccaccaccatgccgacggcaacggcgatttctctctcaatcctcttcctcctctccctcaccaccaccatccacgcccacaacatcacccgaatcctcgcaaaacaccccgaattctccaccttcaaccactacctcaccatcacacacctcgccaacgaaatcaaccgccggcaaaccatcaccgtctgcgccgtcgacaatgccgcaatgtccgacctcctctctaaaggcttatcaatccaaaccatcaaaaacgtcctctccctccacgtcttcgccgactacttcggctccaaaaaactccaccaagtcacaaagggttcaacctccaccgccactatgtaccaagccaccggcgaagcccctggcactgccggttacgtacatataaccgatgtcaaaggtggcaaggtccgtttcacacctgaagataatctctcccaaacagactcagtgtacgtcaaatctatactagaaatgccgtacaacatttctgttatacaaataagttctatattacaatctccagaggctgaagcgcctactgccgcaccagatctgaacctaacctcgttgttagaccgagatgggtgtcagtcatttcataacctgttaactacttcaggtgcaattgggacattcttaagcagtgtagaagccggtgtaaccgttttctgccctgatgatgacgctataacagcttttgctccaaaatataaaaatctaactgctgcagaaaagacatctttgttgctgtaccacggaattcctgtgtataattccatggggatgctacggtcgagtaatgggttgatgaacactttggctactgaaggagctaaaaagaagtatgactttactgttcaaaatgatgggaatgatgttaagttgaagacgaaagttgtgacggcaacggttactggaacggtggtggatgacgagccgattgcgatttatactcttgataaggttttgcagcccagagagttgtttaaaggcgcggttgaggaagcggatgaaccggcgcctgcccccaagggggcgaagaagaagaagaaggcagcaaagaaaggagatgaggcggaggaggatgccgaggcgcctggaccgggttcggatgaggattatagtgatgatgatgcggcggatcagacggcgagtagtggtgaaagggttgtggcgatggtgtcggtggtggttatggcggtgttgttgagtttgttttaattttttatttttttttttcattttttattttggtttttttttgtgtgtcggtgtgataaagtgacagcgggttag

SEQ ID NO: 483 - DNA, 1437 bp, Helianthus annuus
accacccacgatattgatattaactgcaacgcccaatctcgttcgtcaatgccgatagatcaagccgacctcaattccgatcaggttttgaggagggacattccatgggagacctacatgacaagtaagctgatcacaggaacagcccttcagctactaaggcgctatgacaaaaagagtgaacatgatagagcaccactgcttgagaatgatggtccgtcttatgttcgtgtgtttatcagcatcttgcgtgacatacagaaagaggacactgtcgaatatgtgttggctttaatcgacgagatgcttacagaaaaacccaacagagcaaagttgtttcatgacaaatctcttgcagatgaagatatttatgaacctttcttgagattgttatggaagggtagctggtttactcaagagaagagctctaagatacttactttagtcgtgagtgccaggccaaataagaatggtttgaccgcaaatggaaaagccacagattcaaagaagaaaatcaccacaagtgatgatgttttgaaaggattagttgagtggctttgtattcagctgaaaaagccttcccacccaaaccgtagcattcccgtttctatcaactgtcttgcagctttgttaaaggagcctgttgttaggtcttcatttgttcaagcagatggtgtaaagctgcttgtgccactaatttctccagcatccactcagcagtcaattcagcttctgtatgaaacatgcctctgtgtttggctcttgtcctactacgaacccgcaatcgagtacttggctacatctagagccctgccacggttgtcggaggttgtcaaaggttcaacaaaagaaaaggttgtgaggttgatagtgttgacattcaagaacttgctttcgaaaggaagctttggtgctcagatggtagatattggactcccacaaattgttcaaagtttgaaagcacaagcctggagtgatgaagacctcttggatgctttaaatcaaatggaagaagggctgaaggataacatcaagaaattgagttctttcgataagtataagcaggaagtccttctcggtcatcttgactggtctccgatgcataaagatcctaatttctggcgagataatattacaaattttgaagagaatgatttccagactctaagggtcctgctcacgatactggaaacatcaagtgatccaagggcactagccgtggcgtgctttgatctgtcccaatttattcagtaccatcctgcgggccgagtcatagtcactgacctcaaagcaaaagagcgggtcatgaaactgatgaaccacgagaatgccgaggtcaccaaaaacgctttgctctgcatccaaaggctgttccttggtgccaaatacgcaagctttttgcaagcttgatatgcatctctcatggggccttcttag

SEQ ID NO: 484 - DNA, 779 bp, Helianthus annuus
ttggttgagatgatgcgtatgatgtgagcttcaattgttacctgttaaatttgtagaagaaattgttgagaaattggaaacatgatgtcccctggaattaacttggtgatgactgtaatcggatttacagtgagtactatgtttatagtgttcgtgtgtacgagacttatatgtgctcgtattcattacatatcttccagaagatcctttcgtatgtcttctagatctgatctcaacgctatggagcggggcatgcgtggtgctgaaacttttgttgcagcaagcttccctacaaagaaatatagcgatccgtttttttcgtgctcaaaagatgctcaatgtatagtttgtctttcagaataccacgcagatgacacccttcgtattctgccctcgtgtggacactttttccactcatcgtgtatcgacatctggctgcagcagcactgcacgtgtcccgtatgtcgagtctcattgcgtgaagtttttgacaaaaggtgcttaatgcaacccatgttcagttcggctgtcagattcccatcaagcgcggatgacagccgtaggatggacccaaccactaatggtcaaccaaggtcaactggcaacgtacaagaagcgggactacacaactcaaacgtcagtgagaacgttcctgctggctcaaaaagtcccgggaacaaacaatttgaaagcccgtcggatgtttaattaagatcaccacatatgtgtgatcaaagtttgtagcttttgagtgatggtaaagtgtgaaagatgttggg

SEQ ID NO: 485 - DNA, 1375 bp, Helianthus annuus
aacattgcctccgtgtctccttgaggtattcaatctctctggtgccactcttccacacatacaactaactgccttcagtacaaatggttatcgcatctgctagaatcagtacttgtggttcaatggaactagctccagcttcattcagtacgcgacatgtaggtcgtgactgtgttcatctcaaaagtacgagttcccagtggctgaagaagccgcctcgatggtttggtttttcccatgtcaaaataagtaaatttaatcattcagcttgctcggtgagtatggtgtcaaataattatgttggaagaagcacgtacagaattaaaaaggataatgatgataagatatatcggaggcttgattcttgtttagttattcctccacctaaaggcaagaagccgaaagccgttattaaattccttggtggcgcctttattggtgcagttccggaagttacctatagttatcttcttgggctattggcaaatcaaggctatcttatcatttctgtgccgtataacgtaacttttgatcactcgcaagctgcaagagaagtctatgagaggtttcattcctgcttgaattcaatactaacatcaggattgcctgatgatggcctgttagcagccgaacttgttgatcttcctctttattctgttggtcatagtaacggtgcgctacttcaagtactcactgggagctatttttcggataagctaccaaaggctaatgccataatatcatacaacaacaggccagcaacagaggcggtaccctacttcgaacagttaggccctctagtaagccagttgatgcctgtcgtggaagcatctccggtatcttccatggctaagggtgctgcagatgcgtggaaagccctgcttgatacagccgaagcgatgacgcctgattatgatcccgaagctagagtttcattggacaagtttgttgatcagttgccttcagtttttaatcaggttgctcaaggaatatcggaattcaaaccaacaccaactgaaaaccgtgaatgttgcaagaactcgtataatgtcaagaaaacactcctggtgaagttcaatactgatgccattgatgagaccgatcttcttgaggagactttgaggcctcgtgtggaagctataggtggaacgcttgaaaaagtttcattgagtggtaaccacatcacaccatgcatccaggaaccaaaactgcaagtaggtgatgtatacactccagcggacgcgatcgcgcaagggcttaagaatctttcgctaaatgagactaaagtcgcggccagaaccattgcagactggcttagcagcattagttagtaattgtaagtgctagttactttgaacttaactagcttcagcca

SEQ ID NO: 486 - DNA, 1904 bp, Helianthus annuus
catccttgtgcataatttgttccccacaaccacacatccatgacataatttcagaaagttgaatataaagatttgaagaaatgtcatcttacataagaagttcagaaaatgcaagagattcaactccaatgctctacttaagagaacctctacagcaatcatactcatcggaaccacccattctcgccggaaacgagataatgtatatgaactactcatcatcttcagccggagagttttccggttcactcgctggaaactcccagcagctcaacagctgcattgacattccaaacataggagttcatgattccaacgttgtatcgcatcaagaactcctctcgagcattggcgaaccatggagagatggtaggaatcatggaatgatgttaatggatcaaatgggtagtcgaaattcgcaaggacaaggactatcactgagtctgggttcgcatattcaaccggccggaatccaattccattccggtgattacaggaatcccaacatggggttctcttcgtttttgagtgcggattccgactctatcaaaacagatgtttctaattctccctatggaatgggaaatgggtcgagggggattacggattcgaagtacttaaaagcggcacagcaactgcttgatgagattgttaatgttggtaaagctttgaaacagcataatgctaggaaagaagcgatggattattcgaaagagatcgatagtgaagcgaagaatgtagcgtcgtctagtcaacaagaagcgaacgaactctcggctgctgaaaaacaggatttgcagaacaagatgatgaagttgatctctatgctggaagaggttgacagaaggtacaagcaatactatcatcaaatgcagattgttgtatcggcatttgatgtgatcgcaggatgtggggctgctaagccctacacagcactcgcgctgcaaacgatttcacgccatttccgttgtttgagagacgcgataaatggtcaaataaaagcgactcatagaagtctcggggagactgattctaccgcaaatgagaaaggagtcgggatttccaggcttcggtttgtggatcaacagctgaggcaacaacgagcacttcagcagctcgggatgatgcaacaacatacttggagaccacaacgaggccttcctgaaacctctgtgtcgattcttcgtgcttggttgtttgagcattttcttcatccgtatcctaaagattcagacaagaccatgctagcaagacaaactgggttgaccaggagtcaggtctcaaactggtttataaacgcaagagttcgtttatggaagccaatggtggaagaaatgtacaaagaggaagctggagatgcagaaatagaatcaaattcttcatcagaattcgcacccaaaaccacgaaaggcgatcgaaagacttctgttgaccaagaagatctgaaccaaagcactgcagcctctggattcgactcaaatcaagctcctaatgttgaattaataggaaccagcaatgactcggatttccaacacatgatggttcaatcaaacagaggtgaacacgagcggcttatggcggcagcatatcagatgccaccacagttagtatcgcttacactcgggttaaaacactctgaagatggtggcttaccaccaatggcttctcatggaagaggtgacggtgacagtggttcgtcggtggggccagaggcggtcgattttgacggtgtgagttcagataaccaacaacaacgttatggatcttctcacttgttacatgattttgtagcatgagagaacactggcgggtggctttattcgaatcatcaaatgaacattttgttaaactgcttgatttattatcaagtagtgtgaagaaaacaggacgcgaaacagaaacta

SEQ ID NO: 487 - DNA, 1523 bp, Helianthus annuus
gcatcatgagtagttctctgaactatgatgcactaaatttcaaactcatattcttcaccatcctccttatcaacgcaaccgcattgactaaccaaaaccaaaatcctaaatccaactcaactcagactcagatcaactccaactcggtcctcgtcgcccttcttgactcacactacaccgagttatccgaactcgttgaaaaagctcttcttctacaaaccctagagcaagcagtttcacaacacaacattaccatctttgctcccaacaatgaagctctcgaacgccacatggatccagaattcaaacggtttttactcgaaccgggaaatctcaaatcactacaaaaattattgcttttccacatcattccgacccgggtcgggtcggaacaatggccgggtcaggatactggatcagtagcagtagctcatcataaaacgctctgtgtggaagaatccgaaaatcgtttaccgttgacccgtggaaattccggggagaaaatagtgggtgggctagcgaaagttactcgacccgacgacgtgacccgacccgacgggttgatccatgggattgagagactgttggtacctagatctgtgcaagaagagtttaaccggagaagaagtttgacttcaatttcagcggttttacccgaaggagctccggtagtggatccgagaacacaccggttaaaaaaacccgctccagttccagctggagctccaccggttctaccaatatacgacgcaatggcaccgggtccatcactagctccggctccagcacccggacccggtgggccacgtcatcactttgacggtgagagtcaggtgaaagattttattcaaacgctgttacattacggtgggtataatgaattggcggatattttggtgaacttaacgtcgttagcgacggaaatggggagattggtgtctgagggttatgttttaacggtgttggctccgaatgatgaagcaatggcgaaacttactactgatcagttgagtgatccgggtgcaccggaacagataatgtattatcatttgattccggagtatcagacggaagagagtatgtataattcggttagaaggttcgggaaggttcagtatgatactttgagattgccgcataaggtggtggcggaggaggctgatgggtcggttaagttcgggtcgggtgagggttcggcgtatttgtttgatccggatatttacaccgatgggcggatatcggtgcaggggattgatggtgttttgtttccggtggaggagacgaaggagaaaccggctagtaaggtttctccggcgacggcgactaaggtcgttgcaaaccaaagaagagggaaattattggaagtagcatgttcgatggctggcgtattcggacattttacaagttgtaattgatgtatacatacatatatattatgcaaaaaagttgaatatgttaggaaaactgtgtggaaaataggacataaatgggaaacgaatggtgcagtttggcatggaaggtga

SEQ ID NO: 488 - DNA, 1029 bp, Solanum lycopersicum
ctttgcacttcgaatagcagtcttttttgctctcttacttcgcccccagtttttcagcttttcaaacaatcatcaatggagttttggggtgttgaagtgaaagcaggacaaacactaaaggttaagcccgagcttttcaagctcattcatatttctcaggctgccataggtgaagtgaaggatgtcaaagaagccaaatatgttccactacgcctaactgttggagataacaaatatgtcattggaactctatctgctgaggatagacctcagttgatgtttgacttggtctttgaaaaggagtttgaactttcacatggatggaaaaatgggagtgtgcacttcatgggatactctgctgatgatccgagcagtgaggaaattgactctggagatgatgttttttccgatgaagagaatgttatggaggcactgaatgggaaacttgaggctgatgtgaaggatgtaaagcctgatgcaaagaagtctgcacctgcgaaggatgagaaaaatgctaaggtagctgaatcaaagaaagagacggaatctgatgaagatgatgacgattctgaagatgactctgatgatgaagacgattctgaagatgactctgatgatgtgcctctaggcatggatggaccagaagggatggatctttctgatgattccgaggatgatgatgattccgaggaagatgatgattcagaagaagagacacctaaaaaggttgagcagaagaagagaccagctccatctcctaaagtagctcctggctccggcaaaaaagctaaacaagcaacccccgacaacaagtcaggtggtaagaaaggtccagccaccccttctgctaagcaaaatggtaaacctgcattcaatggtaacaacaaaccgaaaactcagtccccaaaatctggtggtcagttctccggcaacaaatctaacaacaagaacttcagtggccaaaagaacttcaagggcaagcaaggaaggaagtagagtgcttggaagatgttgttgaagagcaaatag

SEQ ID NO: 489 - DNA, 2397 bp, Solanum lycopersicum
aaatagtggtgtaattctctgggaagtatataaaagatgtatcttaactgaacatcaacgacccttttgtctactccattaactcttcttcttcttgttatttctgcttcagtttcaactatggaagaatctctgttgcccggagagagtagcagcaacagttggggacggattcggaatcggaggagggttggttccatgtttgatcccagagatgctattgctcatggatctgcttatcaaaaagctgctgctttagttgatcttgctgaagatggcgttggtctacctgaggaaattcttgagggaacgagctttgaaaaggcagcacaattgtacttcatgtttactcgttttgacttcctctggtcacttaattatcttgcactagtacttataaacttctttgagaaaccattgtggtgctccaggcatttagctgagtcatgcaataatagagactactactatctaggacagctgccatttttgactggtgctgagtcccttatatatgagggtgttactcttcttcttcttgttatacacattttatttccaatatcatatgaaggcttccatctctactggagaagtcttctcaacagactgaaggtcgttttgctgttaatcttggttgcggatattgtggtctacattctctttctagcagacttctattatcttccattccgtattgcatcctatctccgtgtggtgttctttattttgaatattagggaattacgagatagcttcttcatccttgcaggaatgtttcggacctaccttaatgttgtggctttaactgcgttatttcttctattctcgagctggttagcatatgtcttctttgaagacacacagcaggggaaaacaatgtttacttcatatggcactacgctgtaccaaatgtttgttttattcaccacatcaaacaacccagatgtctggattcctgcatacaaggaatcacggtggtattgcttgttttttgttctatacgtgctattgggcgtttactttgttaccaacttagttcttgctgttgtatatgatagcttcaaaagtgagcttgtaaaacaagtagctgaaaaagatcgacggaagctaaggactttgaagaaagcatttagcttgattgatgacagcaacactggggtcctcgacaagaagcaatgtatccttctgtttgaggaacttaacaaatacaggacattgccaaaaatatcaggagatgattttgagtcaatattcaatgagctggatgatactggtgactttaagataaatttggaagaatttgccgatctgtgcactgcaatcggactaagatttcagaaggaagattcactgccaatctttgaagcatgtccgaatttctatcattcagcagcatctgagaagttgagagacttcgtccgtggcgatacatttgagtacataatagtgtccgttctcctggtcaatcttgttgctgttattattgaaaccacgctcgatattcagaacaactcaggtcaaaccttttggcagaaggtggagttcacatttggctggctgtatgttatcgagatggcactaaaagtgtacacttacggttttgagaactattggagggatggtcaaaatcaatttgattttatcgtcacttgggtcattgttattggagaaacagctacttttgtagcccctgatgatctgacctttttgtccaatggagaatggattcgttatcttcttatcgcaagaatgttacgattaatgagactcttgctgcacgtagagcgatatcgtgcttttgttgccacatttttgaccctcataccaagtctgatgccgtacttggggaccatattctgcatcttgtgcttttattgctctcttggtttacagatctttggtgggattgtcaacgctggaaaccccaatttagcccaaactgagctttctgataatgactatttgctttttaacttcaatgactatccaagtggcatggtcacagttttcaacatattggtgatgggaaattggcaagtgtggatgcagagctacaaggaactaacggggactgcctggacttatgtctacttcgtcagcttctatcttatctcagttttgtggctgttgaatttgattgtagcatttgtcttggaagctttccaagcagaaatggatctagaggctgcagcaaactgtgcggatggtgatgacaaggaatcaagaagtgagcggagacgtaatgttggcactaagactcggagccagcgagtagatttcctcctgcatcacatgctgagttctgaactaacagaatgctcccatgacgatccataagtttactcctccttttcttcatgctgctttatgcagtcctgtgaacatcagaagtag

SEQ ID NO: 490 - DNA, 1159 bp, Triticum aestivum
gggtgtcttcctcgtctgtcgcgggtctggttgttgctccatgtcggcgggcgacggcgcggcggtgtcggccgtcgaggggaagctcgcggagctctccaccagctgcgacctcaggaccctccccaagaggggcaagtctgcatcagcaaggacattgaacactgcccagattcagcttgttgcaagccatccggaagtgtatgaaccatgtgatgattcctttgctcttgttgatgcactgctctctgacaaggctcaacttctgacgctacagccgagtttatgcatggaggtaggatgtggcagtggttatgtcatcacttctctagccatcatgctcaggcaattaggctctgggacccagtacctagcaacagacatcaaccaacatgccgtggagacaactcaagcaacacttgaagcccatggtgttcatgcagatgttattgctacagatattgtgtcaggtcttgagaaacgtctggctggtatggttgatgtggttgttgtgaaccctccttatgtgccaacaccagaggaagaaatcgggatgaagggcattgcttcatcttgggctggagggttgaatgggcgccaagtgattgaccggattcttcctgctgtgcgcgagctgctgtcagaaaaaggatgtctctacatgattgcccttgaagataatgatcctttgggcatatgccatttgatgaacgagaaggggtttgcatcgcgtgttctgttgaagaggtgtactgacgaggagagcctttatgttctcaagttctggcaagatgctgctgctggcgcaaatgcttctcagtccggtagatctccacgcgccgagtcgtggctttcgcagttgcctttcaaatccttttggcataagaacactggcagttcttgacatcatcagtttgggccttcccatcatgaaatatatcgaagcaaggaaacctttgcaaaattcatatggcggtaatgtgtaaaagtgtctgaatgaggtgttgagttcagacctgcctgtcctttgagaacacgaaccagactgacattgtgaacttagctgtgatccagtgagcaatcaaaccaatcgtagtcgcaatataccaaactttctcgtgtcggtaaaacagctgtcttattatgttggcatgatgcg

SEQ ID NO: 491 - DNA, 2299 bp, Triticum aestivum
gcacctgccagatctgcggccccgccggcggcgggccgccatttctgggtgtccgcattggttcaggatcttattatccaaaggttgggcccatcgggtttcgtaacagcttcccactcaagctttctgttgctttctatctaacgtggaagatggcgtccgttgcctgatgattgctaccgtgacacctttctcgcactctagcaccgcgtcatctgcagaatttgaaaggcgcaagagagcaattcctttgttgtctgccatgtctcgcaacttgaagaaccctgtccagacccagatggcagtttcagccttgagcagctctctgatcggtgattatcctagcaaaactagaagcgaggggagggctgttggatggaaacgtgtttttgtccagactgacactggttttgtactgcctgttcaactggatcgtggtgacagtgtacacacagtcaaaagaaagctgcaggtggccctcaatgttcctactgaggagagttctctgacgctcggtgatcatgtcctcaagaatgatctcagcagcatccgaaatgattcaccactgctcctgaccaagaccttcatgcatcggagttcctccagcccatgcctgtctcctacaagcaaggatctccagcagcaaagggataggggtggtccaattgaagttttagtgtgtccaacccgctgcattcaggcaaagcagcttgttaaggatgttgctagggccataagaaacggtgtggatccaaaacttgtcaatagtgggcttggtggtgcctactatttcaagaacagtaaaggtgagaatgctgccattgtgaagccaaatgatgaggagccgtttgcacccaacaatccaaaaggttttactgggagagcccttgggcagccaggcctcaaaagatcagttcgagttggtgagaccggttttagagaggttgctgcataccttctggactatgataactttgctaatgtccccccgacagttcttgttaagatttcacatcctgtatttaatgtgaatgaaggcgtcggctctaccaacaagaaggcttctgtgggtgatccgcgaactgtcagcaagattgcctcatttcagcagttcgctcctcatgattttgatgctagtgaccttggcacttcaagcttccctgtagctgctattcacaggattggtattcttgacatccgaatcttcaacactgatagacatgctggaaatcttctggtaagaaaggtgacaggagccgatcaattcggcaatcagactgagctgattcctattgaccatggtctctgcctgccagagtgtttagaggatccttattttgaatggattcactggccgcaggcgtcaatcccattctctgaggatgagcttgagtacatagggaaacttgatccagtgaaagatgctgagatgcttcgcatggagctgcctatgatccgggaagcatgcctccgagtgctagtcctctcaaccatatttctgaaagaaggcacattatttggtctttgccttgcggagattggtgagatgatgagcagggaatttaacgggatggatgatcagccaagtcagctagaggttgtctgcatggaggcaaggaggctagcaactgaacgagaagaatgttccacagaacatgattctgcagatgaagatgtgacccaatttgaacttgactgtgaagatcatgaaatgccaaaaacaccaccagcctaccattttgaatttaaggggggaagctccagaaacccgctgtctaaattggaagaggccattgaagaagaggaagatgacattcaggaggaggaagaaagcaatgcagaaaagttagcttgccccaagcctgtcaataagtggcttcctaatatttccaagctatcaacctcactgagcagtgtcagtctcatggacaaaagccagcgtcaggtgcctgctattccgaagggtgcggattctgtgaaaacctctgaaaacagccaagttggtaactggagaaccgcgaatgagcagctcccaacaagcgcaagctttgtgaagctggccgacatgggtgtggatacatggggcctgttccttgagaagttccaggagctgctccctggcgcattccgcgcgcacaagcttggcgccaccgggcagagggggaggctgaggatgggtacttcttgtcagttttgagttagtgcaggagtagagaagtcagtttggctgctactgtttgctgtggcttcctgtaggtgtcaaggtatgcggtcggtcgtcgaataaagccatccttta

SEQ ID NO: 492 - DNA, 2518 bp, Triticum aestivum
ctagcaggaggcggtagagtagggtagggtagagagagagagcgagagagggggcggcggggaggcagatgcgggagatcccacggggggtcgccgcagccggaggaggaggaggaagaagcgatggacacgcccgataggccccgcgccggcgccgccgccggattcgaggactcccccgtcttcaattttatcaataatctatctcctataccacctcctaaacctcaagactcatcacataatgtgcacctattcaagtcgtctgacttggctcctgtttcttcaatctttgcctcaccccatgtcaatccaccaaaggaatctaaacttctgataagggatgattctgttcaactttctcaagattcaaactctcctaatagtgttagaactcgattagggagtgctattaggttgatcaaatgcaaaaacattgtttcggagaattgcagtttcacctgccacctaaatcagggacctatggattcttctgccaatagatcaaactctacaagtaaattgcctcaaaccatccagtttgttggtgacagttcagaatgtggtaagaatcaaaatgctgatagtaaaaaagatcttgctagagatcaggagagcatagaactagaaggcgtcctccttgatcacactggcccagataaaatcgactcatcacaacctggaagaaccgttcatgaaaaccaacaatgtgaacaacaaaaggatggatttacagcatatgatggggattacttgattacacatgaatcaagtatggatatgctgagattagccccaccatgtgaggcagatacacagttagtgaatgagacactaaacgctgataatgtgttctctggcaattccttgctgaccgatgggccaagtggctcttacatcaacaatgctgcacatgatccaaatctttactgggatggaacggttgaagggcccacgacagattataccccccaattgctccctggtgcttgtcaaagtcagtcagtgtcaaatgatcaaatctgtaatgcagttgaagagcccagtgatcacataccaatcgaccaaagtgccttgtcacagaatatgcgtggtatgcgcaggcgttgcctttttaatgaaaaggctggggctgttaacaaagctgccaagaagacctcggatcgccattctgcaaatacaactacccccagatgcaaaactaattctggtgataagcctgtgagaacccctccatgtgcattgcctggtattggcttgcatctgaatgcccttgccccaatatcaacagacaaaatagtcccccaagctgctcaatcttccataaatcaagccagcaacttcccctgtgctgtcagttcttcaacatctgaatcaaatattgcaaatgaagattcctctcaggcaatcgtggttgcaaatgctgatgagtctggtcagggcagtcccaagaagaaaagacacaagtttgatgatggtgatgggacttcatgcaagcgttgtagctgtaagaagtcaaaatgcttgaaactttactgtgagtgttttcatgctggagtcttctgttcagaaccctgttcatgtcaaggctgtcttaataagcctagcaacatggagatagttctatctactcgagagcagattgaatctcgtaatccactagcatttgctcctaaagtgattcgcacatctgagcctggtcaggaattaggggagtactctaacaaaactcctgcctcggctcgtcacaaaaggggctgcaactgtaagaagtcatcgtgtctaaaaaagtactgcgaatgctatcagggtggcgtgggatgctccataagttgcagatgcgagggatgcaagaatgcttttggtagaagggagggactcggaccgttaagcattgaggaagctaagcagggaaatgaggaaaatagtgcttgtgtgaaggaagaaaaaaaggaagatgataataatcagctcgttatctgcccagctgctaatccagttcctgctgagaatgtactgacaacaccttcagctatggatgtcagacccttggcttctcgtccaccttcaagctctaagaggccacggtctacgacaaaggtcctcggacatccttctcgactatgcaactctcaagctcctctgaagacggacactctgctctccccatttgaaaactatgcagaaattatgtttggggtgggtacatcagatagcctaaaaggagggttatctcctcaaacttctgtcaaggtcgtgtcaccgaataaaaagagggtatctcccccgcgcattggtactgggttgtctccaatttgcaagagtggcaggaagttgatcctgaaatccatcccttcattcccttctctcggtggtgatgtaaataacgcggataccaagaccaccttgccagctccttgaattcatcaagcatttgtcagaggtcatttcattagttccttgattccccagatggccaatgcctcgtagctgcatcagctccttcatccttgagagt

SEQ ID NO: 493 - DNA, 1338 bp, Triticum aestivum
gagcagcaagtaatccggtcgaattgataggggagacgaggagcagcgatggccgccgctcgagcccgatggcggctcctcgcgctgcccctggcgctgctcctcgcgatcggctcgtcgcgcggcgtcgacgcggcgcccaagccccccgtccccaaggccatctccgacctgagggaggcgatcgtcaaggggctggggctccagtcggaggagctcaaggtgtccgggttcgacgtgagggacgcgctggtggggcacgcggtggcgtacgagttcgacatggaggtcgggaggaaggccgtgccggtgcggctgctcgaggacgtcaaccggtgggacttcgtcgacctgcccatcttccggtcccaggccgacgccgacgacacggcgctcgccgagatcgggcggggtagcttcgaccccacactgccgcccttccagctcgccgggcccatggagctatggatccaggacggcgacgacgtcaggctcgctttgccgcatgatgtggaagctggaaccctgaagaaagttgttcttgctgacggtgcggtggtaacagtgaaaggtgctagggcggtgagcctccgtttgcccctcgaactaccacttcctctcaaccgcaccacatacaagggccgtctgtctagcttgctttccattgctcgagccctacgcggtgcagctcggtctaatcagaaacccctgatgtccctccggatcgagggtccaacctccttatcctcaaccccgtccatgtctccgaatgacaagctcaagctcaaaaggttggccccaggtcaagtggagctctcctcgcgtgcgatccctgctgtcactgacgatgaggatgaatcgcctagccccggattgtggccctttttgtcattgaatgcatcagatggcagcctgcaggggcttgaagaactactggcgaaggttttgggtaagaaggccggtgagaagggcacgttcaagttggtgaatgcacgggcctcggcacaaacatatgtcaaaatgggattcacggtggagaagcggattgctgatggagaggtgaactggtctaacttgccagagtggagaacaaagcccaagaagttgagagcgcactatgaagttcttgctcgcgtggagcgtggccaggcgatcccggaaaggatcgcccaggtgcagcctttccaggtcgacgaggccatgtccgagagcatgctcactggaaacgtgtctagatcgaagatggaggtagtaaaccccccaccggtttatttcactttgtgagactgggaggggctggaagctttttatttccaaagctctacttgggatggatag

SEQ ID NO: 494 - DNA, 623 bp, Triticum aestivum
gatcgatggcgatggccggcggagccccgccggcgccgctgccggtggtggggcaccagttctgcgcgccctacgtggtgccgctcacggtgaccaagaaggccctcagcctctccgacggcgacttcgccatcacggacgccaacggcgccgtcgtgctcaaggtcaagggcgccatcttcagcatccggagccgccgcaccatcctcgacggcgccgggatgcccctcctcaccatgcaggaaaaggtgttcagcatgcaccaccgatgggaggtgttcagaggggacagcaccaacgcaggcgacctgctcttcaccgtgaagacaacttcgctgatccaactcaagacggagatggatgtcttcttggccgggaacaccgcgcagcaggtctgcgacttcaagatcaagggcagctacttcgacaggtcctgtgtcttctaccttggcgactccaacaacatggtagctcaaatgagccgtaaactgactgtttccaatgtgctgctggggagggacacgttcagtgtgaccgtgttcccgcacgtcgactacgtgttcatcgcgagtcttgttgtgatcctggatgaggttcacagggacaaacgcgatgattgatga

SEQ ID NO: 495 - DNA, 347 bp, Triticum aestivum
ggatcccgtccatggcgccgtccatctccatcgccgccgcggccccggcctcgggctggaagggcggcaggaaggccggggcggcgccggcggagggcgaggcggagacggaggcgctgctgctgcggcgccggaacgccgagctggagcgggaggtggcgctgctgcgggcggagctcgaggccgcgcggctgcgcgccgaggccgcggaggaggccgaggagcggctgtgcgcgcagctcggcgaggccgagtgcgaggccctcgagctcgcgcgcgcgtaccagggccgcgtccaggagctcgcgcgggggctcgccgccgcacgcagctgctagtaggaattc

SEQ ID NO: 496 - DNA, 931 bp, Triticum aestivum
aaccctcgctccatcactctctccctctcactccggcgcgctctcagctgaatctcgccgcaggaccatggcgtcggtgcatctatgcggccccaaggtggcgtccgcggcgatggcgaagccagcgttggcggacgggctccgtgtccccccttcgtcgtcggcgcgtcccgtgccgacggggcggaggttccggggcctcgtcgtcagggccgccacggtcgtgtcccccaagtatacttctgtgaaaccattgggagatagggtactagtgaagaccaagactactgaggataaaactgctggagggatattgcttccaacaacagctcagtcaagaccacaagcaggggaggttgttgcagttggagaggggagaagcttaggcagcaacatcgtcgagatcagtgttccggttggtgccaaagttatttactctaaatacgctggtaccgagttggaattcaatgataccacccacctcattatgaaagaagatgacatcattggtattcttgacactgatgacgtgaaagatctgaagccactgagtgaccgtattctcattaaggttgcagagtctgaagaggaaactgctggcggtttgctattgacacaggcgtcgaaagagaagccttctgttggaacagtggtcgctgttggccctgggggtttgggcgatgatggcagcaggacgcccttgtcaatcactcctgggagcagcgtgctgtactccaagtatgcgggaagcgagttcaagggttcggaaggcgagtacatcgttctcaggtcatccgacgtgatagctgtgctgtcatcgtaaggaaagcctgttctgctcatgtgaactaggaattttgatatttagtccaaaaccttgtttggttatttctcttgctttggattggcgaattgcttctttgctctatcc

SEQ ID NO: 497 - DNA, 2677 bp, Triticum aestivum
agagatgctgctgcacgggctggtggaccggctgaccgggaagaacaagcaggcgtggaaggagggcaagatccggggcacggccgtgctggtcaagagcgacgtgctcaacctcggcgacttccacgcctccctcctcgacggcgtccacgacatcctcggcaaggacgacggcgtcatcttccacctcgtcagcgccaccgccccagacccccagaatccgaggcggggcaaggtggggaagccggcgcacctggaggagatggtggtgaccatgaagtccaaggcggccggggagtcggtgttcaaggtcaccttcgagtgggacgactcgcaggggatccccggcgccgtcgtcgtccgcaacacctaccgctccgagtacctgctcaagacgctcaccctccacggcgtccccggcaagggcaccgtcgtcttcgtcgccaactcctggatctaccccaacgtcgaccgcgtcttcttcgccaacgacacctatctgcccagcaaaatgcctgcacttttggtgcaatacaggcaagatgaactcaacaatctccgaggcgacggcacaaccggaaagtacgaggagtgggaccgtgtgtaccgctatgactactacaacgacctcggtgagccggacaagggccatccgcgcccggtcctcggcggcacccaggaactcccctatccccgtcgttgcagaactggccgacccccaacaaaaacagaccctagatcagagagcagaattcctcagtacaagatacaggaggccctcaacatctatgtcccgcgtgatgagcgctttgggcacctcaagttgtctgacttccttgggtactctctcaaggccatcaccgaggccattcttccggtgattaggacctatgttgacactacacccaaggagtttgattcgtttcaagacatctatgatctctacgacggtcttctgaaagtgcccgataaccaacacctaaaggagctcaagaagaaaatcccccttcagtttattaaaagtcttttaccagttgctggcgacgacctcctgaacctgccccttccacatgttatcagatcaaacgattatgcttggaggtcagacgaggagtttgcgcgggagatgctcgcaggcgtgaacccggtttgcatcaaacgtctgacggagttccctgtaaaaagtaccctggatcccagtgtgtacggggaccaatcaagcaccatcactgaagatcaaattcagcagaaccttgaagaaggcctcacagtgaaacaggcaatggagaaaaacaggctcttcattctagatcaccacgataacttcatgccattccttgaccgcatcaacaagctggaaggcaactacatctacgcttcgaggaccctgctgttcctgaaggccgacggcacgctgaagcccttggccatcgagctgagcctgccacaccctgacggaatacagcacggcgcgaagagcacggtgtaccttccggctgatattgactctggtgttgatggccagatctggcagcttgccaaggcttacgcctccgtcgacgactctgcgtggcatcagcttatcagccactggctgaacacacacgcggtgatcgagccgttcgtgattgcgacgaaccggcaactcagtgtggtgcacccggtgcacaagctgctgagcccacattaccgcgacacgttgaacatcaatgccctggcgcgaaccactctcatcaacgccggtggcgtctttgagatgaccgtcttcccggagaaatatgcgcttgagatgtcttccatcgtctacaagaactggaagctcaccgagcagggcctccccgacgatctcgtcaagagaggcatggctgtgccggattcatcgagcccatacggtgtccggctgctgatcaaggactacccgtacgcggtggacgggctggtgatctggtgggcgatcgagcggtgggtgaacgagtacctggccatctactaccccaacgacggcgtgctccgggccgacaaggagctggaggagtggtggaaggaggtgcgcgaggtcgggcacggcgacctcaaggacgccgactggtggcccaagatggtgaccgtgcaggagctggccaagacgtgcaccaccatcatctgggtggcatcggcgctacacgcggcggtcaacttcgggcagtacccgtacgctgggtacctcccgaaccggccgacggtgagccgtcggaagatgccggaggagggcgaagaggagtacaagcagctgcagaagggcgggaaggaggccgacaaggtgttcatccacaccatcaccagccagttccagaccatcctcggcatcacgctcatcgagatcctgtcgaagcactcctccgacgaggtgtacctcgggcagcgcgacacgccggagtggacgtcggacgccaaggccctggaggcgttcaagaggttcggcacccggctgatggagatcgagaagcgcatcctggacatgaacaaggacccggcgctcaagaaccggaacgggccggtgaagatgccctacatgctgctgtaccccaacacgtcggacgccggcggcgagaaagggctgggcctcaccgccatgggcatccccaacagcgtctccatctgagctgagcgaggtcctttaatctgaacagcgtctcgt

SEQ ID NO: 498 - DNA, 1084 bp, Triticum aestivum
aagatctcccactcgcctccccgcgtcgccgtcgaacccactccgccgccccgtcgccggcagcgcccccctcccgcgatggccacccccgacctcctcttcaacctgcgcaacctcttctacctcggcgcctaccagtccgccatcaacaacagcgacgtcccgggcctcgacgccgacgccgcggccgagcgcgacgtcatcgtcttccgctcctacatcgccctcggatcctaccagctggtgatcagcgagatcgactcgtcggcggcgacgtcgctgcaggccgtcaagctgctcgcgctctacctcaccggagacaaggaaggtgcgatctccagcctgaaggaatggttgagtgattcagctataggaagcaatcctgttctgcgattgattgctggaattatatttatgcatgagcaagactacaatgaggctctcaagcacacacacactggggggactctggacctgcatgcactgaatgtccagatcttccttaagatgcaccggtcagattatgctgacaagcaactgaagatcatgcaacaaaccgacgaggaccatacactgacacaactagcaaatgcttggctcgatattgctgttggtggctctaagatccgggaagcttatctcatattccaggacttcgctgaaaagtaccctatgactggaatggttcttaatggcaaggcagtttgctgtatgcatatggggagctttgaggaggctgaaactctattgcttgaagccctaaacaaggatgcaaaggatcctgaaactcttgccaatcttattgtatgtaatctccaccttggcaaaccgtcgtcacgatacttcagccagctgaagctgtcgcaccctgatcacgtgctagttaagaccaccacgtcagcggaggataatttcgagagggcactccaagccgtcgcctgaaacacccctgcctcattccagtttgcgcattgagcatcccctgttccattttgaagtgctttaacagagtgaattgtattggttttgctttatattgttctgtggtaacacaccgctcggccaaccctgtactcaaacacaa

SEQ ID NO: 499 - DNA, 724 bp, Triticum aestivum
accttgatctcgtctccttcctcccctctggcggcgccactccgatcgatcctccccgtccgcgaccaatatgaggagaggctacagctacagcccatccccaccaccgagaggctacaggggaagggcccgtagcccaagtccccgtgatcgttatgatggtcggggtagagatctcccaaccagtcttttggtcaggaaccttcgtcgtgactgcaggccagatgaccttcgccggccatttgcacagtttggtcgtcttaaagacgtatatattccaagggattactatactcaggagccacggggatttgggtttgtgcagtactttgatcccaacgatgcggcagacgcaaaatactacatggatggacaggtcattcttggtagagaagttgcagttgtttttgcacaggagaacagaaagaagcctgctgagatgagaactagagaaagtagcagaggtcggtcttacgatcggcggcactctccttccccaagggggcggccatcttaccgcggccgaagctactcaaggtctccatcacctcggcccgcaaggcggaggttcagagacgagtctccctcgcgctcccgctcgcccagcggatcgaggagtgcgagtccattggatgggaagtacggcaggtcctcacgaagagagaggtcgatttcggttagcggatgaagcatcagtagctctgctcgggtctctagaacttag

SEQ ID NO: 500 - DNA, 1566 bp, Triticum aestivum
gctcaccgccaccatcataacgccactcccacgctccactccgactcccatcgcgttccatttcaaaaacgccacctttcgccccctgcatttccgccgaagtctacatgtctccgaccaccgccgcgtcccccgcgccggcgccggcaaccgacgcgcccccgaagccttcgccaggcgcgaagcgcagcctgatggggtccctcatcgacgccaccgcgctgctccgggcggcctccttcaaggaggactcgtacgtggccgcagcgctcccggcctcggacctccgcgcgctcgccgacctcagggcgctcctcgccacccacccggaccaaatctccatctggggcgtgccgctcaacccgcccagcgacgcccccgccgacgagcgcaccgacgtcgtgctcctcaagttcctccgcgccagggacttccgcgtccgcgacgcgcacgccatgctgctccgctgcgccgcctggcgggccgagttccgcgccgacgccgtgctggacgaggaccccgggttcaaggacctggagggcatcgtcgcctacatgcacggctgggaccgcgagggccaccccgtctgctacaacgcctacggcgtgttcaaggaccgggacatgtacaacagggtgttcggcgacggcgaccgcctcagccggttcctccggtggcgcgtccagatcatggagcgcggcgtgcgcgcgctccagctccgccccggcggcgtcaacgccatcatacaggtcaccgacctcaaggacatgccgaagcgagagctccgcgccgcgtccaaccagatactctccctcttccaggacaactaccccgagatggtcgcccgcaaggtgttcgtgaacgtgccgtggtacttctccgtgctgttctcgatgatctcgccattcctcacggagcgcaccaagagcaagttcgtcatcgcgcgcgagggcaacgtcgcggagacgctcttcaagttcatccggccggagctggtgccagtgcagtacggcgggctgagccgcgccagcgagctagagaacgggccgcccaagccggcgtccgagttcaccatcaagggcggggagaaggtcttcctagagatcgacggcatcgaggccggtgcaacaataacgtgggacctggtcgtcggcggctgggagctggagtacggggcggagtacgtgccggcggcggagggaggctacacgctgtgcgtggagaggaccaggaaggtcccggccgccgccgccgagcccgtgcacaacgccttcacggccaaggagcccggcaagatggtgctctccatcgacaactccggctcacggaagcggaaggtcgccgcctaccgctacttcgtgcgcaagccgtcggcgtaggctaccctgctgctcgactgctgtggccggcggcttgccggccggcttgtgctttgctttgctgggcgtcagctcgtctcggagagtagattaatttaggtctatttaatcagtgctatataatgtgatatgcatgtattatggcatatgtagaatataatgtatgagccgtgagatcctacttgtc

SEQ ID NO: 501 - DNA, 1773 bp, Triticum aestivum
cagtctttcttggtcgttcctctcgggcctcggcagatcgacgccggcggcgactcctctcgccctgccctcccgagcccggtttaaatggctgcaagaaaggataatgcagtccttattgcttgccaagctcccaatggccgtgtaacacgagctcaagctgctaattgtggaaggtttggagtgcctcacccagcaccggtacttgtcagaactgaacgaaaaccagcgactaaaggaaaggcgaaacggggagcttcagatgagaacacttgtgcaagtgctctaacttcagctccacctcctaaaaggcgagcagcactcaaggatgtgacaaacataagctgtgcaaactcgttcagaaattgcactgctgtgactaagctacagtcaaggcccacacagaaggtagggcgaaatccaagcaaaaacaagcagtgtgcaaagaaggcccctaagccacctcttcctactcttagtggaacttcatttgttgtgaatgattctcataatgtggaagaaactcagaaggcagagcttttgccaccaaaagaggagcccactgctctgctcgaaaacaaggggtcgttgtcattatggaattttgcacggaacagggagagtggtgttcatgagccattctttcagggaagaaacacaagagataaatctgaaactgccgactcaaacactggggactatgttggcttaaacgttatagacattgacaaagataatggcaatccacaaatgtgtgcttcctatgcggcagagatatacagaaacctaatggctgcagagcttataaggagacctaaatcaaattacatggagactttgcaaagggatatcacgaagggcatgcggggcatcctgattgattggcttgttgaggtttctgaggaatataaacttgtgccagacacactatacctcactgtatatcttattgatcaatttctttctcggaaatatattgaaagacagaaactacaacttcttggaataactagcatgctgattgcctcaaaatatgaagagatctgtgcgcctcgtgttgaagaattttgtttcataactgataacacatatacaaaaaatcaggtgctgaaaatggagtgtgaagtgcttaatgatctggggtttcatctttcagttcccacaatcaaaacgtttctgaggagattccttagagcagcacatgcttctcaaaaagctccttgtgcaactttgggctatctgggcaattatcttgcggagttgacattgaccgattacagtttcctgaaatttcacccttcagtggtggcagcctcggcggtgttccttgcaaaatggacactcgaccaatcagacctgccatggaactctactctcgagcattacacctcatacaaaagttcagatattcaaggatgcgtacgcgatctatgggagctgcagcaaggcaacaccagcggaagtccccccctcaatgctatacgtgagaaataccggcaggaaaagtttgaatgtgtagccaacatgctgtcgccggcgatgcctgggtcgctcttccatagacaagctaacggcaccagccccctgctgatcaacaactcgtagcagcgcagcgtcagccccctgctgatcaacaatttgattttttccgaagatcttgtagcatccccttcccaccaccctctccccctccgatctggctgtgttgttatttccccccgacctttttcgagtcgtgcagtcgtaggcgatggctcacataaatgttgatag

SEQ ID NO: 502 - DNA, 1570 bp, Triticum aestivum
cgatcccaatggagcttcctcagctagcgtccttcctcggcgtggtgctcgccacggtgctcttcctcaaggccgtcctccgccgccgccgccagtacaacctcccgccgggccccaagccgtggccgatcatcggcaacctcaacctcatcggcacgctcccgcaccgctccatccacgcgctgtccaagaagtacggcccgctcatgcaactccagttcgggtccttccccgtcgttgtcggctcctccgtggagatggccaagttcttcctcaagacccacgacgtggtgttcaccgaccgccccaagaccgccgccggcaggtacaccacctacaactacagcgacatcacctggtccccctacggcgcctactggcgccaggcccgcaagatgtgcctcaccgagctcttcagcgccaagcgcctcgagtcgtacgagtacatccgcagggaggaggtgctcgccctcctcggcgacctgtaccgcggcggcgccggtgccggccgcgtggtggtgctcaaggactacctgtccacggtgagcctgaacgtgatcacgcgcatggtgatgggcaagaagtacctggagaaggaggtgagggacgaggcaggggcggtgatcacgacgcctgaggagttcaagtggatgatcgacgagctgttcctgctcaacggcgtgctcaacatcggcgactccatcccgtggctcgactggatggacctgcaggggtacatcaagaggatgaagaagctgagcaagatgttcgaccggttcctggagcacgtcgtggacgagcacagcgagcggcgtgggcacgagggggagagcttcgtggtcaaggacatggtggacgtgctgctgcagttcgccagcgatcccggtctcgaggtcaagctcaacagagagggcgtcaaggctttcactcaggacctcattgctggcggcacggagagctcggcggtgacagtggaatgggccctctcagagctcctgaagaagccagaggtgcttgccaaagccactgaggagttggaccgtgtggtggggcgaggccgatgggtcaccgaaaaggacatgccgagccttccctatgtggatgccatcgtcaaagaaaccatgcggttgcatccagtagcgccgatgcttgtaccccgcctttcccgtgaggacacgtccatcaatggctacgacattcctgccggcacacgggtgctagtcatggtctggtctattggtcgcgacccagagttgtgggaagcgccggaggagttcatgccggagcggttcctcggcagcaggctcgatgtcaaggggcaggattatgagttgcttccattcgggtcgggacgcaggatgtgccccgggtatagtcttgggttgaaggtgatccaggtaagcctagcgaacctcctgcacgggttcacgtggaggctccctgatggcgtggagctgagcatggaggagatcttcggactgtccacgccacgcaagttcccgctggaggctgtcatggagcccaagctcccagctcacctctacgttgaggcttgaatatttgatactga

SEQ ID NO: 503 - DNA, 539 bp, Triticum aestivum
gttccatgagaccacagagcgctagcgcattagctgctacaacactggtgttcctctctttgatctgcaacatccaacttttggtctcggtcacgggcttgtccagctttgcgatggataattccccaagtaagccagagctcggtgctgctgctggtgccgccggcaatccagaggttgtactccctgatgctgccaacgttgaggtcaatagtgtgccagcggttgatgatcaacacccagacccagcagacgtattggcttgggcattaagacagggtcaaattcatgcggacccacttatgcaaaggctggaaactgttggagcgctgctcgacatagaaatgcagattgttcccccagtgccccaccaagtgatcttggttgcactggaccagcttgccatgctgcctatgcctgccgccgatcctgctcctcccgaagcctcacaagagattgatgtagataccgagggggtggaaggtgatgtgccgccacccccggcaagtccctgagccacatatataagctgccgatga

SEQ ID NO: 504 - DNA, 2117 bp, Zea mays
ctcttaccagagccacctcctcagcaggccgcagctactccacggtgacggccgccatgagagccctcctctccctctcccgtctcgcccgacggcttccagcttctctcagccctgtaagggcgccgacaacattactcctccggcacatccatgcggatgcccctccgccgccgccatctcatgactcgacgcccttcgtctcccgcatcctcgaatcggagccgtgcctgaccccgaacgacgagtcggagccggcatccgatccgaccctcgacgagttcctcgcgcgcttcgtggctgccttccgcccgcgactggcggctgccttccccaaccatgaccgtgacgtgctcgacgagatgctccgcctcgtcgcggacgccgtgctgtgccgcctcaccgggaccgaccgggggggcgatgctattgagctcaatgacgacctctgggcggccgtatgggaggtcagcgcctccgtgcgcgaggctatgcgccgggatcaggtccgcgccgaccttcgccaataccttcactgcgacgaggtgaaggagatgacgcggttcgctgtcgatgtcggcatccgcggttccatgctccgggagctccgcttcaagtgggccggcgagaagctcgacgaggtcgagttctatcgcggccttgatgacaagcacgccgatgccgaggccggcgccgaccgggcgccagtgccgaggctgactgctttgccgaagaggaagggagaggtgaagttcacgatgtacgggctggacatgtctgacccaaagtgggctgaggtggcggagcgagtggccgaggctgaggcgcattttgtgcctgaggaggccaaggctgtagaagggagggcgaagaaggctgaggagcggctgctgtccgttgacccgaggagtggagatccggtgcctgccattgaggagtggaaggaagatctcaggccaaaccgtgttgattggatatctctgcttgagcggattaaggcacggaatgtcgagttatacctcaaggttgctgaaattctgctagatcaagaatcttttgaggcaaacatccgagattactcaaaattaattgatcttcatgctaaagcaaataatgtggaaagtgcagagagagtacttggtaaaatgaaagagaagggtattgcacctgatgtcatcatatccatcgtattagtccacatgtatagcagggcaggcaagctagagcaggccaaggaggcttttgattttattcgtagggaggattttaaaccagatcggaaactcttcagttcaatgattaaatgctatatcaaccatggagaaccagaacaagcagaaaatctgataaaagttatgagggatacacgtgtcaaacccactagagaaatctacataggtctcttacgatcatatgttcagcgaggcttgatggcatatgcagagagggttcttaagacaatgtcatttgatagagtcgagcctacacaggaactctatacaatatgtatagaagcatatggacgtgttggtgatccaaaagaggcctgtgccatgtttgatcaaatgaggaggaagtttggacacgaagcagatgacagttcaattgctggtgtggtggccgcatacatgaagaataaccaactagaccatgctttgcagtggctgctgagtttagagaaggaaggacttcaacttggtgtcaagacaaatctcatgttactggattggttgtctatgttgcagctagttccggaggctgaacagtttgtgcagaagataaagaatcttggagaagagcccatagaagtccatgtgttccttgccgatatgtatgcgaagtcgtcccaggaagataaagcccgcaggtccctcaagatcttggaagagaagaagaaactattgaagtctgatcagtttgagagggttataagaggccttgtcgatggtgggttttcggaggaggcaaataaattctacaaaatgatgaaatcctgtggctttgaaccatcaaaaacaatcgaggtcgctgttaaggctctcaggattaggggcggttctcatcgcactggtaggtagagcctgtacgccggcagagtggcagtgatctactggtag

SEQ ID NO: 505 - DNA, 2122 bp, Zea mays
caacattcacggacggaaacccctcaaccccgaccccctcgaggcctcgacccgacccgacccgcctccaactccaagccaagccgccatggcggctccgcccgcgaccaccgccacgactcaccaccgcgcgctcctcccgcccacgcgcacccacgccgccgctacgcactccgcgctccgcctcccgctccgcgcgcatccccacgcccacgcccagcgcgcgcgcctcaccgccgccgctgccccggcccccgcggcgtcgacggcctccctcgagtcctccgccgcggggaagcctacggtgctcgtggccgagaagctcggcgccgcggggcttgcgctgctgcgggaattcgccaacgtcgactgctcctacggcctctcccccgaggacctccgtgccaagatctcgctctgcgacgcgctcatcgtcaggtccgggaccaaggtcggccgcgacgtcttcgaggcgtccgggggcaggctccgcgtcgtcggccgcgccggcgtcggcatcgacaacgtcgaccttgccgccgccaccgagcacggatgcctcgtcgtcaacgcgcccactgccaacaccgtcgccgccgccgagcatggcatcgcgctgctcaccgccatggccaggaacatcgcgcaggcggacgcgtcactcaaggctggtaaatggcagcgcaacaagtatgttggtgtatctcttgtgggcaaaactctctcgattcttgggttcgggaaggttggttcagaagttgctcgtcgcgctaaaggtttaggaatgcatgtgattgcacatgatccatacgcttctgctgatcgggcccgcgcaattggagttgagctagttagtatggaggaggccatgacaactgctgacttcatctcattgcacatgcctcttacccctgcaacaaacaagatgctcaacgatgaggcctttgctaagatgaagtatggtgttcgcattataaatgttgcacgcggtggtgtgattgatgaagatgctctagtcagggctcttgattcaggaatagtagcacaggctgctcttgatgtgttcactaaagaacctccagctcctgataacaagttggtgctgcacgagaatgttactgtcacacctcaccttggtgccagcacagtggaggcacaggaaggagtggctattgagatagctgaagctgtcattggagctctgaaaggggaacttgcagcttctgcagtcaacgctccaatggttcctgctgaggtgctgtcagagcttgcaccttttgttgtgcttgcagaaaagcttgggcatttagctgtgcaactagttgctggtggtggtggcatcaagtctgtgaaagtgacctatgcatctgcacgggcccctgatgatcttgacacgagacttctccgtgcaatgatcaccaagggattgattgagccaatctccagcgtttttgtcaatcttgttaatgctgacttcaccgcaaagcagaggggagttcgcatcactgaggagaggatcatcttggacggctcacctgagacgcctatcgactacattcaagttcagattgccaatgtcaagtccaaatttcctagtgcgatatctgagactggagagatcacagtggaggggagagtgaaggatggcgttcctcatctaacaaaggttggagcattccaggtggatgtgagcttggaaggaagcctgatcctttgcaggcaggttgatcagccaggtatgattgggtcggtaggaagtgtcttgggtgaggagaacattaatgtcagtttcatgagtgtcggaaggattgctcctcgcaagcatgctgtcatggcaatcggtgttgatgaggaaccaagcaaggtcacactgagaaagattggggagattccagcaatcgaagagtttgttttcctcaagctttaggcaactaagcgcaaatgtatgtttcaagttgcaagcatgctgtgcaattttgatgtagcttagcaatatagaggacggatggttctccttaaataagcttttaggattatttttgtagtggcgctcttgaatttggtgcaatattgatgccatcttttgaacggggtgttattctcagctactgtttcccaggtt

SEQ ID NO: 506 - DNA, 3435 bp, Sorghum bicolor
cactcctctcagacgccatccccatttctcgccggcggagcgcgcctgcgccccgggtgagagggagccaggatggccaagcccgctgccgccgagccattctccatacggtaagcgcgcgcgcgcgcgcgtccttctccgtctttccctcccggctccagcttctgcttcgtcttctgaccattcggcatggctgtgctgtgttctgacgtgagcgggggtgttcccgagcgtacgcgcctgacctgttggactgaatggcgcgcaggggttacgccatgaggatgcgggccgtcgacgcggccgagtgctacccgttcgtcggcggcggctgcagcgaaggggagggggagccgccgccgccgccgcggttcccgccgatggacccgaagccgctgtcacggtggtggaagcacgagctcgcggcggggcaggcccggcttttggctggcgccaagggcggagaggctgcggcagccggggtccgcggcagtgcgctgcggaaggggaccaagaggaagggatctcgctcgaactccacgggcgagagggccaggaaacggcggcgtgtgcttcagtttaggtcctttctgtcgaacaaggagagaactgctaagcctcagtcaacatttcgtttacatgaacagaagttgcatatggcaatgctgagaaagcataaaagttctactgtccatacaagtacagtacttgaaccaaggaagaaactggaagaggcatgtgatcgcatgccaactcatgaaaacagcgtgaaaaagcgacacagagagagaacggacccttctagtgaaatgaatagtgacctctacgggataaaggaagtgacctcctctgtaaataagcaagtcatagaagtcaatggttcaactaataagcctacaaacactggccacgaaatggtgaaaacttccacagggcccaaagatgatatctttggagatctccctctccttgaattagagagctccaaggttatgtttcggactggtgttcatgaacttccaactgttatagaagaatcatttataacaaatcaaaccgaagcagattctataccagaagttgtacccttggagctgatagatgcatctgacatcactgctcagacgccatctcctcttgaagacttggtgaaaagtgaagacagtgagccagcatgcatctcccacaatgatgtggcagggagtcacccttccactgttgggattgatggtctgccgaatcataagaacatcaatatggtgaaaccaggtcttggtgatatgcagttgaaatttactgacgtgtctgctttaggttctcattctgttctgaggtcaaaatctggttctggttaccctctgcagggttgttttgatgtgaacaagaactgctctcaggaaataaaaaaacatggtactaattctactagcagtccacctgccatgagaacaagagctgaagaaactaaatataaagatgcaccagttaagggcaagaagagtactgatatcactagtgcagcggttgcactacccgtgcctgccaaccaactttcatatcaagctagcgcgttgccctctgcagtatcacattcagttttcagcacaagagttgattcaaatgacatgtcttcattcagaagtatgcctgccaaggaatgcatcccaactaccagacctggtaacttaagaactaatgtgtgccatggaagtaggaaacatgtggatccatgtgtggcactatctacagataaccagggtagctcgcactcaaaacttcatccaatttgcagtcctgctaacattggaatgacttttatgaagctaccgggcctcgaacggatggagatctcaaactgcaatgtaaagataggcgaaaacaggtttagtaatgcagagtcaatgaacgcagtaagatatcagaaacaaccgtggttgagtggcatgacctatgtaatgcaaggtcagaaacagataggtctaagcagctctcaagttgggaaaccagctcttgatggttatgggggcgaaggtgatcatcatctgcagcaacccacagttcgtttgatgggtaagaccgtctcagtttgctcacatagcaaggatcataatgtatcgaccatggatcaagtgagtcctgacaatgttgccattgaagcaagccgcctatccacaatctcatgtcagttaccccaaaagagatcattcccttgtcaggattctgtgacaccaagagtgcatctaaacaactcttcagattttttggcaaggattcccaacaatagcatgcaagggcaaaatactgctttcagtggcctccataaccaaaggccacaaccaataaatagtgctccaaccgtgaaagattgcacttggaattttggtaatcagtttgttcgtcaagctgaactcaataaggcagctatagtcagcaccaactctcagactaggcatctagagctacatcaaccacctcaattgataagcattcctcagaatcaacagtctcatttgtggactccggcagcacagatgagtaggaaagatcagtgttttgtgggtccagcagtgaaccaatcttccctggttccaaaatcattgctaactgcaagtatgaaggaaaagtatcagaaatccactttgttgtcttacgatgatcctagttctatgtctatttgccaaccctaccagatacctggtgcaaactcatcttctgcatctgtcacatccttttttgagtatggtgcggataattcgttgtccagaagctcttctcctggactgagtctttctcttgcaactggtttggctaatgagtctgtttccacaggtagagtagcttgtgcaggcagtcttacaaatgcagatggtaggaaggctgctagctttgccgaaccaataagcaatagttcagcttatgcagataatgtttcacagcaacctgcaaagccaataagcaacagaacagcttatgcaacagataatgtttcacaacaacctgcaaagagacaacttgttacagatacacaggatttaatgtctatgggcccaaacattgtgaaccattcacctggctggtcacttagtgatgcagttggtcctcaggtacttgattttagtaaaagaatagcaagggatgctgttcaaacgtcaagaaatgaaagcaacaatccaagggccagttccggtccagttccgcctattgaaacatggtctaggcctgggttggttgcaggggctaataccatgttgaagccaggtcaaaacctgaatgatcattccaaactgctatactccaccaagttttcggttgataggggtatcaattcggttgtattatagtggaaagcaataaaaaaataataaggcgtccttgttgaagatagctctggagtttttcagtattcaaacagtcaggcacaggaaacttgtaaga

SEQ ID NO: 507 - DNA, 1256 bp, Oryza sativa
gggagatggaggcggtggcggttgcgggcggtggcgcggggctgacaaggtggcaggcggcggcgctgtcggcggtggcggggtgggtgtgggcggcctcctccttcgacctcacgcggcggtcgcgcgcgctggtgcagccgtgggtcacccgccgcgtgctcgccgagacgccgtccatcgtcagattccagaaggtgcatcacaagttgctggacagtttcttctctgtgctgtcatgcgttgtctctgtccctttctacaccggattcctccctctcctcttctggagcggacactccaagctggctaggcagatgacgctgctcatggcattctgcgattaccttggcaattctgtgaaggacgcggtgtcagcccctcggccaagctctcctccggtgagaagagtgacagctactgaagacgagaaggaaaatgccatggaatatggattgccttcatcgcacgctcttaataccgtttgtttgatgggatatctgctgcattatgtcctaacatatggatcacacgacaatgttatggttgtcacgggcttatctctagctttcttgcttgttatgttagttggcattggacggatatatttgggcatgcacagcttgattgatgttattgctggcatctgttttggcgttgtaatcctggcattctggttggctgtccataatcatgtcgatgcttttgttgtctccggtcaaaatgttacaaccttctgggcgagcctttctctgttgctgtgcttcgcatatccaaaaccagaattcccaactcctagctttgaataccacacagcattcaatggggtggcttttggaattgtctatggaatccaacaaacctacttccatttccacaatcctgatgtccccctcattttcagcccacaattaccgcttattgtatttgtcgggagggttctcgtggggatcccaaccatcctagttgtgaaattctgcagtaaagctctctcgaaatggcttctaccggtgatgtgcaacaccctgggcattcctattgtatcaacctgctatgttccagcgctgaaggcttccgaaaagtgcaaggtcaagtccgacgcgaagcagggcggttatctccagaaggtgttctccctctttccacagaaggcgtacgatgtggacaccggcataaggttcgttcagtacgccagccttgcatggtcagtggtcgacctggtgccggccatattcactcatttaagtttgtagtag

SEQ ID NO: 508 - DNA, 2439 bp, Zea mays
acgagatgaagggagcaatgccgccgcgccagttcatggtgccgggccctggggggccgatgctgccaccgcagcagcagttcgggctggtggagacgcgccccccgctggcggccgtgctgcggccgcgcttcaacatcccgggcctccacccgtcagcggcggccgccgccgcggcctcgggcgcgggcaagatcgcctccacctatgacctcgtcgagccgatgcggttcctctacgtgcacgtcgtcaaggcgcgagacctccccgcggtgtccgccacgggcgccatcgaccccttcgtcgaggtcaagctcggcaacttcaagggcaccacgcccgtcagggcggccagccacaacccgtcctggcagcaggtcttcgccttctccgccacgcacctccagtcccatctgctcgaggtcgccctcaaggccaaggatctcgccggcgacgacctcgtcggccgcgtcgccttcgacctcgcggaggtgccggtccgcgtgcccccggactcgccgctcgcgccgcagtggtaccgcctcgagaccaagcgcggcgagaagctgccgcacggcgagatcatgctctccgtctggctcgggacccaggccgacgaggcgttcccggacgcctggcactccgacgcgcacgccgccgcgggcccggcggccgtcgcgtccacgcgcgccaaggtatacttctcgcccaagctcgtctacctccgagtcgcggccatcgccgcgcaggacctcatcccgcatgacacctcgcgcccgatgagcgcctgcgtcaagctgcagctcgccggccagctccgccgcacgcgccccggcgcaccgccggggacgcccaacccgatttggaacgaggagttcatgttcgtcgcgtcggagcccttcgacgagccgctcgtcgtcaccgtcgaggaccgtgtcgcgccaggccgcgacgagatgctaggccgcattttcctgcccctcgcagcagcaatgccgcggcacgaccacttcggcaaacccgtggagccgcggtggtacagcctcatgcgcccctctgatgatcctgataagaaggaagtcaagttcgcaagcaagatacagattcggatgtcgcttgattttgggtaccatgtccttgacgagtccacctactacagcagtgatctgcagccatcatcaaaacctgcaaggaaaccaagcattgggatgcttgagctgggagttctgggtgcgcgaaacttggtaccgatgaagcccaaggatggacgcaccacggacgcctactgtgtggccaaatatggaccaaagtgggtgcgcaccaggactattcttgacacgctgaatccacaatggaatgagcagtatacctgggaggtctttgatccttgcaccgtgatcacagtggtggtgtttgacaatggtcaaattgggagcaagaatggcggtggcccagatcagcggattgggaaggtcaggatccggctctcaacactggagacggacagagtgtacacgcatttctaccctctgctggttttaaatccgagtggactcaagaagaccggcgagcttcatttggctgtgcggtttacctgcacagcttgggtgaacatgatggcgctgtatggtcgtccgctgcttccaaagatgcactacacgcagccgatcgctgtgatgcaactggactacctgaggcaccaggcaatgcagattgttgcagccagactcagccgcgctgagccgccgctgcgcagggaggttgtggaatatatgctcgatgtggattcacatatgtttagtctccggcgcagcaaggctaatttccatcgtatcacctcactgttctttggttttctggcaatgctcaagtggtacgacggcatcaggagctggtggaactcgatcacgacggtgctagtgcacatgctgttcctgatactgatctgctacccggagctcatcctgcctaccatcttcctctacatgttcatgatcgggctctggaactatcgtttcaggccaaggcatccgtcgcacatggacactaagctgtcccatgctgagctgacacaccctgatgagcttgacgaggagttcgacacattcccttcctccagaccagctgaaatcgtaaggatgcgctacgacaggctgaggagcatcggaggccgtgtgcagaccgtggttggggacctggcgacacaaggcgagagagcccatgctttgctgagctggagggaccctcgggccaccgccatcttcgttttcttgtccctggtggtcgccgttgttctgtacgtgacgccgttccaggttctgatggtgataggcatgctttacctgcttcgacatccccggttccgcagcaggatgccctccgtgcctttcaacttctacagaagactgcctgccaggtccgatatgctcctttgatgat

SEQ ID NO: 509 - DNA, 4043 bp, Glycine max
acgatatggacaaactcggcgaagaagagcaactcagaaccagcaccttccaacgcttaaaatcacacactttgcaccttctcgaccttttgcagaaccctcacattcagtatcagaagcattgttctctcaccgtaatcccccaactccttcgtttccttcagagttcttcgccctctacgttacaacccttcttcgactacactctgtttccgttacttctgctcctcgatgcagcgatccagtgcaggtctactcagaaagttgattctcaggaaaattataacatgcctggtgttctgaaaacacctgttaatgtgagtgatggcgttgctgaaggtgtggttaattgtttggaggagcttcttaggaagtgtcgtttgaattctgtggatcagatggttgtgctgctaaaaaagttaacatatggggccatgttatcaccctccgaagcttcagaggagtttcgtgaaggaattttgttgtgcgtcaaggcactgcttttgagcttatattcctgttccgatgtgtcttgcttgtgtgaacaaattcctggtttgcctgcactttcggatgacatttataatgatgaacttcataaaactttcaagtatggttcggaatcagacaaatgtttacttgcatttctccagtctcaatttgcatcagctgctgttggacactggctatcacttcttctcaaaattgcagatacagaggctgctaggggacaaaaaggttctgcaagacttcgaattgaagcattcaaaactctgagggtgcttgttgcaaaggttggttatgcagacgcattagccttctttttgcctggcattgttagtcagttagctaaagttttgcacagtgcaaaaacaatgataagtggggctgctggaaatgtggaatctattgaccaagcaatcagaggtttggcagaatttcttatgatagtcctccaggatgatgctaatgcacctgccctagatattgaagcgtcttcagacttttattcaaatgagtgtaattcaacactttctcttttggatgagcttcgccacttgcaagttaaaaattgtgttaaaacaaaagctgctgaagatacagatgttgagtcagaaaaaatctcttgctcccaaactcaactccaagaaatggggaatactgatcctggcagagagaacatgtctttgcatgtgaaccgaacaaaagattggatgcagaagacatcagcacatgtaaataagctgttgagtgcaacatttccacatatctgtattcacccttcacaaaaggtgagaaagggacttgttgatgctataaaaggactcttgtcagagtgcttctacacactgggggaaagtagactgatgcttttggagtgcttatgtgccttggtcgttgatgtatctaatgatgtgtcttcaactgcacaagatttccttgagtgtttgttctcacaaaatttgaaacatgttataaaacacaatgctgctgagatatttatcaggaaccttgaaaagcttcccagagtggtgcttggccatgaggagtcacatgctgtgttacatgctcagcaattactaacaataatattttattctggtcctcgtctgttagtggatcatcttcagtctcctgtagaagctgctagattcctagatttgtttgctgcatgtctaagccataatacagtgttttctggtttgctcggcataatcactaaaacagatcgatcatcaactctgggatatcttccctccattgctgagttgaaatctggagctaatttcttcaattatggcccccttcttataaattctgctttatctgaagtccctaagtgcaggcttattgaggaaaaaagtatagatgaacctgtgaaaactgctcaaaacaactatgagcttcctcgcatgcccccttggtttagttatgttggtagtattaaattataccagcctcttgcagggattctccgatttgtgggtttatctttagtggcagataatataagtgaagggcttctgtcgcatgtgattgatattctactcggttacttccgtagattggtttctgagcttcgtttaaaagaatacaataaagaaagctggcagtcttggtatgacaggaatggttctggacagttattgcggcaagctagcacagctgcatgcatgctgaatgagatgatatttggtctatcagatcaagcaactaatgattttgctaggatatttcataggtctactctaagcagaggagttcaggttcagtcttacaaacatgatagtgcatttcatgaattttcctggaagaagtccaaggataaaggtgtaaggagttgtttagttgagtgcattggtgggatcttacacgagtatttatctactgaggtatggaatgttccaattgatggcagaattgctgacttgcagcttaatgctgcagttgaagaagatattagcctatactttttccaagatgctgcaatgctacgtgaggttattattgatggagtaggaatctttaatctgtgccttggaagagattttgtttcaagtggttttcttcattcttcactttatttattgctggagaaccttagttcttcaaattaccgagttagaaatgcagcagattctgtcttgcatatacttaccaccacatctagctatacaacagttggacagttagttttggaaaatgcagactatgtgattgattcaatatgtcaacaattacgccatttggatctaaatcatcatgtgccaaatgtgctggcatccatgctctcctacattggagtggctcacaagatattgcctcttcttgaggaaccgatgcgctctgtgtcaacagaacttgaaatactgggtagacaccaacatcctgatctaactgttccattcctaaaggcagtagtagaaattgtgaaggcatcaaaacgtgaagcttgcctgttgcccactcaggcagagtcgtttgccagatatgtcaggtctatggtctctaattcagaagaaacaacacaagacctgtgggaggacattttattcaagttaaatgattctagaagatatagacgaacagttggttctattgctggttcatgtattactgctgcaatcccacttctagcatcattcaagcaagaaatatgcttggccgctctggatataattgagggtggcacgttggcaatagcaaaagtagaagcagcttataaacttgaaagagaaattaaagaagcaacagaagaagcgctacaatcactatcattgtatcaactgaaggatactttggaagctaatgaagaagcggctgatgaaaacaggctgcttccggcaatgaataaaatatggccattcctggttacttgtattcagaacaggaacccagtggctgtccggagatgcttgaatgtgatcagcattgtagtgccagtttgcggaggagatttcttcacacggcgtttccacactgatgggacacacatttggaaacttctgatcacgtccccatttcataaaaagtcaaatttcaaagatgagaagacccctttacaactaccttatagaagcagttccgtgtgttcagaggattcattcgctgagacttcctatcttaaaattcagattgcagtgcttaacatgatagctgatttatgccgtaataagagcagttcctctgcactagaactcgttctgaagaaggtaagtggtctggttgtggggatagcttgtagcagtgttgttggacttcgagatgcttctctgaatgccctccatggacttgcatctattgatcctgatcttgtgtggattctcttggctgatatatactacactgctaagacagaaaattttcctccacctacaccagatttacctgaaatctctgaaattctccctcttcccatatcacccaaagaatatctatatgtgcagtatggaggacagagttatggttttgacatagatttggcttctctggatattattttcacaaaaattgattctcaatatcaaatgtatagctaataa

SEQ ID NO: 510 - DNA, 1203 bp, Triticum aestivum
gctcgagcttcacttcagccccacaaatggcgagcagctcactggtagtactggccgccatggccaccgtggccgcgctgctgctctccccggccacatccctgcccgtcttcaccggcgatgcctccccgggcttccacgccgcgtcgtgcccgcagctggacggcatcgtgtggtcgtccgtcgaggcggcgctgcggcaggaggtggcggtggcggcgggcctgctccgcctctacttccacgactgcttcccgcagggctgcgacgcctccatcctcctcaacaacaccgccgcccgcgagacggcgctgggccccaacctcaccatccagccgcgcgccatgcagctcatcgagtccatccgcgcccgggcgcacgccgtctgcgggcccgtcgtctcctgcgccgacatcaccctgctcgccacccgcgacatcatcgtcatctccggcgggccctggttcaacgtgccgcaggggaacctcgacagcctcgcccctgcggcacaggagaaggtgttcgacctcccggcgcccaaaacggccagcgtggcgacgctagtggagtccttcgccaccaggggcctcggcgacgtcgccgacctcgtggcgctctccggcgcgcacaccatcgggcggtcgcagtgcggcagcttcgaagaccggtcgcagcgcgccgacgataccttctcgcgcaagctggccgccaactgcagcaagcacccggagcggctgcagaacctggacgtgatcaccccggacctgttcgacaacgcgtactacaaggcgttggggttcaaccagggcgtgttcacctccgacatggcgctggtcaagaacaagacgacggcggccatcgtgaagcggttcgccgagagcaaggacgccttcttcgggcagttcgccaggtccatggagaagctcgccagggtgcccaagccggccggcaacgtcggcgagatccggcgcttcagctgcttcaggagcaacgcccagcgtgccgacgctgccgtcgacgccgccggtgaggaggaggaggagggcttctccgcctccgcttgatctgatggttcggtcaagtactaccgtgagtaagatggtcgtcggcaggcaggctagctaccagtgcgttgtgttagcgtgcatgcacggcatggccgtaggccgtagccaatcgtgtttgagttctcggcatgcttcg

SEQ ID NO: 511 - DNA, 1058 bp, Glycine max
tgccctttctatctctctcgtctttctcccacaatgaacgatcttctaacggaatcatttgaaattccacgtggccaaggtcacggaggtggtggtgacattgagttaggagaatatgcaaggaattcaggagacctgggcttggatagtttcttcaagaaggttcaagagcttgataaacaatatgctaagctggataagcttttgaaaaagctccaggatgcccatgaggaatccaaagctgtgaccaaagctccttccatgaaggctataaagcagagaatggagaaagatgttgatgaagttaagaaaactgcacattacttaaagaccaaaattgaagaactggacaaagagaatttggcaaacaggcagaagcctgggtgtggaaaaggatcaggtgttgaccggtcaagaacagcgacaaccatttctttaaaaaagaaactgaaagataaaatggctgaatttcagaccctgagagaggccatccatcaagagtatcgcgaggtggttgagagacgcgtttttacagttacgggcacaagagctgatgaggagacaattgacagattaattgaaactggagatagtgaacaaattttccagaaggctattcaggaacaaggacgaggccagataatggacaccttggctgaaatacaagagcgacatgaagcagttagagatgttgagagaaaacttcttgatttacaacagatatttctggatattgcggtgttagtcgacgctcaaggagacatgcttgacaacatagaaacacaggtttcaagtgcagtggatcacgtgcagcaaggcaacaatgccctccagaaggcaaagaaactacaaaggaactctagaaaatggatgtgcattgcaatcatgatacttctcatcgttgttataatcattgttgttgctgtcatcaaaccatgggttaccaaaaagggtgcatagtatcctatcacttatacctcatgattctttttcctgatccattcttttatttccgcatgttttaagaacattctttccgtgttgtttgcacctgaaag

SEQ ID NO: 512 - DNA, 1913 bp, Sorghum bicolor
ccagcgcgagagaagaagagagggagatggtggggccgcagtacgatctcgtcgggaacccactgggcgcggtgcgcgccaccttcgagaggacggctgccgccgcggcggcggagtccggaggagccgaccctgtggcggccttccgggggaaggattggggcgctggcgacctcttccgctccttcctcttcgagcaagacggccttggcaaggttccggtgttggatgcatcaaatcttggattgatcaaaccaaacaccctggtccggtaccggggaatggtccaggatatgcttgggaatgagtactacattggtgctttcaaggatgggtcaacttggaggacaaacaagttcactgacgtctcaccgttctcaatgccgcatccttgtgattcgcatctttgggagcgccatctcttccactgtgtgcctgcacctggacaaaattcttggacactggagtcttcaccaggacctgatgttcgcaggatgtcaaactgcttggcacctgaattaagagagaaaaggaagagagatggggatgatgatactatggatgtttcagaaaatgggcacagagagtcttcttcattctgcaagaagccgaaggaaggcgatgctcatgtctcatccagttcaactgaagtggcaggaactgttccagagatgaatggaggcgatcatcatatacctggaagttccttttcatgtctggtgaagatctatgatatgcctgaaagtcaagtgaagctaaatgatgttattgagtttattggtgtatatacatttgacccagaacttgctgctcctagtgacaacccagatgacataatgttagacctcatggaagatgtaacagttcagttgcccccgagcaaggtgccacgtcttcactgtttggtatggagaaaattatcatcccacgattatatttcaaggcctgttgttgagccttcacctagcctgttaaaaggcattcggcaatctttgctctctcacctcaccctcgtgttaggcaatgatgaacttgcagcccagtgcttgctattgcatcttctatccagacttcgcaatagggtggacgtggtcactgttggcagactctccttgaatttcactggcttcaacaaggaaagtgcttccatatttgggaatcaactgtattctttaatccagaaattggtgccatattcacaagccatacctctgtcaattgactatctcaacacagccacacttcaacctagaaaggacaacaagtcaggaaggttggtcacaggagttctgcagctacctcaaggcactcatctgacctttgatgagactcttctgcagacagggtcattgacatctaaaggtgtggaaaataccatgctgctcaagaatctgatggagtcgcagaaggttgactacgattttgagtactacaagctggaaatggcagctgatgtgcagctacttactctctctgagggaaaatcaaacatccttccttcagacttggtagtgcctttccggccatcctctgttcccacagttaatgcaggtgctgaggaaactgagagttggaggtggtatttggccacagtaaggtctcttcctcagtccactgaacctgagacctaccagatgattcaagatgaaatggtcagtgccatgcgtgatgataggagcttgggttgttctgaacttagcaggtggctaacaatggcacaaataatggcctcaagctttggtgagaagagtctttctttggagcattggcagatggtgaaggagcttgagaggcttagaaagcagaggatgcaatgagatgatgcatcattagcatgtgtttttacactctaaatgttattatggtggtatgctgttatgtgtatagtactggatgtgtgaatcaagacatgg

SEQ ID NO: 513 - DNA, 1965 bp, Sorghum bicolor
acacgaaacctaccttcctccgggagacgattcgacagggagaggaaagaggcaagaggagccatggacgctgccaactcggtaacgccgggcgccgtgtcgcacatcctggcgcacccgtcgacgggctccgacggcgccgtgccggatctcgtcgtccaggtcctcgacctcaagtccatcggcacgggcagccggttcagtttcatggcaaccgacgggaaggataagatcaaggcgatgttccccaccagcttcgcgtcggaggtccgctccggcaatctgaagaacctcggcctcatccgcatcctcgactacacttgcaacgccgtcaacggcaacaatggcaaagtcttgattgtcatcaaatgcgagcttgtgtgccaagcgctcgacgccgagatcaacggcgaggccaagaaagaggagcctccaattgtgctgaagcctaaggacgaaggcgtggtcgtggctgagcaggcaaatgctcccccagtcgcgattaagcccaagcaggagttgaagtccgcgtcccagatcgtgaacgagcagcgtggaaatgctgctcctgctgcgcgcctttccatgacaaggagggtccatcctttgatcactctgaacccctaccagggtaactgggtcattaaggtgcgggtcacgagcaaaggcaacttgagaacctacaggaatgctcgtggagaaggctgtgtcttcaatgtagagctcactgatgaggatggcacccagatccaggccaccatgttcaatgaggctgcaaagaagttctatccaatttttgagctgggaaaggtctattatgtctcaaaaggatctcttagaattgccaacaagcagttcaagactgttcaaaatgactatgagatgtcactaaacgagaatgctattgttgaagaagcagagggggaaactttcattccgcaagtgcaatacaactttgtcaagattgatcatctaggaacatatgttggtggcagggaacttgttgatattatcggtgtggttcagagtgtatctcccacactcagcgttaggagaaagattgacaatgagacaataccaaagcgtgacattgttgtagcagatgactctggcaaaactgttagtatttctctctggaatgatcttgctactactactggccaagagcttttggacatggttgacagttctcctgttgttgcgataaagagcctaaaagtatctgatttccaaggcgtgtcactttcaactataggcagaagtactcttgctattaatccagacctgcctgaggctcagaatgttaaatcatggtatgactctgaaggcaaagatacttcactagcaccaattggtgcagaaatgggtgctgcacgggctggtggcttgaagtccatgtattctgatagagtttttctgtctcacatcaccagtgatcctgctatgggccaggaaaagcctgttttcttcagtttaaatgccatcataagccacatcaagcctgaccagaatatgtggtaccgtgcttgcaagacctgcaacaagaaggtgactgaagcttttggatctggatactggtgtgagggatgccaaaagaacgactctgaatgctcactgagatacataatggtcctcaagatctctgatcccactggtgaggcatgggtgtccgtgttcaacgagcatgctgagaagatcattggctgcagcgctgacgagcttgatcggatcaggaaagaggagggcgatgacagttacattctcaagctcaaggaagccacctgggttcctcaccttttccgcgtcagcgtcacgcagcatgaatacatgaacgagaaaaggcagaggatcaccgtgaggagtgaagcaccggtcgactatgcagctgaatccaagtacctgcttgaagagatcgcgaagcttactgcttgctagaagatgcaatctttctggtggttcgtgtag

SEQ ID NO: 514 - DNA, 1141 bp, Sorghum bicolor
acaaaccctagccctcaaccacgccgagctcgccggaacccgcccaacccgagcccaattccgctcgggtcccggccgatccggcggctccccaccagcacgatccggggcagcgtccccccgcggatgctagcctgatcgggtccccacggtcgatgggttcgcccgggtccgccaatggcagacgcggcgagtacgtgaggatcccggaggaggtggaggtggcgtccaagggggagggggatgccgcggcggccgtcaaggcggccgcggcggcggagtgcccgagggtgctgcggtgccgcgcgatccggtggtgggccaaggtcgccgtgctcgggatcttccttgcaggggccggagctgctgcggtcgtcttcctcggcccgctccttatcaagaaggttgtttcacctattctttactgggaatcaacaactttcagcagaccagctattgctctaatatgttttggcgcaatcgctttattcccaagtgttttgttaccttcttcgcccttcatgtggcttgcggggatgacttttggatatctttatggctttttgataatcacagtggggatgagcataggcatgtcattgccgtatttcataggctccgcattccacagtaggatacatagatggttggagaagtggccaaagaaagcagcttttgtaaggcttgctggcgaaggagattggcatcatcaatttaaggctgttgcattactaaggatttctccatttccatatatagtttttaattatgcttctgtggctacgaatgtcaaatattacccatacatagcgggttctatggctggaaccatacatgaaacttttcttgcaatatacagtgggaaacttctacaaagcttggctgtagcaactagccatgggtccttcttgtcgttggatcagattatctacaatggaatcggctttacaattgctgcagcttccactgctgcgatcactatttatgcaaagaaagcacttcaaaagctccaagcggaggacgagatattttgagcgcatgaggtccaagccaaggatcaaacccataacgctagtttcctttcaggtgtattatatatgaacagttgctactaatttggtttcctgtgtcaactacctga

SEQ ID NO: 515 - DNA, 3317 bp, Sorghum bicolor
ttccctcctcccaaatctcaaaccccgctcccagctccgccgccgagcaaaaccctaggggcttcccagcgctgccgccgccgccatggacgacagcctctacgacgagttcggcaactacataggcccagagctcgccgactccgacgccgatgacgactccgacgctggcggcgcctcaccgtccccctccgcgtccggctcgccgtcaccggcggcgcgctcctcgtcgggctccccctcccgcccagccgcgctcatggacgtcgacgacgacgagggcgacccgtcccagcaggccgtggtgctcgccgaggacaaaaagtactaccccaccgccgaggaggtgtacggacctggcgtggaggcgctcgtcatggacgaggacgagcagccgctcgagatgcccatcatcgcgccgccccgcgtcgtgaagttcgaggtcgggacccgcgccgcggccacgtctacctacgcgtccaccgacttcctcctcggcctcgcgggcaaccccgcgctcgtccgcaacgtcaccctcgtcggccacctccagcacgggaagacggtgttcatggacatgctcgtagagcagacacacgaagtggacaccttcgactctgagggggagcgccatgtgcggttcactgacacaagggtggacgagcaggagaggcaggtctccatcaaggctgtgccaatgtcgcttgttctcgaggggggaaacggcaagtcatacctgtgcaacatcatggacacgcccgggcatgtcaacttctctgatgagatgactgcagcactgagacttgcggatggcgctgtgctcgttgttgatgctgccgagggagtaatggttaatactgagagggcaattcgtcatgcaattcaagaaaggcttcccatcgttgttgtgattaacaaggttgacagattgataacagaactaaagctgcccccaaatgatgcatatttcaagctgaggcatactctagaggcaattaatgatcttatctcatcatgttctactacagtaggtggcactcagctggtggatcctgctgctggaaatgtatgttttgcaagtggtgctgctggctggtcttttaccttacagtcttttgcccatctctacttaaagattcatgggattcaatttgaccatgagaaatttgcatctcgcctatggggagacctgtattttcaccctgattctagaacctttaaaaagaagccgccaaaggaaggagctaacagatcatttgttgagtttatccttgagcctctgtacaaaatttatagtctggtcgttggtgagcaaaaagggaatgtggaatcaaagcttgctgaattgggtgtcacgttgagcaatgcagcttataagcttaatgttagacctttgctgaggttagcttgccgctcaatttttggcactgctactggttttaccgatatgttagtgaaacatatcccctcagtgaaggatgctgctgcaaggaagatagaccacatatacactggaccacaagattcctctattgtggatgctatgaaaaaatgtgatcccaatggaccccttatggttaacgtaacaaaactatatccaaagtctgattgcagtgtctttgatgcctttggacgagtttacagtggcacaatacagactggacagactgtgagggtccttggagaaggctattctccagatgatgaagaggatatgactgtcaaagaggtgaccaaattgtgggtttatcaggcacgataccgtgttgcaattagtaaagcccctgctggctcttgggttcttattgaaggtgtagatgcatcaataatgaaaactgctactatatgtcctatgaatattgatgaagatgtatacatatttagacctctacgtttcaacaccttgcctgttgtaaaaatagctgctgagcctctcaacccaagtgagcttcctaaaatggtcgaaggtcttcgtaaaattagcaagagctatcctcttgctattaccaaggttgaggagtctggagagcacactatcctggggactggtgaactatatctggattccataatgaaggacctcagagagctttattcagaggttgaggtgaaggtagcagatcctgttgttacattttgtgaaacagttgttgatacttcttctatgaaatgttttgctgaaacacctaacaagaggaacaaaattactatgcttgccgaaccattagagaagggcttagcagaagatattgagaatggtcttgttagcctggattcaaggcagaaagaaattactgacttctttcgccaacgctaccagtgggatgtgcttgcagctaggtcgatatgggcttttggacctgacaagcagggtcctaacattcttctggatgacacactttcaattgaggttgacaagaacctgctcaatgcggtcaaagattcaattgttcaagggttccagtggggtgctagagaaggtcctttgtgtgatgaaccaattaggaacgtgaaattcaagatcttaaatgcaaacatagctccagaaccattgcatcgtggtggtggtcagataattcccacagcacgtcgtgttgtctactctgcattccttatggctaatcctcgccttatggaacctgtgtattatgttgagatccaaacaccaattgactgtgtgtctgcaatttatacggtgctatcccggcggcgtggtcacgtaacagctgatgtgcccaagccaggcactccaatatacattgttaaggcatttttacctgttatagagtcttttggatttgagacagatctcagataccatacccagggacaagccttttgtttgtcagtattcgatcactgggctattgttcctggtgaccccttagataagagtattgttcttcgccccctggagccagcacctatacagcaccttgcccgtgagttcatggtaaagaccaggcgaaggaagggcatgagtgaagatgtgagcatcaataaattcttcgacgaggccatgatgaatgagctggctcaacaggctgctgatatccacttgcaaatgatgtagtccaaaagcgagatgaggtgcacacttgagaagatgcaaatgccttcagcttctttatacactagctgcagatgggacttccggagttccagtcacaccactatatgctggcatttgcccgtaccagtttttgcttggctgacacattttgattgctgggtttcatgtagcgaatgatcatggtggtaccgtatgcaatcatgtatgtactagcttctacaccatctaaccaatcagcaccctt

SEQ ID NO: 516 - DNA, 2481 bp, Sorghum bicolor
atctcacaagttcagctcctgctagcctatcaggatggctgaggaaactgccaatgaagttcaggtggcacaagataacgagattgtccccggcaatgaggcaatccaaggcgatgaatttgtccatggtgatgagttgatccaaggcgaagagttggctcatggtgaagagctgccccaaggtgatgatttggttcaaggaaatgagctggttgtttctgaggtagcaacccctcctactactggaaccagacgtaggagaaaaaagtccttggtatgggagcacttcactattgaagccgtcgccggtggggccacaagggcctgctgcaagctctgcaagcaaacctttgcttacagctctggttcaaaaattgctgggactagtcatctcaagaggcacatcaccttgggctcctgtccaaagataaagaatcaagagcagaggctggcactaccttcaaccggagggactgacaatgatggtgagggaactatcgagcgcccaaccaagagacgctacagatatactggctatgcaaatgctgcttttgatcaggaccgcagttgctcacacttggcaaagatgatcattcagcatgactacccacttcacattgtccaacagccggcattttccatttttattgaaagtctgcagccacgtttcaagattgtggatgttgatacgatggaaggagaggtgtatgctgtttatcagaaagaaaaggagaacctgctacaatcattcagcactatgcctggaaggatcagtctcactataggattgtggacaactagtcagactcttgggtatgtttcacttgcagggcagtttatcgactccgagtggaaagtgcatcgaaggatgcttaacttcatgatggtgtcatctcctcattcagagaacgcacttagtgaggcaattagcctgagcctttctgactggaatatgaaggacaagctattcaccatcacattggataatgattgctcctcacatgatatctacagtgcaaatttgagagatcatctctccaacaagaacaatctcatgcttaagggacagctctttgttgtgaggtgctacgcccatatccttaatgctgttgcacaagatgtcattgcttcgattcatggtgttgtatacagcatccgtgaaagcataaagttcataaaagcttcttctgcccgtgaagagaagtttgccgagattgctctgcagctggagattcccagtactaagaccctctgtctggatgttacaacccagtggaacaccacttatctgatgttgttagctgccttggattataagcagactttcactacactagaaacatgtgatgataactacaatgaagctccgtcagcagaggattggaagaaagttgaggctgcctgtaattacctgaaactgctatacgattctgcacatagcatcatggcagcagcaaacccaactgcaaacatctttttccatgaagcttggaaacttcagctagagctagcaaatggcacaggacatgaagatcccgctttcagtagcatcgccaaggatatgcatgagaggtttgacaagtactggaaagattgcagcctcgtgttagccattgctgttgtcatggatccacgttttaagatgaagcttgttgagttcagttactcaaaaatttatggggctgaggccgcaaagtatgttaaggtggtcaatgatgctgtacatgagctgtataaggagtatgtggctcagccactcccactgaccccagcttatgttgagcaaggtgaagggaataatggaccagccaatgcgaataacagtcaaggcccgcctgcttccactggtgatgggcttctagactttgatatgtacctttccgagatccaaagtagccagccctcgaaatctgagctggaacagtacctggatgaatccctcactccacgtatccaggagtttgatatcctgaactggtggaagctaaacacagtaaagtttccaaccctctctaaaatggcccgtgatatcttggccattccaatgtccatggtaagcagtggcagctctatattctctgctggaacaggaagtcacatgctcgatgattacagaagctctctccgacctgagattgtggaagcacttgtctgtgcaaaagactggctccagtattcaccacctgccaccgaggcaccgagttctgcactggtgaaggctgaaggatcgtaggtttgtcgtcgccactgatcactgcctgccttgtggaagcaagaatctatttatccatctgtcgtatctatgagtgtagttaactgtaggtgtattgtaggctgagattgtgaactgattgtgatctattctggtatttatctcgtaaaggtgtgtaacttgtgttgaactctgctgaacttgtcactgttgtcatgtaatagtttatgtatcattttctggtatcgtctgatgttggagtttgcatg

SEQ ID NO: 517 - DNA, 2120 bp, Oryza sativa
tccgagttaaccaaacagaagccgatcagagaccctaccctccgccgatgcgtcgagaagaagcctccgccgccgccgccgccgccgaggctgggaccccgcgctcaccggacctccacgacctctccgacgactccgactacgccgccgccgccgccgcgtcctccagtcactcggcgatgcggagcgatctggtggatcaagggtcgggcgagacggcgaaggtggatgtggtgtacgagaaggagcgtgtgacgatccacccgacgcagtatggctccggccggatcagcgggaagctgcgcctctacttgcagcagggctccctgttcctgagttgggagccaaatgagggagttgattctttatcaagcaattcagctaccatggaaatagaaaaatatagaaacctgtacactataaaggccttgccattaagtgatgtacgcttcatccgtaagcacaccccgacatttggattcgagtacataatcattgttctctcatcaggattggcttttcctccattctatttctacaatggtgggcttcgtgaattgtttgcgacactaaagaagcatgtttttattatcaggtcggacgatgatcctaatgtatttcttgtcaacgactttcaagatcctctacagaaaagtttgtcatcactggagcttcctggtgttgccaccgtagcaaatgccatgtcacgacagaactcactcagtttcactagttcagttgatgaagccagacatgggagtgatgccaaacatggggcatcttctagcatgactgaatatgtctcaaagcaaaagcacagatcgaatgatccgggtcgtgatctttctatccaagtactggagaaattttctctggttacaaagtttgcacgagataccacgtcaagtctttttcgggaaaaccacagtagtggtggtcatacttatggaaggcagcagcaagaatatgttttggacaacagagcaaatgataagtacaaagatcagcaaataacaccagataaggattctttgctgtcagattcaatggagtctaataaaattctagcgtggggaaaaccaagagaacaaccgttgagtgttgatgagtggagatccttcttagatcctgaaggtagagttatggattcgaaggcgctgaggaaaaaggttttctatggagggattgaccatgttctgagaaaagaggtctggaaattcctgttggggtatcatgaatacgattcaacatatgccgagagggaatatcttgctgtcatgaaaagaacagaatatgaagccataaaatcccagtggaagagtatttcgtccacacaagctaaaagatttaccaagtttagggaaagaaaaggccttatcgacaaagatgtggtgaggacagatagatcagttccatattatgaaggagatgacaatcaaaatgttcttgtgctacgggatatcctgttgacgtattccttctataatttcgaccttggctattgccaaggaatgagtgattttctggcacctatactttatgtgatggaggatgagtctgagtcattttggtgctttgcaattttgatggaacgactaggagccaattttaaccgtgatcagaatggcatgcatgctcagttacttgcattatccaagctcgtggagcttcttgatcctcagttacataactattttcggaagaacgactgcttaaactactttttctgttttcgttgggttcttatacaattcaaaagggagttcagtttcgatcaaatcatgctgctgtgggaagttctgtggacacattattggtcagaacatttccacctctacttatgcgtcgcgatcctgaaaaggtaccggtcgcggataataggagagcagatggatttcgacacccttctcaagttcatcaatgagctcagtggcgagataaatcttgaccgggcaattcaggacgcggaggcattatgtgatcaggcaggccctaacggggctgcctgcattcctcctggaaccccgccttctatgcccatcgagacggacggtggcctctacgtacaagaagacgaggtcatgtgagataccggcgattcagtggtcacctcatactag

SEQ ID NO: 518 - DNA, 1855 bp, Oryza sativa
acagggacagcgttccagccatggacaagggcgccctgatgccgtcgcccgacgagacgtgctgcgtcggcggaggcgggggctcgtcgttctcgagcctgcgcgcgtacgggcgcgcgctggcgcagacgccgcggcggctggcggcgcgggcgtgcgccgcggcctcgcccggcgaggagatgagccgcgtgcgcgcgcgctcgggggccgacatggcgcgcgccctgcggtggccggacctcgtcgggctcggcctcggcggcatggtgggcgccggggtgttcgtcaccacggggcgcgccacgcgcctctacgcgggcccggccgtcgtcgtgtcgtacgccattgccggcctctgcgcgctcctctccgccttctgctacaccgagttcgccgtcgacatgcccgtcgccggcggcgccttcagctacctccgcgtcaccttcggggagttagcggcgttcttgacaggggcgaacctgatcatggagtacgtcttctccaacgccgccgtggcgaggagcttcacggcgtacctcggcacagcggtgggcgtcgacgcgccgagcaagtggcggatcgccgtgccaggcctccccaagggcttcaacgaggttgacctcgtcgccgtcggcgtcatcctcctcatcaccgtctgcatctgctacagcacgaaggagagctcgtcggtgaacatggtgctgacggcagtgcacgtgttgttcatcatgttcgtcattgtgatgggattctggcgcggtgacacccggaatctgacgcgccccgccgacccggagcacaaccccggcgggttcttcccgcacggcgctgccggggtgttcaacggcgccgccatggtgtacctgagctacatcgggtacgacgcggtgtccaccatggccgaggaggtggagcggccgtcacgcgacatccccatcggcgtctccggctccgtcgtgctcgtcacactgctctactgcctcatggccgcttccatgtccatgcttcttccctacgacgcgattgacacggaggcgccgttctctggggcgttcaaggggagctctgggtggggatgggtgtccaacgtgatcggcgccggcgctagccttggcatcctaacgtcgctgatggtagcgatgctgggacaagctaggtatctctgcgtcatcggccgatccggtgtcatgccggcctggctcgccagggtgaaccctcgcactgccacccccgtcaatgcctccgccttcctcggggtgttcacggcggcgctggcgctgttcacggagctcgacatcctcctcaacctcgtctgcatcggcacgctcttcgtcttctacatggtggccaacgccgtcgtctaccgccgctacgtcgccgccgccgaggacgacgaggaggggcggcggcgcggggcggtgccgacgctggcgttcctgctggccttctccctggtggcgctctgcttcacgctggtgtggaagctggcgccgcgcggcggggccaggacggggctgctggtggcgtgcggcgcggcggccgccgccgccgtcgcggcgttccgggcgctggtgccgcaggcgcggcggccggagctgtggggcgtcccggccatgccgtgggtgcccgcggcgtcggtgttcctcaacgtcttcctcctcggctcgctcgaccgcccctcctacgtccgcttcggcttcttcaccgccgccgccgcgctcgtctacgtgctctacagcgtgcacgccagctacgacgccgacgaggccgccgccgcgctcgacggtgccaaggtgctcgacgagggctgcaaggtataactagctttggggggtggctgacatgtagggac

SEQ ID NO: 519 - DNA, 1055 bp, Oryza sativa
gccgatcttgtgttctagtgagttgctgcagccatgaacaatctcttctctagctcgtggaagcgcaccggcggcggcggcggcggcgacggggatattgaatcgggcggcggcgtggagatggcgccgccgccgggggcggcggcgggggcgagccttgataggttcttcgaggacgtggagtcgatcaaggacgagctccgcgacctggagcggatccagcggtcgctccacgacgccaacgaggggggcaagtcgctgcacgacgcggcggcggtgcgcgcgctgcgggcgcgcatggacgccgacgtcgccgccgccatcaagaaggccaaggtggtgaagctccgcctcgagtcgctcgaccgcgccaacgccgccaaccgctccgtccccgggtgcggcccgggctcctccaccgaccgcacccgcacctccgtcgtcgccggcctccgcaagaagctccgcgactccatggaatccttctcctccctccgcgcccgcatctcctccgagtaccgggagaccgtggcgcggcggtactacaccgtcaccggcgagcagcccgacgaggcgacgctcgacaacctcgccgagaccggggaaggggagcggttcctgcagcgcgcgatcgccgagcagggccgcggcgaggtgctcggcgtggtcgccgagatccaggagcggcacggcgccgtggcggagctggaacgctcgctgctcgagctccaccaggtgttcaacgacatggccgtgctggtggcggcgcagggggagcagctcgacgacatcgagacccatgtcggccgcgcgcgctccttcgtcgaccgcggccgcgagcagctggtggtggcgcggaagcatcagaagagcacccgcaagtggacctgcatcgccatcatcatcctgctcgtcctcatcctcgtcgtcgtcctccccatcgtgctcaagttcgtcaacaacaacaagagcagcagcagctcgccggcgccggcgacgccgtcgccgccgccgccaacggcatgatggtcgtatgatagtccatgttgagttca

SEQ ID NO: 520 - DNA, 1205 bp, Zea mays
cgagcagagagaatccaagaacgcgcaagagcccccctcgtcaccaacgtccatgggcggcgctgcgggcgaggcgatgtgggccgctgttgtggcggcgacggtggtcttcttggccgtcgaggtttcgggtgccgcgtcggcgttgccacggtttgcggaggcgcctgagtaccggaacggggaagggtgtccggctgcggcggcgggggtgtgcgacccgggcttggtgcacatcgccatgacgctcgacgcgcactacctgcggggctccatggcggcggtgtactcgctgctcaagcacgcgtcctgcccggagtccatcttcttccacttcttggccgcggaggccggggcagtggacggggcggacccggagccggagctgctgcggcgcgcggtggcggcgtcgttcccgtcgctgcggttcgagatctacccgttccgcgccgaggccgtggccgggctcatctcggcgtccgtgcgcgccgcgctcgaggcgccgctcaactacgcgcggaaccacctagcggacctgctcccgcgctgcgtgccgcgggcgatatacctcgactccgacgtgctcgccgccgacgacgtgaggcggctctgggagacgcgcctccccgccgccgccgtggtggcggcgcccgagtactgccacgccaacttctcccgctacttcacgccagcgttctggtcagacccggtgctcggggcccgcgtcttcgccgggcgccgccggccgccgtgctacttcaacaccggcgtcatggtcatcgacctccgccgctggcgcgccggcaattaccgccaacgcatcgagcgctggatggaaatccagaagcagaagcgcatctacgagctgggctccctgcccccgttcttgctcgtcttcgccggtgaggtcgaggccgtcgaccaccgatggaaccagcacggcctcggcggcaacaacgtccacggtagctgccgcccgctccacgctgggcccgtcagcctcatgcactggtcgggcaagggcaagccctgggaccgcctcgacgccggcaggccgtgcccgctcgaccacacctggaagtcgtacgacctctacatccccggcgactctggaggcgccgcctcgccggcgtccgggccggcattgtccgcatccgtgttctcttggtagagagatagcttctagttccattgtcttgctgtgg

SEQ ID NO: 521 - DNA, 1556 bp, Zea mays
ttacgattattccagataagcacgatccgatgatggccccaccgatatccgccgatgccttggtggaggctgcctcggccgtcgccgcgtacccagccatcgcgccgaacagaatgctttgcaaggacgcgccggcgccggccatctctgtcgtctcgaagcagacggtccggcccgccggcgcgtcggcggcggtcggcagtggagacctcaggctctcggtgtcggacatgccgatgctatcgtgccactacatccagaaggggctgttcttcccgccgcctcctcccggcgtgctggcggcctcgctggtgtcgtcgctcgtggcggcgctctcccgcgcgctcggcgtcttccccgcgctcgccggccgcctcgtcacgctccacgacgacagcatcgtgatacggtgcggcggcgacgacgccgccgtcgagttctaccacgcggtggcgccgtctctgtcgctcggcgacttcctggtgcccggcgccgacgtgccgacccgtttgacgaacggcctgttccccatggaccggacggtgagctacggcggccacggccgcccgctcacgacgttccagctcaccgtgctcggcgacggcgccgtgttcgtcggcttcgtcgccaaccacgccgtcgtggacggcacctccttctggcacttcttcaacacgtgggcggggctgtgccgcggcgcgccggtccgggagcccgacttccgccgcaacttcttcggcgactccaccgccgtcctacgcttccccggaggcgcgagccccgccgtgacgttcgacgccgacgcgccgctccgcgagcggatcctccacttcagtgctgccgcaatcagcgagctgaaggcgacggccaaccgctcgaaaagagcaggtcaggaagccgaggctaacggcaagctcgcgcacgacgactccagacttgaagggcgttccggtgaaatctcgtcgtttcagtcgctgtgcgcgcacatctggagggcggtgacgcgcgcgcgccggctgctggctgccgacaagacgacgacgttccgcatggccgtgaactgccggcaccgtctgcgcccggcgatctccccgctctacttcggcaacgcgatccagagcgtggcgacgacggccaccgtagccgagctggcgtccaacgacctgggctgggcggccgcccggctgaacgccaccgtggcgtcgcacaaggacggcgcgatccggcgcgccgcggcggagtgggaggccgcgccccgttgcttcccgctaggcaaccccgacggggcggccctcacgatggggagctcgcctcggttcccgatgtacgacgggaacgacttcgggtggggccgcgcgctcgccgtgcggagcggccgcgcgaacaaattcgacggcaagatgtcttcgttccccggacaggctggggacggtagcatcgacgtggaggtgtgcctcgcgccagacaccatggcgcatctcctcctcgacaaggagttcttgcagtacgtgtcctcccctgcaccgtgaggcggtgacagagtgaatgtgtggtag

SEQ ID NO: 522 - DNA, 1036 bp, Zea mays
ggcttcctacaacttcaaaatggcggctaccgccaccgccatggctatagcaactatctcccccgccgctccgattccatccgcgcccttcccatcccttctcctccccctcggcctccgcctccgctctcaacccctcctcttcgctgcttcccgccgccgcttcctccacgttcccaaagccgcctcctgggacgaatctgtccccgaggatggtggggatgcggaggaatccgttgccgctggggacgacgaggacgaggacgagaagccgcggcccgagccggtgtcctcctccgagttccagttcgcggcgccacccgagggctacgtcgagcccgcggcgtttgacgagctaccgccggagtccccagaagacgtggcggcggcgtacgaatctctctacgggccggccttcagcggcgagacattgctggggaacaatgtctttgaggtcaaggtggtcgaccccatcgacatggaccgggagcagcgcccgaacgacgatttcaccgagcgcgtcgtgcaggtcaaccgcgtcaccaaggttgtcaagggagggaggcagctctcctaccgcgcaatcgtcgtcgttggcgacatgaagggccacgttggtgtcggcgtgggaaaggccaaggaggtcacggaggccatcaccaaggccgccatgaacggccggcgcaaccttgtcacagtgccgctaactaagtactccacattcccgcacagagctgatgcggactatggagcagccaaggtgatgttgaggcctgcttgccctggatctggtgttattgctggtggagctgtgagggttgtgttggagatggctggtgttgaaaatgctctgggcaagcagctgcgcagcaagaaccccctgaacaacgcccgagccactatcaaggcgacgcagatgatgaagcagttcaaggatgtcgctgaggagcgtggtattccaatggaggagctgtggaaatgataaaaacaattcgaaaccaagaccccccctttgtagcattctttctcctgtcgc

SEQ ID NO: 523 - DNA, 1806 bp, Zea mays
caggcactcaccaaggaaacctttttaaatctggccccttgacgcgcagcgggagaggctcatcaccccgtgtgccctcgcctcgcctcgccccgccgcccgccccaatcgaccaatcccgtccatatcaaaaaaatgggaattgtcgccgccgccaccaccgccgccgccacgtgcacgtcccgactcctccaccaccacgcaacctatcaccggcaccagctcaggtactctgcgagtccgtttcctctctcgctgcactgtggctccggccggcgtgaggcggcggcccgggcgctcctgcccgaccgcgtcaccccgttctcttacggcgtggatgaggacgcggatgaccacccgcgcgaggagtgcggtttagtcggggtcgtgggcgacccggacgcgtcgtcgctgtgctatctggggctgcagaagctgcagcaccgcggggaggagggggccgggatcgtcgccgtgggcggggacggcaagctcaagtccgttaccgggctgggtctcgtggccgacgtgttcggggacccgtcccggctcgcctcgctcccgggtcccgccgccatcggacacgtgcgctactccacggccggcgccgccgcttcgctgcgcaacgtgcagccgttcctggccgggtaccggttcgggcaggtcgccgtggcgcataacggcaacctcgtcaactaccaggcgctacggaacaagctcgaggccagggggtccatcttcaacacgtcctcggacacggaggtcatcctccacctcatcgcgacgtcgctgtcgcggcccctgctcgcccgggtctgcgacgcctgcgagcgcctcgcggggtcctactcgctcctgttcctcacggccgacaagctcttcgccgtgcgcgacccacatgggttccgcccgctggtgatgggccgccgccggaacggcgctgtcgtcttcgcgtcggagacctgcgcgctggacctcatcgacgccacctacgagcgcgaggtggagcccggggaggtggtcatggtcgaccgccgcgacatgtcggtcgcctcggcctgcctcctcccgcaccgcccccggcgcgcctgcgtgttcgagcacatctacttctcgctgcccaactcggtggtgttctcgcacgccgttcacgagcgccgtaccgccttcggacaggcgctggccgaggagtcccctgccccgggcgccgacgtcgtcatcccggtgcctgactcgggcttctacgccgcgctcgggttcgcacgcgcgtcggggctcgagttccagcagggtctcatccgttggcattacagcggccgcagcttcatccagccgacgcaagcgatccgggacctcgccgtgaagctgaagctcgcccccgtgcgcggcgtcatcaccggcaagagcgtcgttgtcgtggacgactccctggtgcgcggcaccacctcgagcaagatcgtgcggctgctccgagacgccggcgcgcgggaggtgcatatgcggatcgcgagcccaccagttgtgggctcctgcctctatggcatcgacacgccgagcgagggcgagctcatctccaatcggatggacatggatggcgtgcgccgggagatcggcagcgactcactcgccttcctctcgctgggcaagctgcacagcatctacggcgaagagtcgagggactactgcgacgcgtgcttctcgcgcaagtaccctgtgctgcccacactagccgacccggccgccgagccggaggagtgagccgggagcagatgagctctgctctgctctgcttcgtctgccatactt

SEQ ID NO: 524 - DNA, 334 bp, Zea mays
ggcgatggcgaagaatcccaaagatgccgctccggaggaggagatgcccgccgcggccgaggaacaggcagcgcctgcagcgacggtgaaggtgctcttcttcgcccgcgcgcgggacctaacgggcgtggcggattccgcggtggaggtgccgccggggagcaccgcgggggagtgcctcgcgcgggtcctagcccggttccccaagctggaggagatccggggctccgtcgtgctcgcgctcaacgaggagtacgcggccgactcggccgcggtcgccgacggcgacgagctcgctgtcataccgcccatcagtggcggctgacgttattaa

SEQ ID NO: 525 - DNA, 1457 bp, Zea mays
agggtagtttgcactttgcagatagctagctagctagcagttaggggatcaggcatgggtgagggcgaggcggaggtgaagggcggggtgctgcagggccgctacgagctcggccgcgtgctgggtcacggcaacttcgggcgcgtccacgcggcgcgggacctgcgcaccgggcgggccgtggcggtgaaggtgctcgacaaggacaagatgctgcgcacgggcatgatggagcagatcaagcgcgagatcgccgtcatgaagcgcgtgtcccaccccaacatcgtggagctccacgaggtgatggccacgcgctccaagatctacctggcgctggagctcgtccgcggaggggagctcttcgcgcggatcgtgcgcgccgggcgcgtcaaggaggacgtggcgcggcgctacttccggcagctcatccacgccgtggacttctgccacgcgcggggcgtgtaccaccgcgacctgaagctcgagaacctcctcctggacgacgcggggaacctcaaggtcgtcgactttggcctcagcgcgctggccgaccacgcgcgcagcgacgggctgctgcacacgctctgcggcacgcccgggtacgtcgcgccggaggtgttccggaacaagggctacgacggcgccaaggctgacatctggtcgtgcggcgtcatcctctacgtcctcctcgcagggtcgctgccgttcccggacgacaacgttgccgccatgttccggaagatgagccgcggcgactaccggtgcccgccgtggctgtccacggaggcgcgcaggctcatccccaagctgctcgaccccgaccccgacacccgcatcaccatcgcccagctcgtcgagacgccgtggttcaacaagccgtccgtctcgaggtccgtcagagccgccgccggcgcaaccgagccgccggccgagcctgcctcctccgcaaaggacggcggcgacaaggacgagccaccggagacgatgaacgcgttccacctgatctccctctccgcggggttcgacctctcaccgctgttcgacgtggaaggcggtccggcgagggggccccgggagggcggcatgcggttcgcgacgcgggagccggcgagcggcgtcgtctcccgtctcgaggaggtggccgcccgcggcggcgggcggatgcgggtgaccaagagcggcgcccgcggcgttcggctcgagggcgcggagcgcgggggccgcaagggccggctagccgtggcggccgacatcttctgcgtggcgccgtcggtgctcgtcgtcgacgtgaagaaggacggcggcgactccctcgagtaccgctccttctgcagcgaggagctccggccggcgctcaaagacatcgtctgggcggccgacccccagcccgccgtcgtgtgacgcccgtgctgccgcctgcccgctcattgtttctggatcgtagtggtgccatagtt

SEQ ID NO: 526 - DNA, 3452 bp, Zea mays
agcgggacaacagacacaggggcacagaggaaccggcgcggggcggcgcaatgggggacgctgcggcggcggggaccctgcacaagagctacttcgacgtgctggggatctgctgcccctccgaggtgcccctcgtcgagaagctgctgcggccgctgcccggcgtgcgcaccgtcaccgtcatcgtcccgtcccgcaccgtcatcgtgctccacgacgccgccgccacctcgcccgcgcaaatcgtgaaggcgttgaaccaggcgaggctagaggcgtccgtgcgggcgtacggcggtgggtcggacgggaggcaggcagccggcagcaagagatggccgagcccgtacgtcctcctctgcgggctcctcctcgtcgtctcgctcttcgagcgcctctggcctcccctcaagtggtgcgcgctggcggcggcggccgccggcctgccgccgatcgccctcaggagcttcgcggccgcgcggaggctcaccctcgacgtcaacatactcatgctcatcgcagtttccggggcgatagctctcaaggactactccgaggctgggttcatcgtgttcctgttcactacggccgaatggctggagaccagggcgagccacaaggcgactgctgggatgtcgtcgctgatgagcatggcgccacagaaggctgtcgtagcagagacgggggaggtggtggcggctcaggacgtcaaggtgggcacggtgctagccgtcaaagccggggaggtcgtgcccatcgacggcgtggtcgtggacgggcggagcgaggtcgacgagagcaccctcaccggggagtccttcccggtcgccaagcagccggagtcccaggtctgggccggcacgctcaacatcgatggctacatcgctgtcaggacaactgccatggcggacaactctgccgtcgctaagatggcgaggatggttgaggaagcacagaacagtaggtcccgaactcagaggctgattgatacgtgcgccaagtactatacgcccgctgttgtggtcatggctgcgggggtggcggtggttcctgtggtggtgagagcgcacaacctcaagcactggttccaactggccctggtcctgctggtgagcgcgtgcccgtgcgcactagtgctgtcgacgccggtggccaccttctgcgctctcctgacggccgcgaggacggggctcctcatcaaaggaggggacgtcctcgaaaccctggccaggatcaagattgccgcctttgataagacaggtacgatcactcgaggggagttcagcgtcgaggagttccaggcggttggcgagcgcgtcactacgccacagctcctttactgggtctcgagcattgagagcagatcgagccacccaatggcgtctgtgctggttgattatgcccagtcgaagtcagttggacccaaatctgataatgtcgccgagttccaaatcttccccggtgaggggatttacggtgagatcgatggggaaggtgtgtatattgggaacaagaggattttgtcaagggcctcatgtgaaacagttcctgacatgaaagatatgaaaggagttaccgtcggatacgttgcctgcaaagggcagttaatcggagtattcactctctcggattcctgccgaactggatcagatgaggccatcagggagctgaggtcgctgggcatcaagtcagtgatgcttactggggatagttctgcagcagcttcatatgcacagaaccagcttgggaacatacttgatgaggttcactctgagcttcttccagaggacaaggtgaggatcgtcgacgagctcaaggcaaagcatggcccgactctgatgatcggcgacggcatgaacgatgccccagcgctggccaaggccgacgtcggagtctcgatgggggtatctgggtcagcggttgcgatggagacgagccacataaccctgatgtcaaacgacatccgccggatcccgatggccgtccagctggcgcggaggacgcaccggacgatcgtcgtcaacatcgtcttctcggtgatcaccaagcttgcgatcgtcgggctcgcgctcgccgggcatccgctcatctgggcagccgtcctcgcggacgtcggcacatgcatgctggtgatcatgtacagcatgctgctgctgagatcggaatcgaacggcggccggaaggtgaagaagtgctgtgcctcgtcgcagcatgggtcacactcacacgccaggaagaagcattgtgtctcccaccactgttcagatggcccgtgcaacaagtcgacggcaggctgttccaaggaatcgccgtctgctggtaagcatgcttgcagtgatcatggccatgcccacacccactgcaaagagccgagcaaccaccggccggaaaggcatgcctgtcatgatcacggccacagccataaccactgcaaagagcccagcagccatgtggttacagaaaagcatgtctgccatgaccacggcaacacccatagccactgcgaagaggcaggcaaccagctgctgcttgtagagagccacggttgcaatgaccatggccatgggcatagccatgaccgctgcaaagagctcagcagcccgcgcttcaccagcaagcacgagtgccatgaccatgagcatagccactgcaaagagcccaagactccgtgtgctgacagtgaggctgcttgccatggccatggccatggacacgaacatcggcactgcgaaggggacagccactcacacgctacaggtgagcatggctgccatgaacatgatgcgcacagccactgcgaggagcacggccattcagacaccgctgttgagcatgcttgcgagcatgagtgccatggtgagcaccaaactgtgcacgctgtggaaacacaccactgccatgaccacgaccatgagcacggacagcatgagcttggggagatcgaggaacctgagaaggactgccacgaccacagccaccactgctgccatgagcctcacggcaaggacaaggtcgcggccgagccagttgaagaggtcacgatctcaatcgctgccctgcccaaagacgaaggccaccaccacagcgaggaacaacacaatggggagcactgcaggaaggcgaaagactgcggcggcggcggcggcgctgctcccaccgactgcgctgcgagcaagaactgctgcggcgtcaaaggtggagacgcctgctcgagcgtgcaggccgcgcgtgctagggagaccggcccgtgctgccggagctacgtgaagtgccccaggacggcggcggcgagcaggagcagctgctgcggccacagcatgctgaagctgcccgagatcgtggtagagtagtagtagtactgtagtagggtggaaattccaccgtgggagaagggtgtgcacatatgaacaagcaactgtgaggtgagtgtgactcgccggcgtaaatgttga

SEQ ID NO: 527 - DNA, 1218 bp, Zea mays
tagcgtaggctgtactggttctcccgcgtcggcgtcgacggccgtgtccttctcgggaagatggtaatggggggcgcgtccgtcggcacgctgctcgtcgtgctcgccgtcctcgctccggcggtgatggcgcagagctgcgacgacgagctgccggctcagctcgccggcaacttctcggggctcgcctgcgcccccgtctggaacaacttcgtgctccggtacgcgcaggacaaggacaacgtgctgcgggtggtgctgtcgaccatgtacagcacggggtggttggggatggggttctccaagaacggcctcatggtggactccagcgccatggtggggtggatcggcaagacggggctcccgcacatcaagccgttctcgctgcggggcaagaccccctcccaggtggtcgcggaccagggcttcctcgtctccagcgacaaccacaagcccaccgtgctcgtgcagcaggccaagatctacctcgccttccagctcagcttcaccgagccgctcaggcgccagaacgtgctcctcgccgtcggctccgccatccccgtcaacgaccgcctcgccgagcaccaggataagacctccatcgtattcgatttcaccacaggcagctcatcaggctcgtcatccttcccggaaggtctgaaaaggacccatggggcgctcaacctgttcgcctggggcgtgctactgcccatcggcgccatcgtcgcaaggtactgcaggagatgggaccctctgtggttctacctccacgccggcatccagttcgtggggttcatcctgggcctagccggcgtcgtggctggagtatccttgtacagcaagatccaggccgacgtccccgcgcacaggggccttggcatattcgtgctcgtgcttgccattttgcagatcctggcgattttcctgaggcccaacaaggactccaagtatcgcaagttctggaactggtaccaccactgggtcggcaggctcgccctcttctttgcagccatcaacattgtgctcgggatcaaggtcggcggagcaggcaactcttggaagatcggctacggtttcaacctggctgtccttctgatcaccatcgtcaccctggaagtcctgctctggacgaggtggaaaaacagcaccggttccacgggggcatattagctacttaccgatttttataggtgtttgtgatggtcagtgaaggaggtt

SEQ ID NO: 528 - DNA, 1025 bp, Zea mays
acgagcgggaggagatgaagatcatcattgacacggatcccggcatcgatgacagcgtggccatcctgatggcattccagatgccgggcgtccaggtcctagggctcaccaccatcttcggaaactgcaccacagagcatgccacacgcaacgccttgatcctgtgcgagaaggcaagccatctagaggtcccagtagctgagggcagccatgagcctctcaagggaggaaagccgcacgttgctgacttcgttcatggacctgatggcctcgggaacgtagatcttcctgatcccactatcaagaaagtggaggaaagtgctaccgacttcttggttgataaggtctcgcgatttcctggagaggtctctgtgctcgccttgggtcctctgacaaacatagcattggccatcaagaaggatccctcattcgtgaaaaacgttaagaagatcgttgtgctgggtggagcgttctttgcggctggaaatgccactccttccgctgaagcaaatatccacagtgatccggaggcagccgacatggttttcacttctggggcggacatctacgtcgttggcctcaacatcacaacgcaagtcagcttcacagataaggatctcctggagctaagaaactcgcaagggaagtacgcacagttcctatgtgatgtatgcaagttctacttggactggcacaccgagtcttatggtgctcctgtgattttcctccacgatccggtcagctttgccgcgctagttcgtccggagctgttcacgttcaagaagggcgtggtgagggtggagacgcagggcatctgcgtcgggcatacttccatggacatgttgctgaagaagtggaactcagagaacccgtggactggctactcaccgatttcggtcgcatggacggtcgatgtgcccaaggtggtcgcgtttgtgaaggagctcgtcaccaagccgtgaaccaagttaactaacgtgttgtggtctcgcgcaccagatgtgcagcaaatttgagatgtcgat

SEQ ID NO: 529 - DNA, 1723 bp, Zea mays
cctccttgcctgttccatcgcctccacgaacaaaccacacaccccacctaccccggccggaccggcaggcagcacagcatggacctcgccctcctagagaaggccctgctgggcctgttcgccgcggctgtggtggccatcgccgtggccaagctgaccggcaagcggtaccgcctcccaccggggcccccgggcgcccccgtggtgggaaactggctgcaggtgggcgacgacctgaaccaccgcaacctgatggccatggcgaagcggttcggcgacatcttcctgctgcgcatgggcgtgcgcaacctggtggtggtgtcgaccccggagctggccaaggaggtgctccacacgcagggcgtggagttcggctcccgcacccgcaacgtggtgttcgacatcttcacgggcaaggggcaggacatggtgttcacggtgtacggcgaccactggcgcaagatgcggcgcatcatgaccgtccccttcttcaccaacaaggtggtggcccagaaccgcgccgggtgggaggaggaggcccggctggtggtggaggacgtgaggaaggaccccgaggccgcggccggcggcgtcgtgctccgccgccgcctccagctgatgatgtacaacgacatgttccgcatcatgttcgaccgccggttcgacagcgagcacgacccgctcttcaacaagctcaaggcgctcaacgcggagcgcagccgcctgtcgcagagcttcgagtacaactacggcgacttcatccccgtgctccgccccttcctccgcggctacctcaaccgctgccacgacctcaagacgcgccgcatgaaggtcttcgaggacaacttcgtacaggagcgcaagaaggtgatggctcagactggtgagatccggtgcgccatggatcacatcctcgaggccgagaggaagggcgagatcaaccacgacaacgtcctctacatcgtcgagaacatcaacgtcgcagcgatcgagacgacgctgtggtcgatcgagtggggcatcgccgagctggtgaaccacccggccatccagcacaagctccgggaggagctcgcctcggtgctgggcgccggcgtgcctgtgacggagccggacctcgagcgcctcccctaccttcaggccatcgtcaaggagacgctccgcctgcgcatggccatcccgctgctggtcccccacatgaacctcaacgacggcaagctcgccggcttcgacatccccgccgagtccaagatcctcgtcaatgcctggttcctcgccaacgaccccaagaggtgggtgcgccccgacgagttccggcccgagcgcttcctggaggaggagaagtccgtggaggcccacggcaacgacttccgattcgtgccctttggggtcggccgccggagctgccctgggatcatcctcgcgctgcctatcatcggcatcaccctgggccggctggtgcagaacttccagctgctgccgccgccggggctggacaagatcgacaccacggagaagcccggccagttcagcaaccagatcgccaagcatgccaccatcgtctgcaagcccctcgaggcctagaaatcaatgcgtgtttcctgcacgcgcccccgcagatgaagcactatgtattttctcttttttttgtgtgttgtgttttttttactaagaggagatgtatttcttgttcgtaaaatgcacttagtcaaatggatcgaga

SEQ ID NO: 530 - DNA, 800 bp, Zea mays
agtgaacaccagccgtattgtcccgaccccgaccgatcctcgcctgctgcagccatggcgacctccgcggcgctctccaccgccgccaatcccacccagctctaccggtcccgcgctttgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaacggcgccgagaacaagttcatctgcccatgccacggatcccagtacaacaaccagggcaaggtggtccgtggaccggcgcctctgtcgctggccctggttcacgccgacgtcgacgacggcaaggtcctcttcgtcccgtgggtggagaccgacttcaggaccggcgaggacccgtggtggaaggcatgaggatgatccgaaaccagcggtgctcagtgctcacacatgagacctacgtatgcctccgttccttg

SEQ ID NO: 531 - DNA, 922 bp, Gossypium hirsutum
tgtctttcaacttctgagcttcgttctttctttctttctttgtttctgtcagttgttcaacaatggctacaactgacgtttccccaatggatcaaaatcccacacctcctaaacagccatcatttcaacaacactgccctcctgattttccaagaaaggtgtttgcagagacgatagcaacctacttgctggtttttgtgacatgtggatcagctgccattagttcggttgatgaacataaaatctcaaggttaggagcttcagttgcaggtggacttattgtgactgtaatgatctatgcagttggtcatgtttctggtgcacatatgaaccctgctgttaccctcgcttttgcagctgtcagacattttccatggaaacaggtcccattttatggtgcagctcaactaacaggggcaatctctgcatcattcacactccgtgtattattgcatccaataaaacatgttggcaccacatcaccatcaggctcagatttgcaagctctaatcatggaaatagttgttaccttttcaatgatgtttatcacctcagctgtggccactgatactaaagctataggagagctagcaggcatagctgttgggtctgctgtttgcataacttcaatcttggctggaccaatatcaggtggatcaatgaacccagcaaggagcatagggccagcaatagctagtggtgagtacaagggaatatgggtgtacgtggtaggaccagtaacggggacattgatgggggcgtggtcttacaatctcatccggatgagagacaagcctcaccatgcaatctctccacattcctcctcgttcaaacttcggcgaatgaataaccaagatggagaggtataaggtaaacctgagtgtattcagtattgattcatatccattgttcatcctcaaga

SEQ ID NO: 532 - DNA, 1415 bp, Brachypodium distachyon
cgagctcaccacagcatattactatcatagcagcgcagcgcaatatgggggaacgcaagccggccagcgaccggcgatccggccgctgccagcattactactaccactgccggccggcaaacaccatcacccccctcgccttcgtcctcctcgtcaccggcgcgctgttcctcatcctcggcccgaccaactcctccctcactctccccgcactccgcgtccagttcagcaaccccatccacatcgccgccgccgaatctccccaaccgcctcccgaagccggcaacaacaccgcgacaaccgtcgacgacggcgacgaggatgcgggcctcccgccggcccggcagctgacggacccgccctactcgctgggccgcaccatcctgggttacgacgcgcgccggtccgcgtggctcgccgcgcacccggagttcccggcccgcgtgccgcccgcaggccggcccagggtgctgctcgtgaccgggtcggccccgtcccggtgccccgaccaggacggcgaccacctgctgctgcgcgcgttcaagaacaaggcggactactgccgcgtccacggcctcgacgtcttctacaacacggcgttcctggaccccgagatgtccggcttctgggccaagctgccgctgctgcggtccatgatgctggcccaccctgaggcggagttcctctggtgggtggactccgacgcggtgttcacggacattctcttcgagctcccctgggaccggtacgcggggcacaacctcgtgctccacggctgggaggccaaggtgtacgaggagaagcactgggtcgggatcaacaccggcagcttcctcatccgcaactgccagtggtcgctggacctcctggacgcgctggcgcccatggggccccgaggccccgtgcgggacatgtacggggagctcttcgccaaggagctcacgggccggccgccgttcgaggcggacgaccagtcggcgctcgtgtacctgctggtgacgcagcgggagcggtggggcgacaaggtcttcttcgagaactcgtacgacctcaacggcttctgggaggggatcgtggacaggtacgaggagatgcggagcaaaggccgcggcgagggcaagtggcccctcgtcacgcacttcgtcgggtgcaagccgtgtcgccggtacgtggacagctacccggcggagaagtgccgcctcgggatggagcgcgcgttcaacttcgccgacgaccagatcctcaagctctacgggttcgcgcacgagtcgctcaacggcaccgccgtgcagcgcgtcgggaatgacaccggcgggccgctggacgcggacgacggcgagctcgcccggctgttgcaccccacgttcagggccgccgtgccaacgtagacggccacactggcctgcgatgtttaa

SEQ ID NO: 533 - DNA, 1873 bp, Hordeum vulgare
tatttaaggccgccccagcgatatgctctccaggaggccgctcgccgccgcgctacgcctcgcgcccctctcgcctcccctcctcctcttcttcgcatcctcctcctcctcctcccccgccgcgtcggcttcggggcccagaggctgcagtgctctaaggatggatagcggtgctgcggaacctgcttcaacaggggcaatctggtcaacaccgtcggtggagccgagaagcatttctattgggaagcagatattctgcaataggtcactcaacatgaggaacatcaccgcagtaggatttgatatggactacactctcgcgcagtacaagcccgagacattcgaggcccttgcttaccatggcactattgagaagcttgtgaaggatctgaactaccctgtggagctgttgacatggcaatttgactggaaatacatggtcagaggactagttcttgataagaaaagaggaaatatcttgaagatggaccggcacaagtatgtaaaagttgcataccatggatttagggagatgtcgaaggaagaaaaagttgctgcttatggaagtacattgataagggattcctttgatgaacctgattatgcccttatagatacacttttctcactgggtgaagcctatctgtttgctcagcttgttgatttcatggacagcaatcctgcaaaagtaccttcaggcactgactatgctcttatgtataaagatgtgaggtctgccgttgatctgtgtcatcgtgatggaactttaaaacgaatggttgcaaaggaacctagcaggtatatcaatgaagacttggcaattgtaccaatgcttgaaatgcttagaaaatctggacgctcaacattcttggtgacaaacagtttatgggactacactgatgttgtcatgaactacctatgtgggccatatatgtcagatgtaagctcaagccacaaccgcaagtggcttgagtattttgatgttgttataacaggcagttcgaagccaagcttttttcatgatgataatcgagcaggattgtttgaagttgagcctgattctgggaaacttctaaatgctgatcttcagattggaagcccaagatcaagtcaacatcagccaaaaccaattcacaaagtttaccagggaggcaatgttggtcatcttcacagactactttctgttgcatctagttcacagatcctttatgttggcgatcacatatatggagacatactccgcagcaagaaagttctaggttggcggactatgcttgtaatacctgagctggagcaagaggtgaagcttctttcagaatcaaaatctactcgaaaggaacttagacaccttagaatggagcgtgattcagttgaagacacaatccatcgccttgaatggtctcttcaatttgaagatcttacagagaatgagaaggggaagttgttatctgagcatgacaatctactgcaaaagctgaagggtatccgctgccttctccgagatgctcagatgcaacatcatcagaagtttcacaaggtgtggggacagcttatgaagactgggtaccaaaattctcggtttgctcatcaggtcgagagatttgcgtgcctatactgcagccaagttacagactttgggttgtattctcccaacaagtattaccgtccgagcgaagattacatgccccatgagttcgatgtgcttggcctgtagtactagtttgtgctcatgcagaatcggagttctcctttgaggtgtaggcaagcaagataggggcacaattttagcatggtactgaataacttgtttacatcctcacacaatggatgaggtttatacttggtgaaactgcacccatttccacatgtttat

SEQ ID NO: 534 - DNA, 595 bp, Hordeum vulgare
catcggagaggaggaagctcctgccccggctcgatccgatggccaacagcaacctcccgcgacgaatcatcaaggagacgcagagactcctcagcgagccagctccggggattagcgcttcgccctcggaggagaacatgcggtatttcaacgtcatgatccttgggccggcgcagtcgccctacgaagggggagtttttaagctggaactatttttacccgaggaatatccgatggctgccccaaaggttaggtttctgaccaaaatatatcatcccaacattgacaagcttggtaggatatgccttgacattctcaaggataaatggagtccggctcttcagattcgaacagttcttttgagtatccaggcactcttaagtgcaccaaatccagatgaccctctctctgaaaacattgccaagcactggaaatccaatgaggcagaagctgttgaaacagcgaaggagtggacccgtctgtacgccagtggtgcatgacaaccccatgctgctcttgatgtaataacccatcatactttagccagcaatctagtgccatttggttggtaaagaacaaactggagatgtttggg

SEQ ID NO: 535 - DNA, 1116 bp, Hordeum vulgare
cttacatttgctctggaaatcagggaggaatccaccttacaccggcgaggaagaagttccgagcaaagagagatggaggcagtggaaggcaatggaggagggagcggcctggtggtgacggagctgagccacatcaaggagctggtgaagcagctggacgtgcacctgggaggctcgccgggcctctgcaagcacctcgcccagcagatcttcgccgtcaccgagaagtccatcggcatcatcaggtccggccacttcaactgccccaagcgctcggccgccggcgccggcctcgactcgccgccgctgtccgcgacgcccagccccgtcagcggcgtctccaacacgccgttcaagcccaacaagaagaggaagacgtcggagaaagggcggcatcagatcagggtgagctcggcgggaggaggagcggacgccccggccgacgacggccacagctggaggaagtacggccagaaggacatcctcggagcccatcacccaagggcgtactaccgttgcacgtaccagaagacccagggatgcgcggcgacgaagcaggtgcagcgcgccgacgaggacccggcgctcttcgacgtgatctaccacggcgagcacacctgccttcacaagacggcggcggccatggtgcagccggacgggcagaaccaggacgcgcagagccttctgcagaacctgagctcgagcctgacggtgaagaccgaggggctcatcgcggcgggaacgcagggctggagcaccaccacgcccttcagtttctcctcgccggccgtgagcggcatgacgccgccggagcaccacccgttctccgcgccgtcgacgccggagaactgcttcgtgtcgatgcccacgtccctcgaaccctcgccggcgacctcgggctcgaaccacatgtgtttcaacccgttccaggcgcagtctgagctccagacaatggtgtctgcgctcgtggaagccacgagcatgccgccggccgacacggaggaggccggcttcgcctactggagcttcgacgattctgccttggacgtcaacagcttcgacgaggacgttaccaacttcgacatttctgccttcttagcatcagacgtttgataa

SEQ ID NO: 536 - DNA, 1146 bp, Hordeum vulgare
ccatcgcttcgccggtatccgcacccagccagcgcccaaagaatggcgtcggcaccctcccgcgccctccccttcctctcgccgccgtccaccgccccgcgcgccccctccggccgcctccgctgtgcggccgccgccggccaggccggcttcttcacccgcctcggccgcctcatcaaggagaaggccaagagcgacgtcgacaagctcttctccggcttctccaagacccgcgagaacctctccgtagtcgacgagctgctcacctactggaacctcgccgacaccgaccgcgtcctcgacgatctcgaggaggcgctgctggtgtcggacttcgggcccaagatctcgttccggatcgtcgacaccctccgcgacgagatccgcgacggcaagctcaagtccgggaccgagataaaggcgtcgctgaaaagatgcatcctcgagctgctcacgaccaagggcagcaagactgagctgcagcttggcttcaggaagccggcggttatcatgatcgtgggagtgaatggaggtggaaagacaacctcgctaggaaaacttgcccacagatttaagaatgaaggagcgaaggtattgatggcagcaggtgataccttcagagcagcagctcgtgaccagctagaaatttgggctgaaagaactggctcagagattgtcattgataacgataagaaggcacaggctccatcagttctttcgcaggcagtaaaacgtgggaagcgtgaaggatttgatattgttctatgtgatacgtcaggacgacttcatacaaattacggtctgatggaagagttggtttcttgcaagaaagtcatagctaaagccctgcctggtgctcctaatgagatcttgctggttctggatggcacaactggattaaatatgctacagcaagcgaaggagttcaacgatgttgttggaatcacaggattcattctgacgaagctagacggcactgctcgtggtggctgtgtggtgagcgtcgtagacgaacttggaattccagtcaagtttgttggtgtcggcgaaggggtggaagatctccaaccttttgatgcagaggcatttgttgaagccattttcccataaatttgaccctgttattagtgtttctcatgtaacaag

SEQ ID NO: 537 - DNA, 1225 bp, Hordeum vulgare
gaacctcgtgctctgacctccaccgctgccatggcgcggccaggccactccacggcgtggctccccgtcctggtgctgctgctctccgcggcgggcgcgacggcgcagagctgcctctccgcgaccttcacgtccggccgcacgttcctcaagtgcaaccagctgcccgtgctcggcgccagcctccactggacgttccacgcccagaacggcaccgccgacgtcgcgttccgggccccgtccggcgccgacgggtgggtcgcctggggcatcaaccccagcggcgccggcatggccggcagcaacgtcttcgtcgcctcgcacagcggcggcgccgtgtccgtgctcaccaccatcctgaggtccacgaaacccgccctcgacaacgccgccctccagttcggcgtgcccgtcccggccagcgccgagtacgccggcggcgcctacacgatatacgccaccgtggcgctgccgggcaacaccacgtcgcagaacacggtgtggcaggccggcccggcctccggcggcagcatctcgccgcaccccctctcgggcccgaacctccagtccgtccagaggctcgacttcctctccggaaccagcaccggcgcctccaactccaggctgcaccgccgtaacctccacggagtactgaacgcggtgggatggggcgtgctgatcccgctgggcgccatgatcgcgcgctacctccgggtgttcgaggccgccgacccggcctggttctacctccacatcacctgccagatctccggctacgtgctgggcgtcgccggctggggcctcgggctgaagctgggcagcgagtccaaggggctcacctacagcacccaccgcaacatcggcatcgccatcttctgcctggccacgctgcaggtgttcgcgctcttcctcaggcccgacaagaagaacaagtaccgggtgtactggaacgcctaccaccactccgtcggctactccgtcatcgtcctcgccgccgtcaacatcttcaagggcctcaacatcctcaagccggtcaccggctggaagacgagctacatcgtcatcctcgccacgctcgccggcgtcgcgctcgtcctcgaggccatcacctgggccatcgtcctgcgccggcgcaagcgcaacagggcccacggcggcgccaacgggaccggcgtgcagctataatcgtcaggatgtgtttgagcgattccgatccatgtcttta

SEQ ID NO: 538 - DNA, 1296 bp, Hordeum vulgare
tcagttagctagctggtgatccatatggggaaggtggtcgtcacggaggccacggcgcgccaggtggcgtccttcctcctcggcgccgccgctgcgctcaccgtcgtcatgctcgtccactaccgggcgccggccgccgggctcagccgtgcgaggacaccggggcacttttccggcttgagatcatcatcatcagatgaccagcaccaccaccaccgcaacgggacgactgcacgtgccgtagttcatcaggcgccaccggtcgccgctagtgcaggcgacgatcatcgccgtccggcgaacgccacaacaatcacaaagcccaattctacctctactgctgctgctctacctctacgtcatcttcccagcacaaatcaccatggacaaaagggagccaatgaggagtcgccggagttccggggcctggcggcagcggtggcgcgagcggcgacggacgaccggacggtgatcatcacgtgcgtgaaccaggcctgggcggcgccaggctccctgctggacctgttcctggagagcttccgcatcggcgacggcacggcgcgcctcctcccacacgttctcgtcgtggccatggaccccggcgcccacgcacggtgcctcgccgtccaccggcactgctaccactacaccatcccgggcctcaacatcgacttcgccgcccacaagtacttcctctccaaggactacctggagctggtgtggagcaagctgaagctgcagcgccggatcctggagctcggctacggcttcctcttcaccgacgtcgacatcctgtggctgcgcgacccgttcaagcacgtgacggcgtacgccgacatgaccgtgtccagcgacgtgtacttcggcgaccccgacaaccttggcaacttccccaacacggggttcttccacgtgaagcccaacgcgcggaccatcgccatgacgaagctatggcatggggctaagggcaagtacccgggagccaacgagcagccggtgtttaacatgatgaagaagcggatggtggcggagctggggctcagggtgcagtacatgaacccggcctacgtcggcgggttctgcagctacgggaaagatttgaggaagatcgtcaccatgcacgcgaattgctgcgtggggattgagaacaaaattaaggacttgaagaacgtgctgggtgattggaggaactatacgaggatgccgccatgggagaggcaccgggccaaatggaccgtgcccggcgcctgcattcgagccgaaaaacaagtttgattcatcaattggttgatgtga

SEQ ID NO: 539 - DNA, 1399 bp, Hordeum vulgare
gggtttgcgtgataaatctgacaaaacaatggaagatttacaagactgcaactccaaaagccttgttgctgttcctgggtctctcgttctgcacgtcttcaggctgttaggtcagcaggataattcctggcagaagtacgccttggcttactttcttttggtcaggaatgagtacttcccgagggagccaaggaaacactcagctgtgaatgggcaacttgttcactgctgtgttagttcagatttgggcagtaaagaagtggaagtggaggagcagaatgctgttgtcaagacccaatcaggaggtgattccagttccaatggatcaaatgattgtttccttccaggccttcatgatgatctggctcaagactgccttgcctggacaagcagatcagactacccttcactctcttgtctgaacaagaaattcagtacactggttaacggtggatatctgtacaagctgcggaggaaatatggcattgttgagcattgggtgtatctggcctgtagcctgatgccctgggaagcattcgacccgtcgcgaaaccgatggatgaggctcccaaggatgccatgtgatgactgcttctcctgtgcagacaaggaatcacttgctgttggtacacagctgcttgtctttggccgagaatatgcaggccttgctatttggatgtacaatttactgacacgccattggtctcgctgcactccgatgaatcttcctcgctgcctgtttgcctcgggaagctgtggtgagattgccattgttgctggtgggtgtaatgggactgggcaggtgctgaggtctgcggagctgtacaattcagaggctggccagtgggagaccctgccagacatgaacttgcccaggagactctcctcgggtttcttcatggatggcaagttctatgtcattgggggtgtgaccagtgaggggcattctctgacttgcggagaagaatacgatcttgacaccaggacatggagaagaatacatgacatgtaccctggaggaaccagcgcctctcagtcgcctcctctcatcgccgttgtaaataaccagctctacgcggccgaccagtccacaaacgtggtgaagaagtacgacaaagcaagcaacacatggaacatagtgaagcccttgcctgtgagagcggactcttccaacggctggggcctggcgttcaagggatgcggcgacaggttgctggtcatcggcggccatagaggacctcgcggcgaggtgatactgctgcattcctggtgccccgaagatgggaacggcgtcgccgactgggaggtgctgtcggtgaaggagcgtgccggcgtcttcgtctacaactgtgcaataatggggtgctgagttagtgccttcggttcggtatatccgtga

SEQ ID NO: 540 - DNA, 1738 bp, Zea mays
ctgccatttcatcgaacaagcgccataccggacatggcaaccggatcccctcgccgccgtcctctgccgctcctcctcctgttcctgctcctcttcgccgccaacggcagggccaatgccgcccgccccggcggccccagccccataaagaacgtggtggtgctggcgctggagaaccggtcgttcgaccacatgctgggctggatgcgccgcctgttgggcctccccgtcgacgggctcaacggcacggagtgcaaccccaattccaactccacatcctccatctgcgtgtccgccgacgccgacctcgtcgtccccgacgacccgggccactccttcgaggacgtcctggagcaggtgttcggcaacgtctccgccgccgctgcgcagccgcagccctccatgtcgggcttcgtccgcagcgcgctctccgtcaacgcggtcctctcctccgccgtgatgcgcgccttccgcccctccctcctcccggccttctccgcgctcgcgccccaattcgccgtcttcgaccgctggttctcctccatcccggggcccacgcagcccaaccggctgttcctctactccgccacctcccgcggcgccgtcgcgcacgacaagctcgacctcctcctcggctacccgcagcgcaccatcttcgagtccctcgccgccgacggccacgacttcgccgtctacttcaagaccatccccaccgttctcttctaccgccgcctccgcgcgctccgctacgccgcccgcgccttccaccgctacgacgccaccttcaaggaacacgcccgccgcggcgtcctcccagcgctctccgtcatcgagcccaggtacttcgacctcacggggacccccgccgacgacgaccacccggcgcacgacgtcgccaacgggcagcgcctcgtcaaggacgtgtacgaggcgctccgatccagcccgcagtggaaccagacgctgctcatcgtcacctacgacgagcacggcggcttctacgaccacgtcgccacgcccaccgccggcgtgcccagccccgacggcatccggggcccgccgcccttcttcttcaagttcgaccgcctcggcgtcagggtgcccaccatcatggtctcgccgtggatcaagaagggcaccgtcgtcggccgcgccatcgggcccacggactcctccgagttcgaacactcctccatcccggccaccatcaagaagatcttcaacctctcgtccgatttcctcaccaagagagacgcgtgggccggtaccttcgaccacatcttcaccgagctcgaccaaccaagaacagattgcccagagacattaccagaggtgtcatttgagaggccaactccacctaaagaacacggctggctctcagatttccagcgggagctcgtcgagctcgcgagcttcctcaacggcgactacatgctgacgagccttgcgcaggagaaccgtaagaagaagatgacagtcaaacaggccgatgcgtacgtgcggcgagccatcacgagctttctgcaggcgagcaagcaggcggtgcggttgggcgcaaacgaatctgccattgtcacaatgaggtcgtctctgacaagcaagagcacacgctcatcaagcccttgagttgattcagtctgctaatacatatagctagtgaacagatggatttgagtccacggtctaatgtatattgcctctgaaatgtttatagctgaatagggagctagcagagcct

SEQ ID NO: 541 - DNA, 684 bp, Setaria italica
ggcccccatggcatccgccgtttcgctcctcctcctctcgtccccgcgcccgctccaccgcacatccggccacctcctctgcagcccccgccgccgcgccctcccacctccaccgtgccccgcccgatccccgcgccgcctcctcgccgccccgccgcgcgcctccaacaacaacgacaacagcggggccgtggaggctcccgaccgcctcgtggccgcggtcgcctacctctacccgttcctcgacggcgcgcaccacggccgcttcctcctcgcgcagttccccttcttcagcgcgctgctccgcccgctgggccccgcggcgcgcctcttccactcctcgccgctcacgcccttcctcctcttcctcacgctctacttcgccgtcgtgcggaaccagcaggccttctcccgcttcgtccgcttcaacgccatgcaggccgtcgtgctcgacgtgctgctcatcttccccgacctgctcgcgcagtccttcgcgccatccggcggggtcggattcgagatcttccagagcatggagagcacggtgttcctcttcctgctcgtctgcttggtctacggcgggggcgcgtgcctgctcgggaagacgccacggttgcctatcgtcgcggatgcagccgagcgccaggtgatgtgactacagttcgcttgaatcatgctgatgag

SEQ ID NO: 542 - DNA, 1275 bp, Sorghum bicolor
gaagaagcatcgccagattggtatattgattgatcgatcgattgatcggtggcggaggaaggggaggagggcggcagatggcggcgtgccggggcttcttcgagtgcctgctcaggctgctcaacttcatcctcaccgtcgccggcctcgccatggtcggctacgggatctacctgctcgtcgagtggacgaagatatccgaggacggcagcggcggggggttgacggcggaggtgctcgtctccgcccggccgttgttgggggctgtcgctctcggtgacagcttcctcgacgacctacccaaagcatggtttatttatttgttcattggtgttggtgctatcgtcttcctcgtgtctctgtttggctgcattggagcagggacaagaaacacatgctgtttgtgtttctatgctttcttggtcatattgttgatccttgctgaagctggagctgctgcattcattttctttgaccaaagctggaaagatgtaattccagtggacaagacacataactttgatgttatgtatgactttctgaaggaaaactgggagattgcaagatgggttgctcttggtgttgttgtttttgaggcagtgctctttctgttagctctggttgtcagggcaatgaacaaacctgctgagtatgacagtgacgatgaaattattgcaattggccgaagccctaccatgcggcagccactgatccatgcccaaaatgtgcctgccactggtgttcctgtcccaacactcgatcagcgtgcaagtagaaatgatgcctggagccaaaggatgcgagagaagtatggtctggacacgagccagttcacatacaacccttcggacccaagcaggtaccagcagaatggcacgccacaggctgaagaaaggagtcgatgcactataatgtgaagaatccttcatgaggtcctaccgagataatgaccaatccttcatgaggtcctacgagataatggttttcttgaacgggctacctcagcttgtgtagtttggtgttacggtgttgttcagacttcatagcggtgtgtggaatagaagaatgccgaccatattgtttgtcacgcttgatatgtcttctctgcaaatgttctatgtccctgtaattttattgtggatgaggaactgttagccattgacaccatcatctattctgtatttttgggggtttgtttcttgtttgctaatcccctttttttcatgtagctctgtttaatctaagatttggttgtgccgtgagactggtagaatc

SEQ ID NO: 543 - DNA, 1728 bp, Sorghum bicolor
aatcagaactcggcatcacacagctttgcgccccagcagttttggggagtggggacgacggaagtccggcacgtagccttttcagttcatcgccttcacggttagttgccgacttgccgcgcactgccccccctgcagccctgctccctcctcgcctggcctcacgatcggcaacggcatgactactcgcgacgcccatctcggagtcggagtcggagtcgagggggacgccaaggacaagaacgccgccgctgacgccttgacggacggaggcggcggccatgaaggagccgggtccggcggcgggcgcaagctgtccctggtgccgctcatcttcctcatcttcttcgaggtcgcggggggtccctacggcgcggagcccgcggtgcaggcggcgggcccgctgtacgcgctgctgggcttcctcatcttccccttcatctgggccatcccggaggcgctggtcaccgcggagctctccaccgccatcccgggcaacggcggctacgtgctgtgggccgaccgcgccttcggcgcgctgccgggctcgctcatgggcacgtggaagtacgtctccgccgccatcaacggcgccgcgttcccggcgctgtgcgccgactacctggcgcgcgtcgcgcccgccgtgtcgggggggcctgcgcgcgccgccaccatcgtcgccttcaacgtcctcctcacggccgtcaactgcgcggggctcaccgtcgtggggtggtccgccgtcgggctcggcgtcgcgtcgctctcgccgttccttgtcatgtcgggcgccgcgctgcccaagatccggccgcggcggtggcgcgtcgtggcccgggagagggactggaagctcttcttcaacacgctgttctggaacctcaactactgggacagcgtcagcaccatggccggcgaggtggaccggccagggaagacgctccccaaggcgctcgtgtccgccgtctccatgacctcgctcgggtacctgctgccgctcttggcggccaccggcgccctcgacgtcgcgcccgacagctgggggaacggattcttcgccgacgctgcaggcatgatcgccggcaactggctcaagtactggatcgaggtgggcgcggtgctgtcctccatcggcctctactcggcgacgctgagcagcgcggcgttccagctgctggggatggcggacctgggcctgctcccgggcttcttcgcgtcccgcgccccggtcttccgcacgccgtgggtcagcatcgtggccaccgccgccatcacgctggccatgtccttcctcagcttcaacagcatcgtggccgccgccaacttcctctacagcctcgggatgctcctcgagttcgccgccttcgtctggctccgcgtcaagcagcccgcgctggcgcgcccctaccgcgtccccgcgcgcctcccgggcgccgtcctgctctgcctcgtcccctccgtcttcctcgtcttcgtcatggccatcgccggctggaaggtgtacgccatcagcgccgcgttcacggccgccggggtggcggtgtactacctcatgaggctctgtaaggctagagggtgcctcaggttcagcgacggcgctggcgccggcgatcaagggtcgacggcggcggtttaccagcagggcagcagcaacggcggcgatgtctgaaatgatagtagactctgactctaacgacatcaaactatcaaagacagtcagctgtggga

SEQ ID NO: 544 - DNA, 2460 bp, Setaria italica
acgcggacggcaataatggacggccgccacccgccgccctcccaccaggcgccggcagcgcagccggagcggcacggcagcttcaactacgacatcgagaacacggacgcggcgtggcgcggcgcgcacacggcctcggaggcgctgctgcggtacgacgacgacggcccgcgggagccgctgctgcggaagcgcaccaggaacactacctcccagatcgccatcgtcggcgccaacgtctgccccatcgagagcctcgactacgaaattgtggaaaatgaccttatcaagcaagattggcgatcaagaaagaagcagcaaatattccagtatattgttctgaaatggtccttagttcttctcattggcttgtgtacgggacttgttggcttcttcaacaaccttgcggttgaaaacattgctgggttcaaactgttgctgacaggtgatctaatgctcaagcagaggtacatcacagcctttctggcatatgcaggctgcaatctagtcttggcagcaagtgctgcagcaatctgcgcttacattgctcctgctgctgctgggtctggtatccctgaagttaaagcataccttaatggaattgatgcttatgctatattggctcctagtacactctttgtgaagatatttggttcaatacttggagtttcagctggatttgtacttggaaaggaaggtccgatggtacatacaggagcatgcattgccaacttgcttggtcaaggggggtcacgcaaataccatcttacatgtaactggctcagatattttaagaatgatagagataggcgggatttgattacttgtggggctgctgctggagttgcagcagcattccgtgcacctgttggtggtgtgctcttcgctcttgaggaagcagcatcatggtggcgaagtgctctcctgtggagagcattctttactactgctgttgttgctgttgtattgaggggcctgatccagttctgccgtagtggaaaatgcggtctctttggtcaaggaggattgattatgtttgatcttagctcaaccatacctacttacagtacacaagatatgatcgcaatcattgtccttggaataatcggaggggtctttggaggcctgttcaactttctcttggataggattctccgcgcctacagttttatcaatgagaaaggtgctccatacaagatccttcttactatcacaatatcgattatcacatcagcatgctcctacgggctcccttggctcgctccatgcactccgtgcccagctgatgccgtggagcagtgtcccaccattggacgctctgggaattttaagaattttcagtgcccagcaggttactacaacggtcttgcatcactcttcttcaacacaaatgacgatgccatccgcaatctgttcagcagtggcaccgagaaagaattccacatgtccactctttttgtcttcttcactgccatttactgccttggccttgtgacatatggtattgctgtcccatctggtctcttcatccctgttatacttgctggggctacgtatggacgcatagtggggacgcttcttggtccaatatcagaccttgaccctggactcttcgcccttcttggtgcggcatctttccttggtggaacaatgaggatgactgtctcagtttgtgtgatacttctggagctcacaaatgacctccttatgctcccattggtcatgctcgtccttctgatatcgaagactatagccgacagcttcaacaaaggggtttatgaccagatcatagtgatgaaaggaatgccgttcctggaggctcatgccgaaccatacatgaggcagttggttgctggcgatgttgtatctgggccactgatctccttttcaggcgttgagagagtagggaacattgttcaggcgttgaggatcacaggacacaatggatttccagtggtggatgagccacctctatcagaagctccagagctcgttgggctcgtgcttaggtcccatctgctggtcctgctgaaaggcaagggcttcatgaaagagaaggtgaaaaccagtggtagctttgtgctgaaaaagtttggcgcctttgattttgccaaggctggatctggaaaaggtctgaagattgaggaccttgatttcacagatgaggaaatggatatgtatgttgatctccatccaattacaaatacctcaccatacaccgtggttgagaccatgtcccttgcaaaggctgcggtccttttccgggcactaggattgaggcacctgttggttgtgccaaagaccccagggagaccaccaattgttggaatcctcacaaggcacgatttcatgccggagcacattcacgggctattcccgaatctccacaagtcacactgaggaaagaattcagtacatgttttgtttgctatttgtttcctggtagcttagctgtacgca

SEQ ID NO: 545 - DNA, 1212 bp, Zea mays
gtgtgtgtgttataagcgcgagggtttctggcgaggttgctaaagcgttagcaaactagttagcggtcaccgggcgcccatggagcttgacgaggagacgacgttcttggacgagctcatgtcgctgcggcgggaggcggcggcggcggcgtccgcgcagtggcaagcagctgccgcctacacgggcggcggcggacaaggcatgatgatgggcgacctcctcttctacggcgggacgacggaggccgccgcgactgccaccagcggcggcggcatggaccagctctcgccgttccaccagcaggagccgctgcaggtgcaggcgcccccgcaccctcactcgcacgaggagttcaacttcgactgcctcagcgaggtttgcaacccgtacaggggcggcggcgtcgccgtaataacgggggccgaggccgccgcggtgcccggaagggcgctcgccgctctccacgacgccatggtggaggacgagacgagcggtcacctgcaggggcagcaatatggagccggcggctccccgacgttcgtgttcggcggtgccgccggcgagagctccgagcagatgcccgtcgtcgtcaggggtgccggcggcggcccccaccacaggagcaaggtccacggcggcggcgcgccgtccaagaatctcatggccgagaggcggcggcggaagcgcctcaacgaccgtctctccatgctccgctctattgttcccaagatcagcaagatggacaggacatccattctcggtgacaccattgactacgtgaaggagctgacggagcggatcaaagtcctggaagaggagatcggcgcctctgcggaggacctggacctcctaaacaccttgaaagcttcttcgtccagcggcagcaacgagatgatggtgaggaactccaccaagttcgacgtcgagaggcggggcaacgggagcacgaggatcgagatctgctgtgccacaaaccccgaggtgctgttgtccacggtaagcgcgctggaggtgctgggcctggagatcgagcagtgcgtggtgagctgcttcagcgactttggcatgcaggcctcttgctcacaagaggaggaggacggtaataataagaggcaagttctaagcaccgacgagataaaacaggccttgtttcggagtgctggctacggagggaggtgcctctaatatagctagctaccatgcaagcagct

SEQ ID NO: 546 - DNA, 4358 bp, Setaria italica
cagatgggaatccgattccggcccgcagcgcatctctcccgtcccgcgacgcgatggctgctgcggctgcggctgcggcttcgccctcggccgctcctccctccgcggcggcggcggtcttcgcggtcaacggcgagcgcgtggagctccgcggcggcgaggtggaccccggcgccaccctcctcgagttcctccgcacccgcacccgcttcaccggccccaagctcggctgcggcgaaggcgggtgcggcgcgtgcgtggtgctgctctccacctacgacgcggcgtcgggcgcggtgtcgcacgcggcggcgagctcctgcctgacgctggtgcacgggctccaccaccgcgccgtcaccaccaccgaggggctcgggggccgcggccgcggcctccacgccgtgcacgagcgcctcgcggggttccacgcctcgcagtgcggcttctgcacgcccggggtgtgcatgtccctcgccgccgcgctcgcggccgccgacgccaagaagggtgacgggaggccggctccgcccgaggggtccgccaggctcacggcggccgaggcggagcgggcggtggcgggcaacctctgccgctgcacggggtaccgcccgatcgccgacgcctgcaagagcttcgcggccgacgtggatttggaggacctgggcctcaactcattctggaggaagggtggcgcccatgcttccaagctcccgcggtatgaggaggggagcattggtgtctttccggagttcctgaaggctgagatcagagcctctgctgggattgaagggtgcacgccgccggcattgctcggaagtgggagcacttggcactggcctcggagtgtggaggagtactataagctggtaggttctgagttgtttggcaaaagtggaacaaaggtggttgtgggcaacactgctgcaggcgtttacagagaggcagaggtgtatgataggtacattgacctgagatgcatcctggaactgaattcggttagtaaggaggccaatggtgtcgaaattggagctgcagtatcgatttctaaggcaattgaggctttaagagaagatggtggctgcaatgatgtgatcttttgtaagattgctgatcacatggagaaggtggcttctccttttgtccggaacacagcgagcttgggtggaaatctgataatggcgcagagggaccagtttgcctctgacatcgcaacgatccttcttgctgccggttcatcgttatgcatccaggtatcatcggaaaggttgaccatcacgttggaggaattcctgcagatgccaccttgtgattacaagacgctgctattaagcatttacattcctcgttggactcccattggtgacttatctggtgatggaaccatggataggacagtaagtacaagaggaaattctgttctatttgagacataccgagctgctccacgtcctctgggcaacgcagttgcatatcttaatgctgctttcttggctcatgttgcttcagatggaacttcaggcagcataatattgagagagctatgtctggcttttggtgcatatggaacccagcatgccatcagggctagcaatgttgagaaactgttagtgggtaaacccattactgcatcggtattgcttgaagcatgtacacttctcaagaaaacaattgttcctaaagaaggcacaagacatgctgcgtatagatcaagcttggcagttgcatttctgtttagttttctttgtccagtgaccaaagaaactttgaagcctttaaaggcagttcatcttaacggctctgtgccttctggcaccaatggaaatccaaattgtggacctgatgcgcgtgttgatgcttcactgaagaagataaataatgtgaaacccggttcatatggcaatgattgcatacttgaatattcaaaacagaaaattgaaatcaataaagactatctcccagttggcataccagccaagaaagttggagcagcactccaagcctctggtgaggctgtgtttgtggatgacatcccctctcctaaggattgtctttatggtgcctttatatatagcacaaaacctttagcccatgtgaggagcatagaactcaacccgtctctcaagaaacttaatacattgggcatcgtcactgttaaggatatcccagaaggtggcagcaatgttggagccaacactatctttggacctgaacctctgtttggtgatccagttactcagtgtgctggggaacctcttgggattgtgattgcagaaacacaaagatttgccaatatagccgcaaaacaagctgttatcgactacaatactgagaacttaggtgctccaattttatcgatagaggatgctgtaagaagatgcagttattttgaaaccccaccatttcttcttccccaaaagattggtgatttctcacaagggatggcagaagcagatcagaaaatctactcagcagaggtgaagcttaattctcagtactacttttacatggaaacacaaactgctctggccgtacccgatgaggatgactgcatggtagtgtatagctcaagccaatgccctgagacaacacaaaatgtcattgcaaagtgccttggtttaccttgtcacaatgtccgtattatcacccgaagagttggaggtggctttggaggaaaagctgttagatcattgcctgtggcgacggcttgtgcacttgcagcatttaagttgcatcgtcctgttcgaatgtatcttgaccgcaagactgacatgatagtgagtggaggtcggcatcccatgaaaatatgctattcagtgggattcaaatcagatggaaagatcactgctttgcatctagatttgttcataaatgcaggaatgacaacagatgttagcctgataattcctcacaatttcattgaagcactgaaaaaatataactggggtgccttttcttatgaagcaaaggtctgtaaaacaaacactgcaacgaaatctgcgatgcgtgggcctggggaagttcagggctcttatgttgctgaagctatagttgagcatgttgcttccgcactctccactgatgctaatttggttaggcagagaaatcttcacacaattgagagccttgctttgtttcacagtgagtgcactgaagatgacatgggttatacacttccctctatatgtggtcaattgactgcatcagaaaatttccagcaccgtcttgaagtagtcaagtctttcaacaaaaataacagatggaaaaagcgaggcctctcttttgtgccaattgtgcacaaagtattatctcgaccgacacctggaaaagtgtcaatccttaatgatggttctattgctgttgaagttggaggcattgagttaggccaggggctttggacaaaagtgaagcagatggcagcgtttggtcttggacaactgtgggctgatcgaagtcaagagcttttggaaagaataagagttattcaagcggatacattgagtaatgtacagggagggtggaccacagggagtacaacatcagaatctagctgtgaagctgttcgtcttgcctgcaatatcttggttgacaggctgaaattagtcaaggagcaatttcaagaaaaacaaagcaatctttcatgggatgaacttatttccaaggcaaaaatggctggtttggacttatcagcacgagaatactacattcctgggccttctggttcttatctaaactacggagctgctgctagtgaggtggagattgatcttctcactggggccaccacgattgtgcgaagtgatcttatatatgactgtggccagagcttaaaccctgccgtggacttggggcaggttgaaggggcattcgttcaaggaattggctattttatgaccgaggaatatgtcaccaactcggatgggttggttatatctgacgggacttggacatataagatcccaactgtggacactatcccaaaacagttcaatgttaagttgcttaacagtggattccacaagaaacgggtgctctcttcaaaagcatctggggagccgcctttgcttcttgccacttcagtgcactgcgcgacaagagaagccatcagagcagcaaggagggaatcccactgctctgcttctggaccttcttcaccttcccatttcgatctggaggttcctgccatcatgcccgtggtgaaggaactctgtggcttggacaatgtggagaggtacttggagagcctgctgagctccaaatgaagaaccaatccaagtcggcacctgtttttcccaactttacttagctgtgtaatacgattaggttattgcgctgctcggcatgttccaaagttctag

SEQ ID NO: 547 - DNA, 1381 bp, Setaria italica
ctattccatcgtccgctcgtacgccgcctcgctggctcgctcatccgcagattttggatcaccctttcgtttttggttttgtggggatgttcaagtttttatcctcccttttcttttcgtttggttttttcccctctccggtgggtgatttggtttgcctgttgggttgaggacagtgaagatcgtatctattggtctcgttcgtcgtaaccggcatctgtttgccttgccgaccatcctgatatatcaccacccatattccgagtcctcatctcagccacagtcaccagtcccatcgtgtgtttattttgttgcttcgcgcgtctattttaagatctgttatgttttgtggccgatgattaaatcaaaaaaatagacaagcatatgtctgaatctttctgtgtggaaaagcctaatcttctctatgaggtcaactgtatcttttttatttgtctttatttttttattattttggatctagacttggatcttggattttgactccattggggcctaggatgaaccatttggatgttctatttgtatgattttgatgattacaaaaccattactgccttccttctgaggcctcttcggattatttttttgttctttgtatttgtttttggtattttctgagatcgatatatggtgctttggtaaggtcgggtgatgagtaccagtgcatagttcagatgatataaccctcgtggttgtgattactttgaacaaatagtctttcgctcctaactgacgaccttatcaattcccaatctctgactgttgttccgtgttcttccaattccaataattttgttgtcttagttgctaactgtgatgttagattgtgacatttaattgttatgaacgttttccagacgatgtttgtatcttcaaatggagaattaaccattttctgcaattcttgcataacaatgtagtactttgcaatctaaaccttatttccgacgtgattttagcatttgtttcatatatgatggttctgcgactacgccattcagatcttaaatgtagacgttccaagctttgttagctggcaagcgacgtcggtctgaaactctgaatgaacagactctctggaattagctggaactcgaatgagaattgcaccattttatgtacgcacaaagcagtttctgattatggattcgaatcggaaagcagtatgagatggatggtggctgtaatttgttttagaatttagctggaatttcagtttccaaaattttaaccaaagtttgtttctgcggtaggattttagtatgatgaaggcaattgagatgcgtgttagtttgagatggcacaatctagaccggttggaatgtaatttgacctggtgatgtaccatgtttgacttgga

SEQ ID NO: 548 - DNA, 376 bp, Gossypium raimondii
ccttacttgaacaggatctgttctataggctcgtacctctgtgtccttaagctcaaaggagacagggttccaagtctggttgatgaaccaggaccgtgtgacctgagcgtgattattggtctggtgattcccttgctggtttcactttgaccgcagaggatcgttctcagctagccttgggcggctgggaaggtcacgcagttgtctgacagactcattcgcctttttttttttctgctttttccatttgaatttgcaggcttattacagtctcttgttggttgctttgcagtgttgttcgaagcaaattttgggggattttagaaggcaagccatgcagatagaaccaaatatgagtttcgaatttgcaatgctg

SEQ ID NO: 549 - DNA, 411 bp, Zea mays
gtacagacgtgctcctccttctcccctccccttgtccacagcccccgtagaccatggaagatgcatggcttgagcatctgcatggttcttgagagttaaagctgcacgacgatggatagtggaaacagagcttctcaagaagcattcgttttcgtggtgcctttcctgacctccttggtggtcagctgaggtgcgcacaaaccggcaagtcacaatacggcaatggcggactccattaggagtcgtccttttttatttctttacccctttttacattctagttctgtgattgtgtcaggcggaagctagaagacaaataacctaagtattcatgtgtgatggattatatacgtatacattggtgagacaatgtttgtctcatgtgtactccagtctccagaaacaagctgc

SEQ ID NO: 550 - DNA, 223 bp, Zea mays
ccacgaccttacttgaacaggatctgttctataggatcgtaccgctgcatccttgattaataaggaggcaagcacttaagcctggttgatgagccatgacctgtgggccagagcgtgattaacggccaggattggctctgacgctttgtccggtgctgtagatgatcgtttccggccaggcttgcctggctgggatggcccatgggttgtctgacaggttctt

SEQ ID NO: 551 - DNA, 862 bp, Sorghum bicolor
aaccctcgtgctctcgccgcagcgctcgccacttgccccgcaccactcgctcggccctcccaatcctcgcgcctccacttcgtgttccacaacgcgagccgcaaggtgcggctgtgccccctccattgatcgaggcggcggtggctcttcaaatccaaggagtacgaggctgcggcggtcaaggtgtggatctggtgagggaggcatcgatctgccatctgttcccgaaggcgtgttggatccggtgagggaggacgcattcaggatgaggcagctggagtggcaacgagctcgagcctaggagttggcggcagaagagggtgctcgaccattcctcccctgcatgacgtgcttcattccatggctggagctgcacccgtcaagcaagcacgagcccagcagttagcgccggccgtgaagcagcctggcaatgatagcgagcagtcagccaacttcaccagtgcggtgaagtccagggtgtctgatctgaatgatatatggatctgggtaccctagtcatcccatgcatattcgaagtggcgcttatgattctcactgcagaaatttccatgaagacaagactaatttgtaatgggctgagctacgtacaacaaactgctgctgggatgtaacctagatagtgcgaaggactccttttgtgtagtctgacatgctcctacaaactcaaatataagtaggtgctaaacttgctttgtagtcgactctgatcagtcaatggcacttgtatttagacggcttataaaaaagtgatcagttatatgtttattcagtgcaaatattttgatttctgggtggatgtataaatggtggcattgtgtataactgtattctgattatgaga

SEQ ID NO: 552 - protein, 357 aa, Arabidopsis thaliana
MVKTKKEDLNQFLIPRLNTIYETLQLFDGTASPTVERVNWNDVLQMSDHLSKQATIVGMLWTGESPKADSLKETMESYFNALQGFLLCCHGSTLGAGPTLSSIIHVSVKQIVDSSFRLLQGSVSLYEGSYEKDKKPSIPQLSGVVWEACSSFKKVPATNITAIGRAITQVAVSMKDVLREMKEVKPACPLSECEASGDNMSSDDDDDDDLGDDLSPEEMEVATMVTEIVSETIMVIKELIRVITGMIKMENPKDNSGFVESLEKLLKLCQGTGVQIDELGACVYPPQEMNKMKQTVKVIQGNLDEFETEVERLKSSSDGFSGACGKLRNSLKHMETELDKRCEAELVVEMQNVTLDS

SEQ ID NO: 553 - protein, 585 aa, Arabidopsis thaliana
MYRLVSNVASKARIARKCTSQIGSRLNSTRNYAAKDIRFGVEARALMLRGVEDLADAVKVTMGPKGRNVIIEQSWGAPKVTKDGVTVAKSIEFKDRIKNVGASLVKQVANATNDVAGDGTTCATVLTRAIFTEGCKSVAAGMNAMDLRRGIKLAVDTVVTNLQSRARMISTSEEIAQVGTISANGDREIGELIAKAMETVGKEGVITIQDGKTLFNELEVVEGMKIDRGYISPYFITNPKTQKCELEDPLILIHEKKISNINAMVKVLELALKKQRPLLIVAEDVESDALATLILNKLRANIKVCAVKAPGFGENRKANLHDLAALTGAQVITEELGMNLDNIDLSMFGNCKKVTVSKDDTVVLDGAGDKQAIGERCEQIRSMVEASTSDYDKEKLQERLAKLSGGVAVLKIGGASETEVSEKKDRVTDALNATKAAVEEGIVPGGGVALLYASKELEKLSTANFDQKIGVQIIQNALKTPVYTIASNAGVEGAVVVGKLLEQDNPDLGYDAAKGEYVDMIKAGIIDPLKVIRTALVDAASVSSLLTTTEAVVTEIPTKEVASPGMGGGGMGGMGGMGGMGGMGF

SEQ ID NO: 554 - protein, 117 aa, Hordeum vulgare
  Sequence also found in Organisms: Triticum aestivum
MSGVWVFRNGVVKLVENHPASAAGPPGGGAVRRKALLHTPTGEVVASYASLERKLVALGWERYYAGGGGAAGDCMLRFHKRSSVDLISLPKDFGQFSSVHMYDVVIKNRDAFRVIDV

SEQ ID NO: 555 - protein, 341 aa, Hordeum vulgare
MELFAHAKAVRLKSRHDKFLYADEDELHVTQDRNGSSPSARWTVEPVPHAPGAVRLRGRYGRYLAASTEPFLLGMTGRKVLQAAAAPGGRPDASVEWEPVRDGFQVRLKSRAGGVRGGGDKYLRANGGVPPWRNSVTHDVPHRTATQDWVLWDVEIVQVVTPGPATPAPEKAASAPPAALAPDSPPAPKLRPAPTPYEAHHRPTKSQTSPPPPDYAPPPPPPRAKPEPRLSKLESSDSFSAPLHKVEGRAIHYHIADDKGDVDDDIERRSFTFNGSNLEELTQKLQEETGIDDLIVCTRSPISGKLTPLLLQLPPNNAAMHIVLVRESSKVAKTFPWPYGS

SEQ ID NO: 556 - protein, 627 aa, Hordeum vulgare
MASSSAKPYCCSSLNPAHSTPVAGRTTLSTLPAAKPRRFSHGLAAVAANPRASRTAVLRSVHACLAAPRRPEYVPDRIDDPNYVRIFDTTLRDGEQSPGATMTSAEKLVVARQLARLGVDIIEAGFPASSPDDLDAVRSIAIEVGNTPVGEDGHVPVICGLSRCNKRDIDAAWEAVRHARKPRIHTFIATSEIHMQHKLRKTPDQVVAIAREMVAYARSLGCPDVEFSPEDAGRSNREFLYHILEEVIKAGATTLNIPDTVGYTLPHEFGKLIADIKANTPGIENAIISTHCQNDLGLASANTLAGAYAGARQLEVTINGIGERAGNASLEEVVMAIKCRRELLDGLYTGINSQHITMTSKMVQEHSGLHVQPHKAIVGANAFAHESGIHQDGMLKFKGTYEIISPDDIGLTRANEFGIVLGKLSGRHAVRTKLVELGYEINDREFEDFFKRYKEVAEKKKRVTDEDIEALLSDEIFQPKVIWSLGDVQATCGTLGLSTATVKLITLDGEEKIGCSVGTGPVDAAYKAVDQIIQIPTILREYSMTSVTEGIDAIATTRVVITGDVSANKYALTGHSNRSFSGSGAAMDVVVSSVRAYLSALNKMSSFVGAIKASSAAPETLSAQTTE

SEQ ID NO: 557 - protein, 184 aa, Hordeum vulgare
MATKSQKKKKPSAPNPSIDAKKPDPQEPAETRETAAAAAKKKTPKKQKESKEVSAKKAKQQKEGKEVSAKKPKPKKQKESNEIDEIFEATKSDKKRKLQEEEEEESEGASKKAKKGKAEGGSKKKSKKEAGGRGWEPGHDEVEEKRPRRRTNDGLTIYSADELGFGKADAGGTALCPFDCDCCF

SEQ ID NO: 558 - protein, 248 aa, Hordeum vulgare
MASSDEKPVPTPASTGGDGGPAGKPTTTSTMLLDKGAAALQSLRPVKQIKQHVCTFALYAHDPHRQVETHHFVSRLNQDVLQCPVYDSDDKHARLIGVEYIVSRKIFESLPAEEQKLWHSHAHEIKTGLWANPWVPSMLGKAELDHMAGTFGKFWCTWQVDRGDRLPLGAPALMVSPQAERVGAVRPDLVRKRDQKYSFSTEELKAARADVEVPAEPRPGQADYWVRHHKGFAVDVVPHEMKRHAPFP

SEQ ID NO: 559 - protein, 157 aa, Hordeum vulgare
MSSGLSLPATVRPASSGLGGRQLYASPPRHGTRRPCRGLLALRPSTRSCAAFGQDHYGGALVDVGMAVLRRRIRETRMAETNYEAPAGWADWEKRYYPAYVSDVAALAGALQLLAMGTRPGVAAAVTALLLAGVPISALAALHLLGQAVGSVLHHVS

SEQ ID NO: 560 - protein, 513 aa, Hordeum vulgare
MGLSSAADIDGAQLCIFDLRRGQQEGQELDKILFFHPADCPILLQLSVIGLCEGIITFTRIFSPEDDCEVIESDKHSHVFYQAEPDIWMVLVVQKIKDNESTLRFGALQGILKESHSLFAMFHGPIRTLLDRQPSAEFARGHLHTFVTDYLSDFSVGKKLQLPTYRDSLTERGTVQMLTVSREVALEVQSLTTVLGSCLRNVICQSIVLFEDLLVSTTLPLDDTLNLYTYAILRLTPSALSSNGNSWSYLRKGGYVNADTTLSSANGAAAAERYHSRSRDTSPGGQNQMHHNFRPLQREKLSKGKDGFVAADFATTEIRGAVPLNPILWFHQAEERMYLCVYQHKNLTILLVIPASSLINGEEGIAHVKRHLLENASQNIVSVEQKLSRGWGGENAYHVGGYRYILSDPNRKVSRASPPGKVITLSKDSLLALNRLRGEVDLEKSRAKRSDTTHDKDYEVCIRAKNNAWIIAKISRGKELYMAIEKGGETLLYASTAVEKFSNRYCEGAFSTD

SEQ ID NO: 561 - protein, 506 aa, Hordeum vulgare
MGCFQSKPAGKPLPPDADAALPPDDPADPEAANGADGAGADGDEKDGAKRAVPVFREFGLAELRAATKGFSADLIVSESGEKAPNVVYRGRLDGGRLIAVKRFSRLSWPDPQQFLAEAAGVGKVRHKRLVNLIGCCAEGDERLLVAEYMPNDTLSKHLFHWDKQPLPWEMRLRVAHYIAQALDHCNAENRKIYHDLNAYRVLFDEEGDPRLSSFGLMKNSRDGKSYSTNLAYTPPEFLRTGRVIAESVIYSYGTVLLDLLSGKHIPPSHALDLIRGKNILLLMDSSLEGQYANEDASKLVDLASKCLQFEARDRPNIKYLLSSVGPLQKQKEVASHVLMGITKTASVLPTILSPLGKACAGMDLTAVHDILLKTGYKDDEGAENELSFQEWTQQVQEMLNTKKFGDIAFRDKDFKTAIDYYSKLVGMMSVPSATVFARRSFSYLMNGQSELALRDAMQAQVCMPEWPTAFYLQALALSKLGMETDAQDMLNDGATFEAKKQNSWRG

SEQ ID NO: 562 - protein, 895 aa, Hordeum vulgare
MAATTATPTFLRATELRLLRCTLPSPISQPAPPSPPPEHPLGPVVSSAVAAVEVGDYVAAIASAVPHIFHPSAFAEVAQGSPTQAYADLTAAAEAFLREDGGGAASEGFQCRCALVLSAAVAALLAFTQQNVTGPSGKFPPFPFQTSRLDEEGHGDPGSKWDDWASGHLAAFGSHVHGKFALLPFIVFAELLFTSIQGLDSSDCWSVQWWLCRISLSQQNILDELSSSLFDRVQVYKNEMLAHFGELEKVSSYWGSLLCDEEGFSFVSAVFLEAGIVEYKYGQVDASRLHLDSAQEACGIHLSLTGILGFRTIHQVDAKSQMVLVAKTTKSAADDGQSTELAGSQSDGVASRNAGSSVPSESDEFCDILRTPRLAENGNETSGESMTSANTQISLSAIQQAAVLAQCLYVSRRSRSDEMSGWEMAPYIESIDSQEKSYFVVRSLCDVLRIRWESTRSRTKQRALLMMENLVEDIAKEFPVVSQRTKLVFGVHMPPIPALRKEYGELLISCGLLGEALNVFKELELWDNLIYCYRLSGKVADAVSLINTRLSVTPNDPRLWCSLGDATNNDDHYKKALEVSDNKSARALRSLARSAYNRNDFHTSKILWGSALALNSLYPDGWFAYGTAAWKDKDLEKAVDAFSRAVQIDPENGEAWNNIACLHMIRGKSQAAVQAFKEAVKFKRNSWEVWENYSKVALDTCNMRLTLEAVKMVLNLSSNKRFNVDLLDKVMVSVEEQARHLSDTQEAKSISNASDDANKETRLPNQLLGVIGDILQQIVRSGASNAEIWGLYARWHKSKGNLMACSEALLKQVRSLQGSGLWHDQKKFTKYAQASLQLCKVYIEISSTTGSRRELLSAEMHLKSSLKQATDFSGTEEYKSLNDCLDQLRGLIGAA

SEQ ID NO: 563 - protein, 805 aa, Hordeum vulgare
MRGQMQPRPFMMHGGPMPPPQQQFGLTETRPPLAAMLRPRFNIPGLNPSAAAANAAGKISSTYDLVEPMRFLYVHVVKARDLPGVSPTGSIDPFVEVKLGNFKGSTAVLPGNHTPSWHQVFAFSATHLQSHLLEVALKAKDLAGGDDLVGRMVFDLSEVPVRVPPDSPLAPQWYRLDGKRGEKLQRGEIMLSVWLGTQADEAFPEAWHSDAHGAASPSAVASTRAKVYFSPKLVYLRVAAIGAQDLVPHDTSRPMNASVKLQLAGQVRRTRPGAPPGTPNPMWNEEFMFVASEPFDEPLLVTVEDRVGPGRDEPLGRIMLPLNAAMPRHDHFGKPVEPRWYSLARPSDDGEKKEGKFASKIQLRMSLDFGYHVLDESTYYSSDLQPSSKHTRKPSIGILEVGILGARNLIPMKAKDGRTTDAYCVAKYGPKWVRTRTILNTLNPQWNEQYTWEVFDPCTVITVVVFDNTQIGSKNGDARDESIGKVRIRLSTLETDRVYTHFYPLLALKPSGLKKTGELHLAVRFTCTAWVNMMAMYGRPLLPKMHYSQPISVMQLDYLRHQAMQIVSARLSRAEPPLRREVVEYTLDVGSHMFSLRRSKANFYRITSLFCGFASMAKWYDGIRSWRNPITTMLVHMLFLILICYPELILPTIFLYMFMIGIWNYRYRSRHPPHMDTKLSQAEFTHPDELDEEFDTFPSNRPADIVRLRYDRLRSVGGRVQTVVGDLATQGERAHALLSWRDPRATAIFIFLSLVVAIVLYVTPFQVLLVITMLYLLRHPRFRSRMPSVPFNFYRRLPAKSDSLI

SEQ ID NO: 564 - protein, 151 aa, Hordeum vulgare
MSIVRRSNVFDPFADLWADPFDTFRSIVPAISGSNSETAAFANARMDWKETPEAHVFKADLPGVKKEEVKVEVEDGNVLVVSGERTKEKEDKNDKWHRVERSSGKFVRRFRLPEDAKVEEVKAGLENGVLTVTVPKTEVKKPEVKAIEISG

SEQ ID NO: 565 - protein, 260 aa, Hordeum vulgare
MAATHHPASPTGGKPSSPSPPSPVRLAASQAAAVAAIQPSSPRYFFSSLAASSSPHRRIAIAVDLSDESAFAVKWAVQNYLRPGDAVVLLHVRPTSVLYGADWGSIPVSVDEEGAGGAAPASEDPEDDARKKREEDFDAFTSTKSQDLAQPLVAAQIPFKIHIVKDHDMKERLCLEAERLGLSAMIMGSRGFGASRKAGNGRLGSVSDYCVHHCVCPVVVVRYPDDAGAAGGADSVGDELRTVPENEVVFHEAPEGQKEN

SEQ ID NO: 566 - protein, 484 aa, Hordeum vulgare
MGKKGKWLGAVKKVFSPESKEKKEEKLRKKLAARDPSPPDLTPSTSLEVNVSMPPPPPAVPSPHQTEEVQVRDVELELELELEQEQEQSKHVTVEAAPDAPAQTSAALPPGVSREELAAIKIQTAFRGYLARRALRALRGLVRLKSLVEGNSVKRQAASTLRCMQTLARVQSQIRSRRLKMSEENQALQRQLLLKQELDSLRMGEHWDDTTQSKEKIEASLISRQEAAIRRERALAYAFSHQWKSSSRSSNPMFVDPNNPHWGWSWLERWMAAKPSEAGRTGTGKESNIDQGSVKSMSLNLGEGEITKAFNRRGSKPDKSSPTTPKLTRPASRLSPSTPTAKVTPIVVKKKPATPKNGLSQVDDDARSVLSVQSERPRRHSIATSTVRDDESLASSPSVPSYMAATKSARAKSRLQGSPLIDSAETTPEKGGSVSIGSAKKRLSFPAGGAPPSPMRRHSGPPKVESMVKDIAVTPQPEALAING

SEQ ID NO: 567 - protein, 180 aa, Hordeum vulgare
MEEGKQGFQPHLMGGGGRMRGAAGAMGLQKQNSWSPDIERDEAWERRRRGILGRGRRSPLQRAQSVTDDQLDELRGSLDLGFRFDPPSQRCAACDAGRSRLVETLPALDLLYAVNANANANAKAGCAASQCSCGASSEASEPSPIGSPLSILSPDDPPETVKMRLKQWAQVVALSMRSRS

SEQ ID NO: 568 - protein, 566 aa, Hordeum vulgare
MASASEDEAGSERCCGSYSPSADVSGSETSSDCSAPTATTRRFPFSSSSASASASRGLASSSSSQLPTPSAAFFPSSVPASDLSEIDMMKERFAKLLLGEDMSGSGKGVCTALAVSNAITNLSATVFGELWRLEPLAPARKAMWTREMDWLLSVADSIVELIPSLQELPDGGGQFEVMVPRPRSDLYMNLPALRKLDAMLLAMIDEFKETEFWYVDRGIVVDDGGGGPCPSSSSSSSCGRPSSVRQEEKWWLPCPRVPPKGLPEEARRKLQQSRDCANQILKAAMAINSDVLAEMEIPDAYLESLPKSGRTCLGEIIYRYITAEQFSPECLLDCLDLSSEHHTLEVANRIEAAIHVWRLKGQKKTTTQAKSKKSWGGKVKGLVGDTKSQVLSQRADGLLQSLRLRHPGLPQTSLDMNKIQYNKDVGQSILESYSRVLESLAFNTIARIDDVIYVDDATKKSAAAETVSIFNRGTGAPVQKKISPSPFSIQHTPYASPFATPTFCSSTPVNGNSPGRAPLPPPSKKNPPAKPEIKVEKLFSGDVEKVWTYAGNLSARKEAGDAPERD

SEQ ID NO: 569 - protein, 299 aa, Phaseolus vulgaris
MFRSGMELFHRAKVVRLRSHHDKYLLADEDEESVTQDRNGSSRNAKWTVELIPEFDNLLRLKSCYGKYLTASNQPLLLGVTGRKVVQSVPRQLDSSVEWEPVRDGAQVKLKTRYGNFLRANGGLPPWRNSVTHDIPHRTATQDWILWDVDVLEIHVESPAPPPIPHSDSLDFDSYTPSAVSIKSTAFSRQESTDSNVGSPPKLEGRTIYYHVAEDNGDVDDENVQGYSLTFKGNGVEQLTRKFVEETGLEGVIVCTRSPLNGKLYPLRLQLPPNNVTMQVVLVLPSSKVARDFEEQGLL

SEQ ID NO: 570 - protein, 785 aa, Phaseolus vulgaris
VEAARFLDLFAACLSHNSVFSGSLRKLTSTDRSSALGYLPSIAELKSGANFFNYSPSLINSGLSEVPKCRLIEEKSLENPVKTAQNKYELPRMPPWFSYVGSLKLYQPLAGILRFVGLSIVADNISEGLLLHVIETLLGYFRKLVSELRLREYNKESWQSWYDRHGSGQLLRQASTAACMLNEIIFGVSDQASNDFARIFHNCAFHTSFWEMPKDKGVRSYLVECIGGILHEYLSAEVWNVPIDCGTADLPLHAVVEEDISLYFFQDAAMLQQVIIDGVGIFNMCLGRDFVSSGFLHSSLYLLLENLSSSNYRVRNAADSVLHILSTTSGFPTVGQLVLENADYVVDSICRQLRHLDLNHHVPNVLASMLSYIGVAHKILPLLEEPMRSVSMELEILGRHQHPDLTIPFLKAVAEIVKASKREAFLLPTQAELFAGDVKSIISNSAETMQDQWEDILFKLNDSRRYRRTVGSIAGSCVTAAIPLLASIKQEICLAALDIIESGTLAIAKVEAAYKHEREIKEATEEALESLSLYQLKDTLEANEEGADENRLLPAMNKIWPFLVTCIQNRNPVAVRRCLSVISNVVPVCGGNFFTRRFLSDGPHFWKLLTTSPFHKKSVFKDEKIPLQLPYRSSSMSSEDSLAETSYLKVQIAVLNMIGDLCRNKSSSSALELVLKKVSGLVVGIACSSVVGLRDASLNALHGLSSIDPDLVWLLLADIYYTKYTQDFPPPSPQLPQISQILPLPMSPKEHLYVQYGGQSYGFDINLASLDIAFTRFDSQRQMYS

SEQ ID NO: 571 - protein, 77 aa, Phaseolus vulgaris
MGLWTILEGFLLLANALAILNEGRFLAPRGWGFTDFSGGRTKSFKGQLIGLIYATQYLRVPLILLNSICIILKFVSG

SEQ ID NO: 572 - protein, 857 aa, Phaseolus vulgaris
MATLADIGVSATINILSAFAFLLAFALLRIQPVNDRVYFPKWYLSGGRSSPRSSGNFVGKFVNLNFRTYLTFLNWMPQALRMSESEIISHAGLDSAAFLRIYTLGLKIFVPITVVALLILIPVNVSSGTLFFLKRELVVSDIDKLSISNVPPESIRFFVHIALEYMFTLWICFLLYKEYDNIASMRLHFIASQRRRVEQFTVLVRNIPRMPDHAVSDSVNGFFQTNHPDHYIGHQAVYNANKFAKLSKRRDRLQNWLDYYQLKFERHPDKRSTVKTGFLGLWGGKVDAIEYYKHAIKELDNLMTSERQRVIKDPKAILPVAFLSFNSRWGASVCAQTQQSKNPTLWLTDWAPEPRDVYWRNLAIPFVSLSIRKLVITLSVFALVFFYMIPIAFVQSLANLEGLEKVAPFLRPVIELNFIKSFLQGFLPGLALKVFLYILPSVLMIMSKIEGYTALSTLERKTAAKYYYFMLVNVFLGSIVTGTAFQQLHAFLHQSPTQIPRTIGVSIPMKATFFMTYIMVDGWAGIASEILRLKPLVIYHLKNMFIVKTERDKGKAMDPGSVDFPETIPSLQLYFLLGIVYAVVTPILLPFILVFFAFAYLVYRHQIINVYNQQYESAAAFWPLVHSRIIASMLISQFLLLGLLSTKKAAKSTPLLVILPVLTFAFHKYCQRRFEPAFRKYPIEEAMSKDLLEKSTEPDLNIKAYLADAYLHPIFRSFEVEEELIEIEVDKQQTAAPSSPSTEPSSPSPPHHLDQSFPSHHLHIPSPPHHLPELSALHHLPELSAPHHLPELPPPHHLPQLSPPHHLPQLSPPHHLPQLSPPHHIIEPALPPQYNEYPPGYYYQYHPPSPPHYVYQY

SEQ ID NO: 573 - protein, 824 aa, Brachypodium distachyon
MLEEMVVAVENGVKMESAAAATTDADADSPISVLEDEKMSESKDEKASRFVDASTSLPVKFEANGGEVHPIVQALNAEEALLQSVKVETADEYLDASTSLPIDLEAKNGDASFITEVMSKEEEQLYQARLKEEEEEEEAKTKEAAKHAFDPKARFSKLDELLTQTQLFSEFLLEKMEQITDKGVEVKDEEEPVEEPQKGRGRKRKANSKPQYNDKKAKTAVAAMLTRSQEDRSADDGILTEEEKCEIEQAKLVPLMTGGKLKSYQIKGVKWLISLWQNGLNGILADQMGLGKTIQTIGFLAHLKGNGLHGPYMVIAPLSTLSNWLNEISRFVPSLTGLIYHGDKVTRAELRRKFMPKTAGPDFPIIITSYEIAMSDARKVLSHYKWQYVIVDEGHRLKNSKCKLLSELKHIPMDNKLLLTGTPLQNNLAELWSLLNFILPDIFSSHQEFESWFDFSGKGDEEQQEDTDENKRVVVSKLHAILRPFLLRRMKEDVEQMLPRKKEIIIYANMTEHQRQIQTHLIEKTFDDYLLGSADIVLRPGMKAKLNNLMIQMRKNCAHPDLFNAAFDSTGLYPPIGKLLEQCGKFQLFNRLLDSLLKRKHKVLVFSQWTKVLDLIAYYLDTKGLEVCRIDGGVRLEERRRQIAEFNDLNSSLNVFILSTRAGGLGINLTSADTCILYDSDWNPQADLQAMDRCHRIGQTKPVHVYRLATSNSVEGRIIKKAFGKLKLEHVVIGKGQFQQDRAKPNALDEAELLALLRNEQDEEDRMIQTDISDEDLLKVMDRSDLTGPPGAVDATPLVPLKGPGWEVVVASKSGGGMLTALTS

SEQ ID NO: 574 - protein, 493 aa, Chlamydomonas reinhardtii
MDPAKIRPSSAYNTPYWTTNSGAPVWNNNNSMTVGTRGPILLEDYHLVEKLAQFDRERIPERVVHARGAAAKGFFEVTHDISALTAADFLRAPGVQTPVIVRFSTVVHERGSPETLRDPRGFAVKFYTREGNFDMVGNNMPVFFIRDGMKFPDMVHAFKPNPKSHIQEAWRIMDFLSHHPESCHMLTFLLDDAGIPLNYRHMPGFGVHTMKLINKAGRETYVKFHWVPKCGEKYLLDDEAVMVGGANHSHATKDLFDAIAAGDYPEWALMVQTMDPADEDKFDFDPLDVTKTWPESLFPMQPVGRMVLNRNVDNFFNENEQVAFCPAIIVPGIGYSDDKLLQTRIFSYADTQRHRLGPNYLLLPVNAPRAPHHNNHHEGFMNFMHRDEEINYFPSRFDPVRNAERVAAVSSAPLSGRREKMVIAKENNFMQAGARWRAFDAARQERFVVRVADMLADPRCTQEIRRIWVGYWSQADPQLGARIAAKLQGRGCL

SEQ ID NO: 575 - protein, 162 aa, Chlamydomonas reinhardtii
MAASCLRPAPTASAQMMTRSPVAGLPRPCSALQRSGCTLQGAFGTFAPQTTRTFVVTWAKGGVMDAPTTTQQPASGVERSQKRPPIYKVLLHNDNYNKREYVVKVLLKVVEQITVDDAVTCMQEAHETGVALVVACPQDNAERYCEGLRLNGLTSTIEPGGC

SEQ ID NO: 576 - protein, 476 aa, Chlamydomonas reinhardtii
MAGFRPLNLVRPFLSVLPDVQQADRRVPFREKFLYTAVTLFIFLVCSQLPLYGIKTNSSSDPFYWVRVIMASNRGTCMELGISPIVTSGLVMQLLAGSKIIDVDNSVKADRELLNGAQKLLGVLITIGEAVAYVVSGMYGDVRELGAVNAILIITQLFMAGIIVICLDELLQKGYGLGSGISLFIATNICESIIWKAFSPYTITGPRGAEFEGAIIAMFHLLITRSDKVRGLKEAFYRTNLPNMTNLMATILIFLVVIYFQGFRVDLPVRNKRARGQQGNYPIKLFYTSNMPIILQSALVSNLYFISQLLYKRYGGNMLVQLLGRWQQTEYGGGQMIPVGGLVYYISPPSSLTEVAQNPLHALFYVTFMLTACALFSKTWIEVSGSSASDVAKQLKEQQMFIQGHRDTTASLKKELNRYIPIAAAFGGMCIGALTIVADFMGAIGSGTGILLAVTIIYQYFETYEKEKAQAPGSLF

SEQ ID NO: 577 - protein, 1039 aa, Chlamydomonas reinhardtii
MRRSAARLLRGVGQAVARSGEVAEASAVKLFDINASRGLSAQTLSMLGALSHAATPLPSGFAASGIRSISVAALQPSDDFKPRHNSGTPAEIDSMVKATGFGSLDALIDATVPKAIVRKDGMNLGKYHEGMTESQFLEYFKAMASKNKVYKSYIGMGYYGTHVPNVILRNVLENPGWYTQYTPYQAEIAQGRLESLLNFQTMICDLTGMAISNASLLDEATAAAEAMTMCSAIARGKKPKFLVSSKCHPQTIAVCQTRAEGLGLEAVVVDEDKMAYAKDVCGVLLQYPATDGSISDYKALVAKAHAANVKVCVATDLLALTMLAPPGEWGADIVIGSAQRFGVPMGYGGPHAAFLACHDEFKRLMPGRIIGMSIDAQGKPALRMAMQTREQHIRRDKATSNICTAQALLANMAALYAVYHGPEGLKTIAHRVNGLASVFAAGAAKLGHTVPSAPFFDTVSVTVKDGDADKYVALALNEKINIRKLSKNTISLAFDETSSVADVDALLRVLNCGRDAPFTAASLAPAVEGGVGGFARKSTFLQQPIFNTYHNEHDMLRYLKRLENKDLSLVHSMIPLGSCTMKLNATAEMMPITWPELAALHPFVPVDQAEGYAEMFRDLSAQLCSITGFDAMSLQPNSGASGEYAGLMAIRAFHLSRNEGHRNVCIIPVSAHGTNPASAVMAGMKIVTVSTDSQGNVNIPELRAKAEEHSKNLAALMITYPSTHGVYEDGVDEICRIIHQHGGQVYMDGANMNAQVGLTAPGLIGADVCHLNLHKTFCIPHGGGGPGMGPIGVKAHLAPFLPTHPVVPTGALPSRPADPKPFGTMAAAPFGSSLILPISYAYISMMGSAGLTMASKLAILKANYMAKRLAGHYPVLFTGPNGTCAHEFILDLRPLKETAGIEAEDVAKRLMDYGFHAPTMSWPVPGTLMIEPTESESKEELDRFCEAMISIREEIREIESGKADKANNILKHAPHAPGVVLADKWERPYSRERAAFPAPWVRQAKFWPTVSRVDNVYGDRHLITRWDNGTSAEAVAAHA

SEQ ID NO: 578 - protein, 1051 aa, Chlamydomonas reinhardtii
MRNSSTLLRSAFARRGTHLQQQSALWELHRARYSTNDDSNREEGGLLNKIWRAGLGQKPKDSSSSSSSAAGGSSSSSSSSRSSGASSGDALVPSGPERRHHKVFVVELSRKPLFPGIYTPVIISKNEALVKEIMDVKKQGAHAYVGAFLKRPEPPLGMTAAAAVAAAGETEVRDAASHLYDIGTFAQVHTVLAGDSADSAQLLLLGHRRIRKTGVISADPLRVHVDHLRDESYTSDDILKATSMEIVNTMRDLLQLNPLYGEQFRTLLSLTGSIDLQDMSRLVDAAASLTSADDTTLQTVLETLNVPERARLVLGLLKKEVELCKLQADIREQVEGKIVKEQRRMLLMEQLKSIKKELGLERDDKSALLQRFQARWDERKALAPPDVARAVQEELDKLGGLEPVSPEFNITRTYLDWLTSLPWGATTQELFDLVRAKKVLDDDHYGLEDVKDRILEFIAVSHLRGSAQGKILCLVGPPGVGKTSIGRSIAHALNRKYYRFSVGGLHDVAEIKGHRRTYVGAMPGKLVQCLKSTQSSNPLVLIDEVDKLGRGHSGDPASALLELLDPEQNAAFTDHYLDLPLDLSKVLFVCTANSLDTIPGPLLDRMEVIRLSGYAQDEKRAIARRYLEPAAAADAGVPPGSVSLADDALEALIGEYCREAGVRNLKKHVDKVYRKVALQLVRAGAKVIRLDEEGKTPQQQQQQGEAAVEAGAGSSSGTAEASTSTSTPSSTSSTATNTDSTTTTSTANSTSSKPAPKVRVEYDGPPITVHRAQLKDYVGQAPFAKDKFYESTPPGVVMGLAWTPLGGATLYVEAARVAGSEARGSLTTTGQLGDVFRESATIAHTYARNFLAARIADGTIPAGAAASSPSDDTPASSPSDATTASSSSSASSGSSSSSSGKQQQQQPQLPSGPGSFFSSGALHVHVPAGATPKDGPSAGCTLVTALLSLALDRPVRPDLAMTGEVTLTGCVLPIGGVKEKVLAARRSGVKVVVFPEGNRPEYEELAEDIKQGLEPHFVSSYDQVFKLALEHDSGSGNADKAKQEAPLSTSA

SEQ ID NO: 579 - protein, 293 aa, Chlamydomonas reinhardtii
MRQSLSSTRSASATPSACCSRTAARAVHAGRWLPQRRRNLTPVAAAAEGGGGAVLRQVLTGPERTKLDTGDDRGFYDVPRLVKHVDDGFLDQVTELYRQRIPEGGAVLDLCSSWVSHLPQDVTYSKVVGHGMNAAELARNPRLDSFFVRNLNASPDGWAAADQSFDAVLCCVSVQYLQQPERVFAEVYRVLKPGGVFIITFSNRLFYTKAISAWRDASGYARCQLVKQYFQAVAGFTAPEVLMEVPKAAGSASSAAGSGGALPQWLKPLGRFFERTSSDPFYAVVAYRNFKRE

SEQ ID NO: 580 - protein, 392 aa, Gossypium hirsutum
  Sequence also found in Organisms: Gossypium raimondii
MASSSVIAWGSGEDGQLGIGNNEEREWVCVVQALEPHNVRSVVAGSRNSLAICDDGKLFTWGWNQRGTLGHPPETKTENIPSQVKALANVKIVQAAIGGWHCLAVDDEGRAYAWGGNEYGQCGEEPERKDDTGRPLRRDIVIPQRCAPKLVVRQVAAGGTHSVVLTREGYVWTWGQPWPPGDIKQISVPVRVQGLENVRLITVGAFHNLALQEDGTLWAWGNNEYGQLGTGDTQPRSQPIPVQGLSGLTLVDIAAGGWHSTALTDDGEVYGWGRGEHGRLGFGDNDKSSKMVPQRVQLLAGEDIVQVSCGGTHSVALTRDGRMFSFGRGDHGRLGYGRKATTGQPMEVPINLPAPKSVSGSGAEGYWISKLVACGGRHTLAIVEWKTDESKP

SEQ ID NO: 581 - protein, 407 aa, Gossypium hirsutum
MKSVFSAPGDYIYFKSQVPLHRIPIGTKQWRYYDFGPKVVTPLICLPGTAGTADVYYKQIMCLSMKGYRVISVDIPCVWNHQEWIQSFEKFLDAIDVHHIHLYGTSLGGFLAQLFAQHRPRRVKSLILSNTFLETRSFAAAMPWAPFVSWTPSFLLKRYVLTGIRDGPHEPFIADSVDFVVSQVETLSRDELASRLTLTVDSASVKPLLLSDSFITIMDTNDYSAIPQQLKDQLSERYPGARRAYLKTGGDFPFLSRPDEVNLHLQLHLRRVGLEAQPELVQSIPKDGTGGGPSKENDKEDRDDEQKDNGGNPESNSEESQPSPSAPESSESHGLDEQLLSNAEIHYINQKDSIILKPSAMSMNQHSAAAGILLQSTWEFFIFSLLPLYVDSLYIYSNNAWKLRQLV

SEQ ID NO: 582 - protein, 612 aa, Gossypium hirsutum
MEGSVEEMAKAVSDLALDSSAAGEAQSKNARKKELKNKQREEERRRKEEEKAAKQAAAKAGTQSQKHAAAEDEDMDPTQFHENRLKFLAAQKAEGKNPYPHKFFTSMSIVEYIEKYGSLGNGEHIEDATVSLAGRIMSKRASSSKLFFYDLHGGGAKVQVMADASKSGLDEAEFAKFHSTVKRGDIVGVTGFPGKTKRGELSIFPMSFLVLSHCLHMMPRQKAGPDASVKKTDVWIPGSTRNPETYILKDQETRYRQRYLDLMLNLEVRQIFKTRSKIISYVRSFLDNLDFLEVETPMMNMIAGGAAARPFVTHHNELNMKLYMRIAPELYLKELVVGGLDRVYEIGKQFRNEGIDLTHNPEFTTCEFYMAFADYNDLMELTEKMLSGMVKELTGSYKIKYHANGLDSAPIEIDFTPPFRRLDMVEELEKMANLNIPKPFSSDETNKYLADACEKLEIKCPPPQTTARLLDKLVGHFLEETCVNPTFIINHPEIMSPLAKWHRSKPGLTERFELFINKHELCNAYTELNDPVVQRQRFAEQLKDRQSGDDEAMALDETFCTALEYGLPPTGGWGLGIDRLAMLLTDSQNIKEVLLFPAMKPQDEPSTKAPAT

SEQ ID NO: 583 - protein, 187 aa, Gossypium hirsutum
MRIPNLTKAFILLMAITLMSTQANSLIPYSRSLWDVMLAEDPFKILEQTPVTVPKGSEPVALARADWKETPRYHAITLDIPGMKKEDLKIEVEENRVLRISGERKEEQEIEGEKWHRAERTNGKFWRQFRLPANVDMDRIKAHMEDGVLRISVPKIVDENKKQAKVIDIVQSGGTGEDIKATSQGHQ

SEQ ID NO: 584 - protein, 554 aa, Gossypium hirsutum
MASQDSQMPSSSPLSSNKDEMRPKADFQPSIWGDLFLNCPDKNIDARTEKRHQQLKEEVRKMIVAPMANSTQKLAFIDSVQRLGVSYHFTKEIEDELENIYHNNNDAENDLYTTSLRFRLLREHGYNVSCDVFNKFKDEQGNFKSSVTSDVRGLLELYQASYLRVHGEDILDEAISFTTNHLSLAVSSLDHPLSEEVSHALKQSIRRGLPRVEARHYLSVYQDIESHNKALLEFAKIDFNMLQFLHRKELSEICRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMEQLVPEHGRQYRVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVSAQEAYDVFNKHVESAWKDVNQEFLKPTEMPTEVLNRSLNLARVMDVLYREGDGYTYVGKAAKGGITSLLIEPIAL

SEQ ID NO: 585 - protein, 355 aa, Gossypium hirsutum
MEGLMQVPYDVTVRFMLTFLERNLLPDAIIRRLTRLLLASRLRSGYKPSTELQLSDLLQFAHSLKEMPIAIKTDKPKTQHYELPTSFFKLVLGKNFKYSCCYFSDESKTLEDAEEAMLELYCERSQLKDGQTVLDVGCGWGSLSLYIARKYPNCRVTGICNSTTQKAFIEEQYRDRQLQNVEIIVADISTFEMEASYDRIYSIEMFEHMKNYHDLLKKISKWMKEDSLLFVHYFCHKAFAYHFEDINEDDWITRYFFTGGTMPSANLLLYFQDDVSVVNHWLVNGKHYAKTSEEWLKRMDRSLASIKPIMESTYGKDQAVKWTVYWRTFFIAVAELFGYNNGEEWMVAVFLFKKK

SEQ ID NO: 586 - protein, 108 aa, Gossypium hirsutum
  Sequence also found in Organisms: Gossypium raimondii
MASSFRAFLNSPVGPKTTHFWGPVANWGFVLAGLVDMNKPPEMISGNMTSAMCVYSALFMRFAWMVQPRNYLLLACHASNETVQLYQLSRWARAQGYLSEKKDKATLQ

SEQ ID NO: 587 - protein, 421 aa, Gossypium hirsutum
MLNKLALPESSTFPGKPMPPTAECWFDDACILDMDYFVKTISGIKAKGVRPDLVGSIIAHYASKWLPDLSGNDTEKGPMSLQESSPESVTVSWMKKRFFVETLVGILPPERDSIPCNFLLRLLRTANMVGVEPSYKAELEKRISWQLDQASLKELMIPSFSHTCGTLLDVELVIRLVKRFASLDEGTRSGIAVVKVAKLVDSYLAEAALDTNLSLEDFIALGAALPSHARAMDDGLYRAIDTYLKAHPGVSKQDRKVLCRLIDSRKLSPEASLHAAQNERLPVRAVIQVLFCEQSKLNRHVDWSGSFNGTRSPNPAGLEAPVRCMSKREMNAQQMEIKKLKEELLRVQNQCVAIQMQMEKLVDKKKGFFRWKKLGIMPSLKSSVSVFEKIEEEREANFGRQTPIDIKHKPVRPPKWRKSMS

SEQ ID NO: 588 - protein, 233 aa, Gossypium hirsutum
MGNSIGGRNKAKVMKIDGETIKLKTPIRVWDVLKDYPTGHVLLDSQTVKHYGIRAKPLEPQESLKPKKIYFLVELPKLADDEVHNAPRRVRSGGIHMSAKDRLECLMLSRRTVSDLSMVRPSSTSMVPDGVRLGGGGGTSGGGMMTVKMRLPKSQMAKLMEESKDGVEVAEKILDLYTGNGGSGGDEAGNRIHREAPWKPGLGTVGENFKPKREKRVSFIPQEEGEIHLANHL

SEQ ID NO: 589 - protein, 158 aa, Gossypium hirsutum
MKMAISLVLSRLILFLTLTCFAAVSSSTTTTTTLKRHSGFLYSRTRGKCTPQFWSSRREAWPRMVPQGSTVSNVFGSRASERYRSDMTLLESRAVNEEGNVFNELLKQASAALLNSYARKGFPYSAWEVKTLMIQGLVSEYAAARLTRLFSVANDACI

SEQ ID NO: 590 - protein, 182 aa, Setaria italica
MGSPVPLRPLALACFIFLCSSFWAANGMYGRVGAAAAEVESRRRMRLHTDGSRGDAHAWPGYLYTRAVGRCTPQFWSSGAEPWPNIVPQEAAVSKVFGSRSVERYGPRLTLLEATMRTDDIGGSAFVKLVKQGSAALLNAYTRRGFPFDSWEVKALLLEALVSEEVAAVQAERFEQANESCV

SEQ ID NO: 591 - protein, 929 aa, Setaria italica
MDQQRRSSLRSYGSNASSQSGSFDFDHDQDKERAGSQHGDGDRREVVVKIDAEPHSPVSLSAAAGVSRNNSAVSTPRAGGAVSMLAASASGSSASTSPSVGGDASRSGDSFSFKNRPPQSPSSPGESSEDPPSRLIGSFLRKQAAAGGELSIDPDFEVDDMRRPPRAPTSVSASRELRVSFQNPHKRFSPSTSSASSSSYDGGDNRNQSGIDGDTAEVLRCTSTSTGSSLLARSKTRSRLMDPPPPSSAPANEPDPRKSFVSKGLPPKSGQLRSGLIGKSGLIGKSGGFDDEDDDPFVDEGMTSDFKRDTMDCLLIMEWVSLVVIVGALICSVTIPSLSRKKVSGLHLWKWELLVFVLICGRLVSGWVIRIAVFFVERNFLLRKKVLYFVYGVRGAVRNVLWLGIALVSWHLLFDKDAKRETHTLVLPYVTKVLCCLLVATVIRLVKTLLLKVLASSFHVSTYFDRIQEALFNQYVIETLSGPPLVDESRMMAEVQRLQSAGAAIPSELEATAMPSKSGPVPKSGRLTTAPSRRGGGVSKQLQRQKTERHLDDGISIDQLHRLSQKNISAWSMKRLMKIVRYGALTTMDEQLKHATGEDELATEIHSEYEAKVAAKRIFQNVAKPGSKHIYLSDLMRFMRQEEALKAMDLFEGAQENNRVSKRSLKNWVVNAFRERKALALTLNDTKTAVNKLHQMANVVVALIVLALWLLILGIATSKFFVLLSSQLLVAVFMFGNTLRTIFEAIVFLFVMHPFDVGDRCEVDGMQVVVEEMNIMTTIFLRYDNLKVYYPNSQLAQLPIMNYYRSPDMGDAVDFTVHVGTPVEKLSLMKERLLHYLDNKKEHWYPGSMVVLRDVDDTNKLKVSIWCRHTINFHDMGMRFERRELLLQEMIKILRDLEIEYRMLPLDINVRNAPTIQSARMPSTWTFNY

SEQ ID NO: 592 - protein, 139 aa, Setaria italica
MQIRVRCGCGDSSCPEWAVVELQGVVQPQASFSGDIRGLHIGRLCSAPSPSSSKGGYTFTVGYHELAGTKVTLKKPLLVLRKKKVTGGAADQEPPTAAEEAELEVIGVIRHKILFKDRPKALISKPPTKEKKAVQPAAN

SEQ ID NO: 593 - protein, 122 aa, Setaria italica
MGNCLETSRRGRSGGGGGSVHYSKTNPVWVEEEVGRKEEEEEEARKGESAPAAGAAATEVKIRITRKQLEELLRRVEDGKESGDGVPVRDVISELLYVASTSSNFRHRDEGQWRPSLQSIPE

SEQ ID NO: 594 - protein, 88 aa, Setaria italica
MPMNAGLRAYREVLRLVRRLPAETRPYYAKYARENFVNYRDLSADDDLAALLRRAYTHSSWVLSKYSIDGEKAAARLKDLGGGHPAGH

SEQ ID NO: 595 - protein, 452 aa, Setaria italica
MEAAAAAPVLDAFFAGPRHHHHQLRPTAAAGGGCRSARLQAQPSRAAAAPYARADWQAACAILASNSSGGNGGSTSSADASNSNSSSKQPAPRVNGQEPPRPPALEATPAPVPAELDLVPVSNLPRPLSISDLSPAPMHGSQLRVAYQGVPGAYSEAAAAKAYPGCDAIPCDQFEVAFQAVELWIADRAVLPVENSLGGSIHRNYDLLLRHRLHIVGEVQLPVHHCLLALPGVRRELLTRVISHPQALAQCELTLNAMGLNVAREAFDDTAGAAEHVAAGGLRDTAAIASARAAELYGLQVLADGIQDDASNVTRFVMLAREPIIPRTDRPFKTSIVFAHDNDGTSILFKVLSAFAFRDISLTKIESRPHRHRPIRLVDDANVGTAKHFEYMFYIDFQASMADVRAQNALAEIQEFTSFLRVLGSYPMDMTPWDAAPSSWSSRVDNSSSQHL

SEQ ID NO: 596 - protein, 93 aa, Pennisetum glaucum
  Sequence also found in Organisms: Setaria italica
MLEGKAMVEDTDMPAKMQAQAMAAASRALDRFDVLDCRSIAAHIKKEFDTIHGPGWQCVVGSSFGCYFTHSKGSFIYFRLESLRFLVFKGAAA

SEQ ID NO: 597 - protein, 360 aa, Setaria italica
MPLLAVASSTRAAAVRPPRASAASGEAAASEAAGRRPVKVILPKKKPQKWSTGMEPGEYGGGPATIKPRKYWWGKEDRDPVGNTDDFIWNKDFLPHMERVIANGGAAAEPTITRRSPVDEEESGFLSINRAMSLDSVEVDLSKELQAPTRPILQTQVEAARRGRAIGAEAVNGATSARWRLVPTRREQAKWDRAAKAATGGSDVILRESKSRVQQGDPKELAARAREDYLKLKQRLQLLTLGIGGVGVVSAYVSYSPEIAVSFGAGLIGSLVYLRMLGTSVDSLAGGTGETVKSAAAQPRLLIPVVLVMMYNRWNGILVPDYGFMHLELIPMLVGFFTYKIATFAQAIQDSIPAVEKREV

SEQ ID NO: 598 - protein, 895 aa, Setaria italica
MPTKGQFSSERNVKIISGRDGQKKGNSQHDQIAHVPKDRVTAANGNVDGKIEDRIRVAKNDKFRRQRESWSGEKAACMKGSKPWPGRKTTTVDELVKHMSNVPSYLQRKETADHLQDKALNVGVLEWGLLANWSQQQKHELARSHGASPSNTSRSVLFSSPSHSSASPSSRSLESNQSTPMSDHHHSSIRAQQSRLSDKQHGTARYSPSPNSAVLSLLPGHGKHLSPENSCNYVGSGLRNVSLPADSLGSSSRSFGRHEMGEDEETRRKIEDVVHHCSRRLFTDSDKIGKNFFTSNNNDSMCNDPEQSSVLNGENFESLISDAVMDTPRNGSRLPDVFLEDIEPSHEFPRIPYSCPLPIIDSAAKEIGTTSTEARDNFVGTDAKLSKNGNRNRSAMSGAENPPQCSAKFSDRVPDRHLGSGMNRVSRSSSLKETPCARQPDAVPSVDKIGDRSSSNSKGRRSPLRRMLDPILKPRHSSPVRPSFVPKCHLPVNTTKQSLDMGRSVPQNVQRRSVDMVVNSNYPTEANINQPPHVLLNSARYLQQEKDSPTTRQALLQLAWKNGLPLFMLSYGESDILAATVRKKSISEKDDLESTYAVFTVEEPKKKSGAWIKAGGKNKKHHLLSSIVGELKVTRRKSRCHHTKNIHVHREFVLVGSEFLPSSEESGDSHISGELAAFISALPQQEAETSSQSSSQNVGQNNSAPIGCGCPPLGNFQPCTRNANSGSANVIAVLPDGFHGTSTSGQPLPLIERWKSGGTCDCGGWDEGCILSVLTGAAPENDAIQANQAMDGSQRFELLAQGRSREDRNAFSMISFKEGLYTVEFRSSIALLQAFAMCIVMLHGRFPSRMQVASQAAQEHDLLANHELKTMAASQGRAPTSYVPHRPPLSPVGRA

SEQ ID NO: 599 - protein, 560 aa, Setaria italica
MAAMMQPQIILLKEGTDTSQGRAQVVSNINACTAVADTVRTTLGPRGMDKLIHDDKGGVTISNDGATIMRLLDIVHPAAKILVDIAKSQDSEVGDGTTTVVLLAGEFLKEAKPYVEDGVHPHSLIRSYRAAGNMAIQRVKELAVSIEGKSLEEKKSLLAKCAATTLSSKLIGGEKEFFASMVVDAVLAICNDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVTEEDLQRVAAATGGTVQTSVNNVIDEVLGSCEVFEEKQVGNERFNIFSGCPSGQTATIVLRGGADQFIEEAERSLHDAIMIVRRALKNSTVVPGGGAIDMEISKYLRQHARTIAGKSQFFVNSFAKALEVIPRQLCDNAGFDATDVLNKLRQKHASGDGANYGVDINTGGIADSFANFVWEPAVVKINAINAATEASCLILSVDETVKNPKSESAQGDAAAGAMAGRGGGAMRGRGGRGMRRR

SEQ ID NO: 600 - protein, 354 aa, Setaria italica
MELLVRAGAAAAAASSSPHPSLQLPRSTCVVPGPCRPRPRRPRYPSLRAAAAAAAVAVEPETEDQQNSISETEVFACPVCYEALIRKGPPGINLPAIYRSGFKCSKCNKSFTSKDIFLDLTVTSGTKEYTEQKPARTELFRSPLVSFLYERGWRQNFNRSGFPGLDEEFQMAQDYFQPVAGGILLDVSCGSGLFTRKFAKSGTYSAVIALDFSENMLRQCYEFIKQDDTLLKANLALVRADISRLPFASCSVDAIHAGAAIHCWPSPSNAVAEISRVLRPGGVFVGTTFLSSPRNNPFSVEALRPLRQIVGPVNTSYNYFTEGELEDLCKSCGLVNYSSKVQRSFIMFSGQKPY

SEQ ID NO: 601 - protein, 624 aa, Setaria italica
MAPPPRVCVTGGGGFIASWLVKLLLSRGYAVRATLRDPGNPKNAHLKELDKAPENLRLFKGDVLEYDTLTPAVEGCEGVFHLATPVPEDKMVDPESEVLDPAVKGTLNVLKVCSAAKVQKLVVVSSNAAVDFNPTWPQDTLKDESCWSDKEFCKENGDWYSVAKIMAEQAALEYADKNGLNVVTLCPPLVFGPLLQPVVNTSSKFLIYVIKGGPDVMNNKLWHIVDVRDVADALLLLYEKKESSGRYICSPNHIRTKDLVALLKKLYPQYNCVNNILDVDQKASLTCQKLMDLGWEPRTLEETLADSVECYEKAGALQDVPGHPCRLPHLFRLAGDPKNAILTQLDGASGNLRLFKADVLDCGTLAAAFAGCEGVFHPATPKELMDPTVKGTKNVLEACSATNVQKLIVVSSVAASCFDPNWPEGKLKDESCWTDKEFCKDTQNWYSLAKTEAEEMALEYGKKNGLHVVTFCPGLVVGPLLQHVAVNTSSKVLLYIIKGGPDTLSNKFWPLVDVRDLADAMLLAYEKSESSGRYICSLDQMDIKDLVSLMKSMFPNYNYTDKMVDVDYKVYTTSDKLKNLGWQPRKLEETLADSVEYFEKAGLLQDADGKPCRLPYFYRVNAEE

SEQ ID NO: 602 - protein, 434 aa, Setaria italica
MEGTNQPPGSRMQGAPFGSLDLHGNSMETHAPNLGKQIFINSQIPGTLTMNRASEPDDFPGFQFKEDGRSDKNHHQHSHHSKNGLIDDEGHYMTEDATNTPSVKGKKASMWHRMKWTDSMVKLLITAVSYTGDDHGADLGGGRRNSTIMQKKGKWKAISKVMGERDCHVSPQQCEDKFNDLNKRYKRLIDILGRGTACDVVEKPELLDSMNHLSDKMKDDVKKLLNSKQLFFEEMCSYHNNNRRKLPEDHALQHSLLLALRCKEDHDPLRDASGDADEDDQSADSDHEENDDEEQHPVHTNMREPSMDKRARHGDAALLTSSSHEGIKRSDPHGITVDINKAFPDGTNWALLQQDLASQSLEVRKRLLQIEEKNLELKKQCVKWERFRKKKDREIERMAMENEHMMIENKQLELELRQKELELELKLKGQANHA

SEQ ID NO: 603 - protein, 483 aa, Setaria italica
MASAGGPSGVVGISVRPDSSAACLFQKVGARSNSLPGAAPVQVRRCHNKARNGQAIRCAMATGKEQGAVTTTSSDQHKGGLRGKLNKVVLAYSGGLDTSVIVPWLRENYGCEVVCFTADVGQGAIELEGLEKKAKASGACQLVVKDLREEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVAPENAPSEPEYLEIGIIAGVPVSINGRDLSPASLLAELNEIGGKHGIGRIDMVENRLVGMKSRGVYETPGGTIMAAAVRELEALTLDRETMQWKDMVALKYAELVYAGRWFDPLRQSFDAFMENITATTTGSVTLKLYKGSVNVASRKSPYSLYREDISSFENGEIYNQADAEGFIRLYGLPTRVRAMLEKGI

SEQ ID NO: 604 - protein, 591 aa, Setaria italica
MVVARAKKAAPAGAGGAGAGARRSGVRVGPARLEGLPAAWPAGAAAVKVKWPAPGGALSQMLTGRWARGVTAVEPVAAGGTVRWEPRDGNRFSLHVEPAGARGRTERGVFFSLLYGFQEQGRGKDLVRLEEIGTAMISLEECCWEMQLQQQRQQLVVVPIRVRKDGWASDAMLYVNVELVDMMNTRSDIERAVSFREKPRTTSKPPPHAMRDHRKSLEAAAYHDVLDLKQLLDLAEKEGRVAVYGSKRNSDTSSVSSFSSSSSSSTISISSASSSGGASPELASTSKRRFLPWMRRSRDFDKRSTESLSQELPIKCMDDDPAGSWETREFTSRDAETKLRTPVFFASIDQRDGSAGGESACTALVAVLAAALHANHPAMPTRPELDALIRDGSSEWRRLCDDEAHMARFPNRHFDLETVLAARTRPIAVQHDRTFVGFFQPESFASLSGAMSFDDVWREIAGGEREPGRADVYIVSWNDHFFVLKVESDCYYIIDTLGERLHEGCDRAYMLRFDGSSEMHALSTPAVDDGKEEEVIVTGKECCREFIKRFLAAIPLREELEIEKKGAGSVGAPHQRLQIEFHFTVLQDDER

SEQ ID NO: 605 - protein, 488 aa, Setaria italica
MDMSVASSHHLRPSPAGPARRPGFAAAAAPRVALRPGGASPPSRGRCAVAAAASGAGGEAASAPAAVTAVAPAAAAARDKVRRHTISVFVGDESGMINRIAGVFARRGYNIESLAVGLNKDKALFTIVVSGTDKVLNQVIEQLNKLVNVLSVEDLSKEPQVERELMLIKLNVKPDQRPEVMVLVDIFRAKVVDISDTTLTLEVAGDPGKIAAVQRNLRKFGIKEICRTGKIALRREKIGATARFWRFSAASYPDLIEALPKNPLTSVNRTVNGSLDQPSNAGGDVYPVEPYESLSMNQVLDAHWGVLDDDDDSTGLRSHTLSILVNDCPGVLNIVTGVFARRGYNIQSLAVGPAEKEGISRITTVVPGTNESIEKLVQQLYKLIDVHEVHDITHLPFSERELMLIKVSVNTAARREILDIAEIFRAKPVDVSDHTVTLQLSGDLNKMVALQRLLEHYGICEVARTGRVALVRESGVDSKYLRGFSLPL

SEQ ID NO: 606 - protein, 534 aa, Setaria italica
MSAAQQAEPTTSPASPTPAGAGSTTVIKNARHRPSALKLCYHVAISNLPYLLLAPFAAALFVRLSRHSPADLAAALTSNPPLTAALAALAAVLVTIYLARRPRAVYLLDFACYKPGPEHVVTRETFMRQSTAAGVFTGDNLAFQRKILERSGLGQETYFPRAVLNAPPNPCMAEARAEAEAVMFGAIDQVLAKTGVRARDIGVVVVNCSLFNPTPSLSAMIVNHYKLRGNVASYNLGGMGCSAGLISIDLAKQLLQVHRNTYALVVSMENITLNWYWGNNRSMLMSNCLFRMGGAAVLLTNRGGADRRRAKYQLMHTVRTHHGADDRAYRCVFQEEDETGRVGVALSKDLMAVAGEALKTNITTLGPLVLPMSEQILFLASLVGRKVFGLRSLKPYIPDFKMAFEHFCIHAGGRAVLDTIEKNLELSAWHMEPSRMTLYRWGNTSSSSLWYELAYTEAQGRVRRGHRAWQIAFGSGFKCNSAVWRALRTIDPAKEKVGNPWVEEIHRFPVEVPKVESVVVAPAAAAAAAAAAES

SEQ ID NO: 607 - protein, 442 aa, Setaria italica
MDPQPFVRLSVGQLGLKLPGGNASKASSRLCDCEIRLGGFPVQTAQVPLIHSPEFNLDPFTNAAVFSLDESDLRSLAAPGCFRPPRPCLEVAVYLARFGGARCGVTWRKRLVGVFRVELASSSEWRDGKPVLLHHGWAGIGKGAAEARPELHLRVKMEADPRYIFQFDDEVALNPQVVQLHGSSRQPIFSCKFIRDRRRPSQGDGQYWSSSGGSEETDMEMAMRRERKGWKVVIHDLSGSAVAAAFMATPFVPAPGGDTVARSNPGAWLIVRAGTTGSSDSWQPWGRLEAWRESSSSAPAASSRDTVRLRLHLLPDGQDDCVLVSEAPLGSDKGGEFSIDMDRQAPAPVPAAAAAAGHCAVSLGAACAGGGFVMSCKVEGEARSSRPFVQLAMRHVTCMEDAAMFVALAAAVDLSVKACRPFRRKPGKKAASPSPDPLELDT

SEQ ID NO: 608 - protein, 546 aa, Setaria italica
MAAALQPRRARLLLFLGLLLHALARGAVEAAAPFRARDVLPLLPRRLAWQLMGATAHSAVDLLPSFVGAVAPGGAPAAWRGACFAENEAVLSLTPGAGAGAVGRNGTGGGLHGNTSSGLGGAVLHLKTASPESWTCMDLYVFATPYRIAWDYYMRSNENHTFEIKAWEEAAELEYVKQHGIAVFLMPSGMLGTLLSLIDVVPLFSNTGWGQDANLAFLQKHMGTSFQKRSQPWSANIRKEDVHSGDFLALSKIRGRWGGFQTLEKWVTGAFAGHTAVFLKDENGTLWVAESGYENKKGDEIISMTPWDEWWGMALKDDSNPQIALLPLHPDVRARFNESAAWDFARSMYGKPYGYHNMIFSWIDTMSDNYPPPLDANLVMAIMSMWTRLQPHYASNMWNEALNKRLGTEKLDLHGIITETERRGLSFNQLLTIPERDDWEYSDGKSTTCVAFILSMYKAAGVFAPFTESIQVTEFTIRDAYMLKVFEDNQTRLPGWCNAAADRLPFCQILGEYKMDLPEYNTIEPYANMNENCPSAPPTYSRPARC

SEQ ID NO: 609 - protein, 343 aa, Setaria italica
MADEIDELIGFLSDPKPQVRSAAVDIVRGLTGGEDGLRALTVRADRALPALLRLLASAAGSGAGEAAADSLVNLSQDAALAARLAALGAVDAAMDVIARRAGEQPALARSLVMLLVNLTHVASGVAALLQVGDEKVQGLYVAKLVRSFCRSSSDSEEQDTFEYVASMLVNISKVEAGRRILMEPKRGLLKQIIRQFDSTNQLRKKGVAGTIRNCCFEADTQLQNLLSLAEYLWPALLLPVAGKKIYTEEDRSKMPLELSSALSHEREAVEDSEIRQHTLEAIYMIVLQDDGRRSFWSVNGPRILQVGYEDEEDPKVMEAYELIGSLLVGKGEGEQEQGGEKSQ

SEQ ID NO: 610 - protein, 558 aa, Setaria italica
MSLRGDPAPAGDETAEELLERVQGMVPAALEAARAAGGFPGRWKAIAAKLETLPACLSDLSSHPCFAKNALCRELLQSVAATLAEAADLAGRCREPPPDGKLRTQSAIDALAGKLDLNLRDCALLVKTGVLSDASGPSPPPEAAAAGSPAHADVRELLARLQIGQTEAKNRAVDGLLEALRKDEKSVLAVLGRANVSAMVQLLTASAPVVRGKAATVVCQVAESGSCDGLLVSEGVLPPLIRLAESGSLVGREKAALTLQRLSVSPDVARAIVGHGGAGPLIEICQTGDSVSQSAAAGALKNLSAVPEVRQALADEGIVRVMVTLLDCGAVGGSKEHAAECLQNLTSSNDGLRRAVVSEGGLRSLLLYLDGPLPPEPAVGALRNLVGAVSPDSLVSLGVLPRLVHVLRVGPVGAQQAAAAAICRISSTAEMKRAVGEHGCVPLLVRLLEAKSSGAREVAAQALASLVGCPANAREVRKDDKGVPRLVQLLDPSPANTAKKYAIACLLTLSAAKRCKKLMISHGAIGYLKKLSDMDVAGARKLLERLERGSLRSLFSRD

SEQ ID NO: 611 - protein, 1072 aa, Setaria italica
MAARALGPLPPLGSMWGPPRAAAGSPAIEASAAAAHAAPRGGAAVSSALSGLRGRPSLCSVQFMDGLRSNIQAEVNLALSPKASMSNGSDDSTITCKGFCTIAWNLKADVQDGYLIFITGDPVTLGCWESNMAVQLAPVENDNIWTAEIKVPYGVHFKYNYFVREEKGSCSDIIWRPGPDYSLSIPSVGRKKQVIVVKDLWMKTSVAGLPAPSWGSWLMEAGSLEGEFFEGGNHQSIVEAHSARDTTDQDLSVGEHIILKMGNGTPLHSKLLSESLSTKMHNRITDKPNANNISQHGRYQVVEEPWILESIAASKKPVARVKDKKGKKKFSNNKHDFSKASENVPQEDQPVEEPWLFESMVEANETIVHADGKIEAKDIIRKLRKIEKPPAPLDENKPPTCEPSSRVILINSSVCTMQRIAVLEDGKLVELLLEPIKNNVQCDSIYLGIVTKLVPHMGGAFVDIGILRPSLMSIKQNRDPFVYPQVVKNSRADPVDDSYYNEDNLPTYDEDDDMSDDEFADEETHDGSSSFPVENITDNEEGMADAKIDIVDSTEFEGISGYDEDKDDENDHMEDEYSEEILQADQSEISNDLKTLSSIQHALRESDDDTNGSRWSQVRKGTKIMVQVVKEGLGSKGPTLSPFPCLRSRFWILVSRGNKVGVSKKITGIERTRLKGITKLLRPPGFTLTARTVAAGHSWEELQRDLDGLLSAWKGITEHAQSAALAAEEGVDGAVPVMLHRAKGQALSVVQDDFNEKVKRLVVDSPRTYHEVTSYLQEVAPELCSRVDLYEKRKPIFDEYNIEKEIDNILCKRVPLQNGGSLVIEQTEALVSIDVNGGHSMFGQGTSQEKAILEVNLEAAKQIARELRLRDIGGIIVVDFIDMTDDSNKRLVYEEMKKAVEKDRSTVGVSELSKLGLMEITRKRVRPSVTFMISEPCTCCHGTGRVEALDTSFSKIEREICRRLAASRRKSDPEKPKSWPRFVLRVDHEMCTYLTSGKKTKLGLLSSSLKVWILLKIARGFSRGAFELLPYSEEKENGEEKETSSESPQKEGSPKLSVFPIKKWMSRAKRAK

SEQ ID NO: 612 - protein, 247 aa, Setaria italica
MSERSESATEKIMSSIIDTIADNLPKQKSGQFGPGSVSDKVKNKLFGRQKTLHGALGGGKPADCLLWRNKKISSSVLAVATAIWVFFEWLDYHFLTIVSFALVLGMVVQFVWSNFSNMLSGSPSQVPRVELPDELFVNIAVAIGAQINKFLSFLQDLSCERNLKHFVVAIAGLWAAAVIGSWCNFLTVIYIGFVCAHTLPVLYEKYEDQVDNFLYSLLGLLQDQYQKLDQGVLSKIPKGNLKAKKNE

SEQ ID NO: 613 - protein, 438 aa, Setaria italica
MAASHHHRGHFFLLALSLAASLAAAADSSSTHNITTVLDGRSEYTLYNSYLSETKVCDEINSEHTVTVLVLTNGAMSSLVANLSLADIKNALRLLTLLDYFDEKKLHSLDSGSELTTSLYQKTGQAAGNMGHVNITDLRGGKVGFAPAAPGAKFQSTYTKRVDEEPSTLSVLEVSDPITFPGLFGSPSASSVNLTDLLEKAGCKQFARLIVSSGVVKMYQAAMDKALTLLAPNDDAFKAKDLPDLSKLSSADLVTLLQYHALPQYTPKSSLKVAKGDIPTLASTGAGKYDLSVVSSGDDVSLDTGKDKSRVASTVLDDTPTVILTVDKVLLPPGLFGGAPSPAPAPGPAADVPASAPAPETSAPAPSPKAAGKKKKKAKSPSHSPPAPPSDSPDMAPADAPEGDAADKVESKKNGAAAAAASFAATGACVALAVASFL

SEQ ID NO: 614 - protein, 416 aa, Setaria italica
MEQEDESEGAAAEQPADEAEEQLADDLLLHFERVLHSDPLIDEVGFLHPTQFGSLGCGQDGDSASQAPEFQHRYFWCRDHKLAICSEILPKLYRAARDAYYNTRNAPSQAVHLMSLTKVLLILCPDMLTAWNSRKMVLSEKYDLTKLKDELQLCALILSYSPKNESTWSHRRWVLKQVAEQNQDMAQLVEKESVLVKEIAERSKMNYRAWRHRCWLIPYMTRKQVLDELKKSTRWSELHVADNCCFHYRRSLLLALLDSCLGNGEDSVSWESETCMLWKDELRWNEMLIRRYQGRESLWNHRRFLSQWWIRQLFSVEETCPSTTSQVDLFITQEIGLLSECLNDPADEFGESCVQAELSALYILWISKQVPAVKGKLEERLHSVSIVGLKDVLVRACRPEKRWLWMNLLGLPDRSQ

SEQ ID NO: 615 - protein, 396 aa, Setaria italica
MGKSGKKPRESHRQGRGRRASHFDDDLPSSAYDALPPHHNDSTDDDDDTNEATAEDEREENGEAGEQDQWPAGSMPSKFHLYQLSVQSPKGDISYLQKFFLMYVGGRVPLHLQEDFCGTALLSTEWIRTDARRTAIGLDLDLESLEWCLENNLSKIGADGYSRMLLFHGNVLQPKEARLVKQKFSDLVQGLDVSSENGSSGSNSCEQPGLANSKCLANSTMSEAALPGRDIICAFNYSCCCLHSRKDLVLYFRHAFSSLSKRGGIFVMDVYGGTSSERKLRLQRKFPSFTYFWDQEEFDIISRQTRISLHFQAGKKQMLRHAFTYHWRLWSIPEIKDCLEEAGFKSIHVWIREMPNTQSNGNAKEYNANRDVKYEESQRFNQGDAWNAYVVGVANI

SEQ ID NO: 616 - protein, 333 aa, Setaria italica
MALAAAVLLLLPGILFTAMAATPYPHGRGGDPLLGASKKYEGSSDLVDLRYHMGPVLSAAPLRLYVLWYGRWDPAHQAPVRDFLLSISDPSPPRPSVADWWATAALYADQTLANVTRRVALAGEAADESASLGRSLSRLDIQRVLASTVAAGHLPADTRGGAYLVLTAPGVGVQDFCRAVCGFHYFTFPSLVGHTLPYAWVGHSGGRCADVCAYPFALPSYMSRSGMAALRPPNGDAGVDGMVSVIAHELAELATNPLINAWYAGEDPTAPTEIADLCEGVYGTGGGGGYAGKVAVDKQGRSWNVNGRKGRKFLVQWLWSPEAKACVGPNASD

SEQ ID NO: 617 - protein, 542 aa, Setaria italica
MNSEAECAAAPAAADAVGGGGGRAEVDTSAPFESVREAVDRFGGSAAWFAPSKKHEHSEQAAEAIDVQEQAAQLENEVARKERETLDVLKELESTKKVIADLKLKIQKEATETSPDEAVKSEETDQVSAPGPEEQQPENVTVDMDGMEGIEENPQLSSGSVLVELEQAKEILNRTTSDLAQVRAAVELLRNSIAKEKILLERGQEKLSSNTSLVSHLEDELDQTAQKLETLKDLQKRRKDPSDIFIEIKKMTTEVQQLRSMANDSKSEAMLLAAEIEQAKASISTAEIRCIAAKKMEEAARAAESLALAEIKALLSSQSSFEGDNSSDGVTLSIEEYFTLCSKTLEADENSKKKVGDAMLQVDIANSSESESVKRLEDAKVEVEECKKALQEALKRVEAANHGKLAVEEILRRWKSESGHRKRSICGSPKFKNAAHPRKDSHSMDITDDVSDRSFKQTLSIGQILSMKLMGPDGYDKSVWDDKASEMPNISLGQILNRSGVLCREDMAPRKRISGKRKKFALTGLSVLLAKQSKSKKKRESF

SEQ ID NO: 618 - protein, 710 aa, Setaria italica
MSSDPSARSSPSSSAASPPNDARRRDQAGQATPPPGGEAIDTSGKSRRGRRRRVPWCPPGLGAAWPLDPRARWVRQWNRAYLLACAAGLMVDPLFLYTVSVSGPLMCLFLDGWLAAAVTALRCAVDAMHVWNIATQLRLTRGTAGSKRAEGSSGDEEQQAAAAAGEEEDDDEEGADEVARKLPAGARSKKASVLDLFVILPVMQVVVWVAAPAMIRAGLTTPVMTVLLVAFLLEYLPKIYHAVRFLRRMQGHSGYVFGTIWWGIVLNLMAYFVAAHAVGACWYLLGVQRASKCLKEQCQLQAAAGGCARSGAVVACAAPLYYGGSPSAAAAGHLGAGRLAWARNAPARATCLASSSGDGSGGYQYGAYKWTVMLVANPSRVERMLLPIFWGLMTLSTFGNLESTTEWLEIVFNILTITGGLILVTMLIGNIKVFLNATTSKKQAMHTRLRAVEWWMRRKGLPRGFRHRVRQFERQRWAATRGVDECQIVRDLPEGLRRDIKYHLCLDLVRQVPLFQHMDDLVLENICDRVKSLIFPKGETIVREGDVVRRMLFIVRGHLACSQALRNGATSSCTLGPGNFSGDELLSWCLRRPFRDRLPTASATLVTLESTEAFGLDAADVKYVTQHFRYTFANEKVRRSARYYSPGWRTWAAVAVQLAWRRYKHRKTLASLSFIRPRRPLSRCSSLGEEKLRLYTAILTSPKPNQDDDF

SEQ ID NO: 619 - protein, 463 aa, Setaria italica
MRAAAGGRAVFHLQHLRPRPPCRASPAPATAVLPHSAPASRAYHRRLPKGFLPTLEPGVSAVYLCRRVHSTTCSVSLDGRLQGELDGAKGEVRKHETVGAFQKIPMVMPATDILMSAQRKSRNVPPTKGIANIAKRERNKGAKQLDALMKELSVPLRTYTENFPKRRDLHPYERSLIELTFGEGYYEQVLGRVDALRKRITSVGKQHASVCAKSTTKREAEERLAEGKKRLEEAFQHGQHAIDDLVNVAKALRSMPVVDLHIPTLCLVGSPNVGKSSLVRILSSGKPEVCSYPFTTRGILMGHIVSNHERFQVTDTPGLLTRHDDDRNNIERLTLAVLSYLPIAVLYVHDLSEDCGTSVADQYTTYKHMKERFGDRLWIDVISKCDLLGKKAPISFDDADEDVTQYRKFGPEGALRVSVQSEIGVKELKERVHQLLTSQMARIKADKAEHETQEAGVSVPWRS

SEQ ID NO: 620 - protein, 409 aa, Setaria italica
MSCFGWFKRRSRSVGGSAGKRGASAPPSGPATTTTVSGVSTSRSDDSGAVRPVSKSAGSAASSQSQRSISSLYEERGHGQLRVFDYEELEAATAEFSRAQKLGEGGFGSVYKGFVRAADGKGDRIPVAVKKLNQRGLQGHKQWLAEVQFLGVLEHPNLVKLLGYCAVDSERGPQRLLVYEFMPNKSLEDHLFRRANPPLSWNGRLQVILGAAEGLAYLHEGVEVQVIYRDFKTSNILLDKDFRAKLSDFGLAREGPTGANTHVSTAVVGTHGYAAPEYIDSGHLTAKSDVWSFGVVLYEILTGRRSLDRNKPVAEQKLLEWVAQFPPDSRNFRMIMDPRLRGEYSVKAAREIAKLADSCLLKNAKERPTMSEVVEVLRRAVQAAEPDGRAPGAGAVKGKRADAAAPSRR

SEQ ID NO: 621 - protein, 540 aa, Setaria italica
MAALQHLGKAVDGNFRGAAAAGGMVRPPPPSLIAPNGTAAAPRSSAPPSRREEGAAAANGGPDLPAPRSVSKPPPGKKFSTRAAGGNKPRKPAPPLWQWQAAFFVSFALNVGLFLRTHPYVNSTVPPHHEEHQQACLMHLDAADNSGRRTARQQEEPVAAGAPSTGKPAVTPESVINLDHGDPTMFEEFWRGTGSAAEIVIPGWQTMSYFSDVGNVCWFLEPGFDHEVRRLHRLVGNAAVDGYHVLVGTGSTQLFMAALYALSPPAAAGAGAPMSVVSTAPYYSSYPAVTDFLQSGLFRWAGDANSFKGDAYIELVCSPNNPDGTIREAVLSSESGNGIAVHDLAYYWPQYTPITKRADHDIMLFTVSKSTGHAGTRIGWALVKDRDVAKKMTKFIELNTIGVSKDSQLRAAKVLRAVSDAYELPEAREEHRLFDYGRRKMAERWSMLREAAAASGIFSLPDETSGHCNFAKETASTNPAFAWLRCDREDVEDCASFLRGHKILTRSGSQFGADPRYVRVSMLDRDDAYDIFVRRLASLK

SEQ ID NO: 622 - protein, 129 aa, Setaria italica
MAAVARVFRGSRFLMSPAAGAAAAAGAKKAAPAPQVTKADATAAKEKRGIMKPVPVSEEMRRFAGGAPELARPQAVKLIWAHIKANGLQNPAKKTEINCDATLKSLFGGRDKVGMLEISKLLNPHFLKN

SEQ ID NO: 623 - protein, 73 aa, Setaria italica
MGFVLVISLPFIFFSILLGFGCYFLGKHRGREEMRAGVGAQIYGTPLPPPGVVGGSSPAHEPFHMKKEGAENV

SEQ ID NO: 624 - protein, 148 aa, Setaria italica
MAYMRVTHRDEEGKKVTEKMPIPETRRPDTAKHFERKLEEQGFHRLERHPANAPRGVGIGTPPPKSGRGGKYTWEGPGGLVQDELDPAPPAIDPNDPNYEEDDGAVGAEDDAAKEVVVGEVEVAKVAEERDGVARVDVAPQLLQEQKQ

SEQ ID NO: 625 - protein, 864 aa, Setaria italica
MFGVKIPIIDDLTGGNKHGHLNGNVVLMRKNVLDVNSIAGSLIDGISEFLGRGVTCQLISSTVVDPNNGNRGKVGAEASLEQWLLNPPPLLAGENQFSVTFDWEVEKHGVPGAIIVTNNHASEFFLKTITLDNVPGRGTVVFVANSWVYPQSKYRYNRVFFANDTYLPSQMPAALKPYRDDELRNLRGDDQQGPYQAHDRVYRYDVYNDLGNPDGGNPRPTLGGSKHHPYPRRGRTGRRPTETDHDCESRLTLLDDDVYVPRDERFGHIKSADFLGYSIKALVDGIVPALKGYVGVEFNSFKDIIRLYEGGIKVPDVPALEEIRKQFPLQLIKDLMPVGGDFLLKLPMPKIIKEDKKAWMSDDEFAREILAGVNPMIIKRLTEFPPKSTLDPSKYGDHTSTITAAHIERNLEGLTVQQALESNRLYVVDHHDHYMPFLVEINNLDDNFIYATRTLLFLRGDGTLAPVAIELSLPELRDGITAAKSTVYTPTSTTGAEAWVWHLAKAYVNVNDYCWHQGISHWLNTHAVMEPFIIATNRQLSVTHPVHKLLLPHYRDTMNINALARQKLINAGGIFEMTVFPRKYAIEISSKVYGSWSFADQALPNDLVKRGMAVEDPSSPYKVRLLIEDYPYASDGLAIWHAIEQWVAEYLAIYYPDDGVLQADAELQAWWKEAREVGHADLKDEPWWPRMTTVAELTRACATIIWIASALHAAVNFGQYPYCGYHPNRPSVSRRPMPAPGTEEYAELERDPERFFVRSITCQFQAVVGISLLEILSSHSSDEVYLGQRDTPGWTSDARAQEAFKRFGARLAEIEKRVEAMNADPRLKNRNSPAKFPYTLLSPNVSDRENAGVTARGIPNSISI

SEQ ID NO: 626 - protein, 313 aa, Setaria italica
MASGCGGRRGRKPRARARGKGKKTRYLSLSDVLIKVEAEAGTPPRSQEDEPAPVWEEAEVKQEDAGDGGGQQQPPQQVEPFALHNEASTLFAALPAPSLSDILGASAGGGDGDESPSPSASPDGGSGGSELPCAQEEDLARRALRGRERWVYCSSGSSPTATTATTSSSSPCSSAASTGASVRSLLLKLDYGEILAAWADRGSLYIGGGGGGADSDAAPELELNAVLVEVEPPEHAASAPPPPAPAAFAWTAAETEAAGRERAEKVRRYKEKRRNRLFAKRIRYEVRRVNAVKRPRFKGRFIKEHEDIKLQPT

SEQ ID NO: 627 - protein, 514 aa, Gossypium hirsutum
  Sequence also found in Organisms: Gossypium raimondii
MAGGEQKKGGGEQKKAGGGGKKKEVKKETGLGLSFTKDENFGEWYSEVVVNGEMIEYYDISGCYILRPWAMSIWENMQTFFDAEIKKMKVKNCYFPLFVSPGVLQKEKDHIEGFAPEVAWVTKSGESDLEVPIAIRPTSETVMYPYYSKWIRGHRDLPLKLNQWCNVVRWEFSNPTPFIRSREFLWQEGHTAFATKEEADTEVLQILELYRRIYEEFLAIPVTKGRKSELEKFAGGLYTTSVEAFIPNTGRGIQGATSHCLGQNFAKMFEINFENEKGEKSMVWQNSWAYSTRTIGVMVMVHGDNKGLVLPPKVAALQVIVIPVPYKDADTQGIFDACAATVAILSDAGIRAEADLRENYSPGWKYSNWEMKGVPLRIEIGPRDLANNQVRAVRRDNGEKTDISRVFLVEQVKGMLEKIQQNLFDVAKQKRDACIEVVKTWDEFIKALGQKKLILAPWCDEEEVEKDVKARTKGEMGAAKSLCTPFEQPELPEGTKCFASGKPATKWTYWGRSY

SEQ ID NO: 628 - protein, 458 aa, Gossypium raimondii
MVGLGDNNNPSCQNNISSKAKDKKKNKKKKRGGSKRKMTAEQTSAFKSVTEWVYLDRHHHPNSSSTAGLSSWVVDDFGVQKSLGRGTEKMVFELHSHSKHSDGFLSPSKLVERAHGNGVKVLALTDHDTMSGITEAVEAARRFGIKIIPGVEISTIFSPRNPEMEEPVHILAYYSSCGPTRYEELDKLLANIREGRYVRAKDMVLKLNKLKLPLKWEHVTKIAGKGVAPGRLHVARAMVEAGYVENLKQAFARYLYDGGPAYSTGSEPLAEEAVQLICETGGLAVLAHPWALKNPIPIIRRLKDAGLHGMEVYRSDGRLAAYNDLADTYNLLKLGGSDYHGRGGHGESELGSVNLPVVVLHDFLKVARPIWCSAIKDILEGYAKEPSDTNLAKIARFTRMGSFKGSTPLSCGKDLIDRCLASWLTAEEQQNDEFEAIRLKLSHATINLSGVQVPIETK

SEQ ID NO: 629 - protein, 808 aa, Gossypium raimondii
MDGWLKGSNSFVDRVGLNDGTVLALSGRDFDNRFKNEKCVDIPSSEPVMIPGNSGNVVSSLGTCSDRVGLNDGTVLALSGRDFASQFKNENYVDVLPLEHVMVPGNLVPSFGTCSDIVGLNVDSQPVPIPGNSVPSSSVNEGDLHEDFDFSDEVLKYISQMLMEEDMEDKTCMFKESSAALQAAEKAFYEVLGERYPPSPEYDGDQNQESSDESHGQNCWRCSSASISSGSVVDPGHNHDFSEQRALNFPSQASSSHSSGNSTGSVVDGYADSPVSTVRLPEIFNNSESAIQFRKGFEEASKFLPNGGSLFVHGENDGLFLKELKEETKDVAVDKVEKDEISQDGSRGKKNPYPEDLSLECGRSTKQSLVYTESAVSPEMFDMVLLNCQSVTELQKVLQDETSKNVQQNGQLKGSNGGKARGKKHGGKRNMVDLRTLLTLCAQAVAADDRRSANELIKQIRQHSSPMGDGMQRIAHYFIDGLEARLAGSGTQIYTALITKPTSAADVLKAHHLFLAACPFKKLSNFFSNKTIMNLAENAARLHIIDFGILYGFQWPCLIRRLSSRPGGPPKLRITGIDLPQPGFRPAERVEETGRRLANYAETFKVPFEFHAIAQKWDTIQIEDLGIDRDEVLVVNCMYRLRNLLDETVIVESPRNKVLNLIRKMNPDVFILGIVNGAYSAPFFITRFREALFHFSTLFDMLETNVPREIPERMLIEREIFGWEAMNVIACEGAERIERPETYKQWQMRNMRAGLRQLPLNKEIMKIAKERVDTGYHKDFVIDEDNRWLLQGWKGRIVYALSTWVPAP

SEQ ID NO: 630 - protein, 150 aa, Gossypium hirsutum
  Sequence also found in Organisms: Gossypium raimondii
MGALDSLSDYISDLVTVHGKRKKRKVMQTVEIKVKMDCDGCERRVKNAVSSMKGVKSVEVNRKKSYVSVSGYVEPNKVLNKVKSTGKRAEFWPYVPYNLVAYPYVAQAYDKKAPSGYVKEAVQALPSPNAVDEKFVTFFSDENPNACSIM

SEQ ID NO: 631 - protein, 255 aa, Gossypium hirsutum
  Sequence also found in Organisms: Gossypium raimondii
MVSHLVTTIRNVVGITGNVISLFLFLSPVPTFIRIWKKGSVEQFSPAPYLATLINCMVWVVYGLPMVHPNSTLVVTINGTGTAIEIVYLTLFLIYCHDKKKRVKVMLIVLVEIIFIAGVTALVLIIAHTTQRRSMVVGIIAILFNIMMYAAPLSVMKLVITTKSVEYMPFFLSLASFANGVAWTAYAFLPFDPFIAVPNGLGTLFSLAQLLLYATYYKSTKRIIAARQEAKMEMHLSEVVVNGDNKDPKKNSTAP

SEQ ID NO: 632 - protein, 251 aa, Vitis vinifera
MACHCAFPFSSSPQRDCFSMTHTSLKPSRASKPVVLSSIGSTKASYNALVFEAARLLGPPAKFDASKLKVVPMGEEIDNYSGISPRVYTLSHCDFTANLTLTISNIISLDQLKGWYNKDDVVAEWKEVKGEKCLHVHCYLSGPSLFLDLAAEFRYHIFSKELPLVLKAVLHGDSVFFREHPELMDAIVRVYFHSSSTKYNCMECWGPLKDAAQGRQGDHTHGSLTASKEGSRPQNWGNPKSIFQAFFTFLL

SEQ ID NO: 633 - protein, 466 aa, Vitis vinifera
MDYHIYGFPNLKMINILFLASFFLLSTHAHSSALPRKPSSSSNSPQINSNSVLVALLDSHYTELAELVEKALLLPTLEDAVGKHNITIFAPRNEALERDLDPEFKRFLLEPGNLKSLQTLLLFHIIPNRIGSGEWPEGLSGDPTHSTLSNDRLRLESKGSGVRSVDLAAVVQPDAVLRPDGVIHGIERLLIPRSVEEDFNRRRSLRSISAVLPEGAPEVDPRTHRLKKPVSVPAGAPPVLPIYDAMAPGPSLAPAPAPGPGGPRGHFDGESQVKDFIQTLLHYGGYNEMADILVNLTSLATEMGRLVSEGYVLTVLAPNDEAMAKLTTDQLSEPGAPEQIMYYHLVPEYQTEESMYNAVRRFGKVRYDTLRLPHKVVAQEADGSVKFGEGDGSAYLFDPDIYTDGRISVQGIDGVLFPAEEKETKLEAKTSRVTKLVAKPRRGKLMEVACRMLGAFGQDSRFTTCQ

SEQ ID NO: 634 - protein, 157 aa, Vitis vinifera
MANLYVKAEPPADLNRNTEWFTYPGVWTTYILILFFAWLLVLSIFGCSPGMAWTVVNLFHFLVTYHFFHWKKGTPFAEDQGIYNRLTWWEQIDNGKQLTRNRKFLTVVPVVLYLIASHTTDYQHPMLFFNTLAVIVLVIAKFPNMHKVRIFGINADH

SEQ ID NO: 635 - protein, 320 aa, Vitis vinifera
MEFWGVEVKAGEPLEVVPGDDMLVHISQASLGEIKKDKGNELVCLYANIGGQKLVLGTLSAEKFPQISFDLVFEKKFELSHNWKNGSVYFCGYKAANSVESESSDSSSDSDSEFEIDLPHNTTVDNGKPQQLKQEKPESAAAKQVKIVEPNKDAKSPKENDDDSDKDSDESMDDEDESSEDEDMVNDRSASSEDEDDDENEDNEDDKNEISKKKETPKKAGPSKKRPTESVSKTPVPDKKAKFVTPQKTDGKKSDDKKSGGHVATPYPSKQAGKTPANTEKPKQQVQKSGGSFSCKSCNRSFNSENALQSHTKAKHTAAK

SEQ ID NO: 636 - protein, 422 aa, Zea mays
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGNTISFSECGGIEIEENWDKVKTIFLPTEKQMTPDACAPLIATLPLEVRTKIGGFIRAVFSVFQDLDFSFLEMNPFTLVNGEPYPLDMRGELDDTAAFKNFNKWGNIVFPLPFGRVLSPSESFIHELDEKTSASLKFTVLNPKGRIWTMVAGGGASVIYADTVGDLGYASELGNYAEYSGAPKEEEVLQYARVLLDCATSDPDGRKRALLIGGGIANFTDVASTFSGIIRALREKESKLKAARMNIYVRRGGPNYQTGLAKMRTLGAELGVPIEVYGPEATMTGICKEAIDCIMAA

SEQ ID NO: 637 - protein, 139 aa, Zea mays
MKGKADTSKKDEGRLRAGGAAGKRKKAAASGKPKRPPSAFFVFMSEFRQEYQALHPGNKSVATVSKAAGEKWRAMSDQEKQPYVDQAGQKKQDYEKTKANFDKKESTSSKKAKTEDEDGSKSEVDDEDGSSDEENDDDE

SEQ ID NO: 638 - protein, 344 aa, Zea mays
MSDALINGLAGAGGGIIAQLLTYPLQTVNARQQTERDPSKPAFKDGAARQLYLVVKNEGWERLYGGLMPSLVGTAASQGVYYYFYQIFRNRAEARALERSRRGLGDGSVGMLQSLTVAALSGCVNVLLTNPIWVVVTRMQTHRKANKQQRPQGLNCALDKPLEAATAENAPYKTIDVFQELYKESGVLGFWKGVIPALIMVSNPAIQFMLYETLLKKLKKRRASNFKGADGLTALEIFLLGAVAKLGATVVTYPLLVVKARLQAKHMINDDKRHRYKGTLDAFTKMVRYEGLSGMYKGMGTKIVQSVFASALLFMIKEELVKGARLLVTGNTSLVKKLPSKSSR

SEQ ID NO: 639 - protein, 626 aa, Zea mays
MAAPSPTTTAAAAAAATTHHRVLLPSARPRAAPSSLRLPLRAQPHAHAHAQRARLAAPVAAAAPAPAASTASPESPASGAVAGKPTVLVAEKLGAAGLALLREFANVDCSYGLSPEDLRAKISLCDALIVRSGTKVGRDVFEASGGRLRVVGRAGVGIDNVDLAAATEHGCLVVNAPTANTVAAAEHGIALLTAMARNIAQADASLKAGKWQRNKYVGVSLVGKTLAILGFGKVGSEVARRAKGLGMHVIAHDPYASADRARAIGVELVSMEEAMTTADFISLHMPLTPATDKMLNDEAFAKMKKGVRIINVARGGVIDEEALVRALDSGVVAQAALDVFTKEPPAADNKLVLHENVTVTPHLGASTVEAQEGVAIEIAEAVIGALKGELAASAVNAPMVPAEVLSELAPFVVLAEKLGRLAVQLVAGGGGIKSVKVTYASARAPDDLDTRLLRAMITKGLIEPISSVFVNLVNADFTAKQRGVRITEERILLDGSPETPIDYIQVQIANVESKFPSAISETGEITVEGRVKDGVPHLTKVGAFQVDVSLEGSLILCRQVDQPGMIGSVGSVLGEENVNVSFMSVGRIAPRKHAVMAIGVDEEPSKGTLTKIGEIPAIEEFVFLKL

SEQ ID NO: 640 - protein, 365 aa, Zea mays
MEGYDREFYQFSDQLRLQTAAFSGLSLGDSIWSPAGRRNNSNDVLFAASASPADAAAKSNAVVGLKLNDGGPGLIGSGKLAFGGGAGGGGTNKADRYNNNNLPNTDNKTVYNTSSSSFMGNGSSYAKNNNNNADMLAFDKMGSYGYNGGGNTNNNSNGVEVKSYFNKSAGRAASNNNNNNNSHAGGGNKKGGAGEYGRKKHAKSEGAAAATDKQRFKTLPASEALPRGQAIGGYIFVCNNDTMDENLRRELFGLPSRYRDSVRAIRPGLPLFLYNYSTHQLHGIFEAASFGGTNIDPTAWEDKKCPGESRFPAQVRVATRKIYDPLEEDAFRPILHHYDGPKFRLELSVTEALALLDIFADKDDA

SEQ ID NO: 641 - protein, 415 aa, Zea mays
MAASNGEGHGRFDVIVVGAGIMGSCAAYAASSRGARVLLLERFDLLHHRGSSHGESRTIRATYPQAHYPPMVRLSRRLWDEAQADAGYTVLTPTPHLDLGPRDDSALVASMRNGGATEVVAGDESSSWPWAGVFRVPDGWTAARSELGGVMKATKAVAMFQALAVKRGAVLRDRTEVVDITSSKRGEGEGSIISVRTSSGEEFHGTKCIVTVGAWTSKLIKSVTGLELPVQPVHTLICYWKVRPGREQELTPEAGFPTFASYGDPYIYSTPSMEFPGLIKIAMHGGPPCDPDGRDWSTGAGDLVEPVARWIDAVMPGHVDTTGGPVVRQCCMYSVTPDDDYVVDFLGGEFGKDVVIGAGFSGHGFKMGPAVGRILAEMALDGEASTAAEAGVDLRPLTIGRFAGNPKGNLSASQG

SEQ ID NO: 642 - protein, 193 aa, Zea mays
MATDEATKPSPIPPYPEMILAAIEGLDDKSGSNKSAISKYIEGKYGSLPPAHASLLTAHLARMKESGELVFLKNNYFRAGAPDAPPKRGRGRPPKARDPNAPAPAPKSPSSTGRGRGRPPKAKSPLEAAVKQATAGMPKPRGRPPKKAKTDGAASPSPSPAPAPAGDGSTPGKRGRGRPPKVRPAVPSETAAA

SEQ ID NO: 643 - protein, 217 aa, Zea mays
  Sequence also found in Organisms: Saccharum officinarum
MAGAGDKVDYVFKVVLIGDSAVGKSQILARFARNEFSLDSKATIGVEFQTRTLVIDHRSVKAQIWDTAGQERYRAVTSAYYRGALGALLVYDITRRQSFDHIPRWLDELRAHADKNIVIMLVGNKSDLEEQRAVSTEDAKEFAEKENLFFLETSALQATNVESAFQTVLTEIFKIHSKKNMVSEPKSNGAAPAMPGTKVLVPGPAQEIPKSKCCSSM

SEQ ID NO: 644 - protein, 528 aa, Zea mays
MATLPLLLHLLWEASPWARAGAATAAVVLVWLAAWTLEWAWWTPRRLDRALRAQGLKGTRYRLLTGDVRENARLNREARTKPLPLGSHDIIPRVLPMFHNAVKENGTNSFTWFGPIPRVIIPDPELMREVLSNKFGHFGKPLFSRVGKLLANGLANHEGEKWAKHRRILNPAFHHEKIKRMLPVFATCCADMINRWENSMSSKEPSEMDVWPEFQNLTGDVISRTAFGSNYQEGRNIFQLQGEQAERLIQSFQTIFIPGYWLLPTKNNRRMKEIDREIRKILHGIIRKRERAFIDSEGTNDDLLGLLVESNMRESNGNAKLGMTTEDIIEECKLFYFAGMETTSVLLTWTLILLSMHPEWQEQAREEVLNHFGMGTPDFDNLNRLKIVTMILYEVLRLYPPVVFLSRRTYKEMELGGIKYPSGVSLLLPIIFIHHDPNIWGKDASEFNPQRFEDGISNATKHQAAFFPFGWGPRICIGQNFALLEAKMALSTILQRFSFELSSSYTHAPYTVITLHPQHGAQIRLKKL

SEQ ID NO: 645 - protein, 788 aa, Zea mays
MTAQTKKRGATENGDGVGLGLAAFIANNEDVGPVVRHAFESGKPEALLHSLQNIVKNKEVEIEEICRLHYEEFILAVDELRGVLVDADELKGTLSDENLRLQEVASALLLKLDELFEIYSVNSNVGEALATLKICLQVTNLCKVCNRDITEAKLLSALKTLELIEKDYLQNIPLKLLKKVIHKQVPMVKLYIEKKVCSEFNEWLVYIRRTAKDIGQVAINQTSLTHKKDQGICARQREAEESSLVGFDVNAYTLDVEHMAEEAMLEFDLVPVYRAHHIHIGLGLGEKFREYYYNNRLMQLNLDLQISTSQPFVESYQPFIAQVAGFFIVEDRVFRTADGLLSESQVDTMLETAISKLTLILEEQFSRIHAANHLLLIKGYVSLFGATLKKYGYRSMSLAEILDKTRDKYLELLLSDCRKQLNEAFSRDSYERMVIKKQNEYDANIAAFQLDPIDGVSNLPYVAPFSSSVPNACRIVRSFIEELVSYLSLSGGVNVYDVVKSYLDKFLIETLNDGFLKLIHGGSLEFPQVVQIAGNIAVLEQSCDMFLWHAARLCGVPRCLLEKPHSGLSARAVLKASQNAAYNGSVTLVNSKIDEFMLQLTSINWTPDEAPEHANDYMNEVIIYLHEVVSSGQQAVPRDALFKVVSGALSHISDSMTTVLLSDRVKRFNANAVASIDVDLRALEGFADDTYRTAGFLDLRKGTSFRECLAEVRQLTNLLLSSQPESFANPATREQSYGALDHKKVAIICDKFKDAPDSLFGSLSGRGTVQSARKKSLDVLKRRLKDFS

SEQ ID NO: 646 - protein, 689 aa, Zea mays
MSSAVKDQLQQMSTTCDSLLLELNVIWDEVGEPDMARDRMLLELEQECLDVYKRKVDQANRCRAQLRQAIAEAEAELAGICSAMGEPPIHVRQSNQKLQGLREVLNAIVPYLEEMRKKKVERWDQFVDVIEQIKKVASEIRPADFVPFRIPVDQSDLSLRKLEELTKELQSLQKEKSDRLKQVMEHLNTLHSLCEVLGVDFKQTVNEVHPSLGEADGSKNLSNCTIESLASAASRLRELKVQRMQKLQDLASSMLELWNLMDTPLEEQQMFQNVTCNIAASEHEITEPNTLSIDFLSYVESEVLRLEQLKASKMKDLVLKKKTELEEHRRRAHLIGEEGYAAEFSDEAIEAGAVDPSLVLEQIEAHIATVKEEAFSRKDILEKVERWLNACEEEAWLEDYNKDDNRYNAGRGAHLTLKRAEKARILVNKIPGLVDVLTTKIVAWEAERGKEFTYDGVRLMSMLEEYMIVRQEKELQKKRQRDQKKIQDQLKAEQEALYGSKPSPSKPQSTKKAPRHSMGGANRRLSLGGATMQAPKTDILHSKTARAAKKAEDLGALSPSSRGLDIAGLPIKKLSFNASTLREAETPRKPFAQIMPGNNVSPMPTRPISSATEEENKTPRTFVGGLNAKTPATVTAPMQMAMTPAVANKVIATPATLFQEKADSPALPADIEYSFEERRLAVYLARQVA

SEQ ID NO: 647 - protein, 338 aa, Zea mays
MVAAPSKCRPSAAALVVAPPGAPRRQLRCRCCEDTLGVPRRRLQPQLHLKQQAPAATTAPAAAPPPRPRRIVLVRHGESEGNVDEAAYTRVPDPRIGLTAKGWREADDCGRRLRDLFSSGSRDQDDWKVYFYASPYRRSLETLRGIGHAFEPHRIAGVREEPRLREQDFGNFQDREQMRVEKEIRQRYGRFFYRFPNGESAADVYDRITGFRETLLSDIVLGRFQPPGHRSTSGDMNIVLVSHGLTLRVFLMRWYKWTVRQFEGLENLANGGELVMQTGEGGRYSLLVHHTPDELRAFGLTDEMLQDQMWQKTARPGELNHRFMTNGQSFFDPFTVIY

SEQ ID NO: 648 - protein, 91 aa, Zea mays
MRTAVHAALCIVLVIMSSTLSSCEDDEKVSIACDTGCNAAISRLKCFLMAYSEGKVLVSSNCETPTRCGCVFRHKQDATLIAGDVGNKKGY

SEQ ID NO: 649 - protein, 404 aa, Zea mays
MPAADPPVTDAVPDEDAAPRPSPPPPPPRPRPLSLASALPFWFYFAAAVSLLALLLPHLLPPSSPAPLPPLLLGHLAAGRFLKLDPAPGLFAVTSRPTAAAGDSPAHRVLVLPGLAAGSLSFRRVLSSLSSRGVHAAALDLPGQGLSPASPAATAPARTSALREIMNRGVFHAFEHLVQTGEVPYQEEEPAASAARSPHAPDEAAAAVARAAEALGVGPVHLVLHDSALAAGAAFASANPGAVRSVTLVDATASLPAFPAAVFDVPVLGRLVLRVPALFRGLVRLCCVRGVGAEEAEAYRAAMRGEGKAEAVVEAWKSMNHSFQLGEWRVSSEEVRRLPMLVLWSGSWSDMWIDEGKKVAAALPDAKFIYHSGGRWPQVDAFEEISGVITEFVTSAEEAGSSRW

SEQ ID NO: 650 - protein, 506 aa, Zea mays
MRGGTLQINWHDQQPVLSLDFHPVSRRLATAGADHDVKIWEVASDGKLPTATFKTGLVPNTTAHSSAVNVLRFSPSGEYLASGADGGGITLWKLHPADDGEAWKIHKTLLFHHKDVLDLQWSHDSTFLVSASVDNTCIIWEASKGTVQQKLEGHLHYVQGVAWDPLGQYIASLSSDRTCKIYAKKPQGKSKNAERLNFVCQHTLVKVEYQNHDESKPPTKSHLFHDETLPSFFRRLAWSPDGSFLVLPAGLSKHSSEVINTAYVMSRRDLSRPSIQLPGASKAIVAVRFCPVLFKPRGSNSDGFFKLPYRVVFAVATLNSLYVYDTESVPPILVHAGLHYAAITDIAWSSDAKYLAVSSRDGYCTIIEFENEELGQPHILPGSKEVANGNLTPETKKPVCADSMKVDNSANKLKMEASPVAVGVRAPLLPTENIKRTGELAEGNVTCENKEPVTIDSMEVDADDTKGKEATIPVAAEVTPPPAVPAAKNSASSKPAKRRITPIAID

SEQ ID NO: 651 - protein, 263 aa, Zea mays
MDEEGQRTPQPMVVARKRRQATPDHPPYCWMIGEATDALAEDGGSEEDSISAFIRARHPGVPPAHDRLLRHYLGKHVAEGFFVRTATGRFERSPQENADEEELPVEQADQAGSCKPASVGSSVVLVEAKPKRGRGRPRKDGSPSTLAVAAMSSVAVAGKDEIHAPSLKPKRRGRPRRQAGADHRDKEHEPPRELALVILGDSSAAPIMDKPCTTLVPPTTPPVDGGQPIDLALATTTEVPVPEPAATPAMDKDGADADASSIE

SEQ ID NO: 652 - protein, 890 aa, Zea mays
ALLRKHKSSTVHTSTELEPRKKLEEARERKPTHENSVNKRSRERTYPSSEMDSNLFRIKEVTSSVNKQGIEVNGSTNNPTNGGYEMVKTSTGTKDDIFGDLPLLELESSKIMFRTGVHELPTVIEESFITNQTEADSIPEAVPLRLIDASDITAHTPSPLEDLVKSEDNEPACISHSDVEGSYPSTVGIDGVPNHKNINMVKPGLGDMQLKLAEVCALGSHSVLRSKYGSGNPLQGCFDVNKNCSQEIKKHGSNSTSSPPTMRTRTEETKYKDAPVKCKSTDITDTVAALPAPANHSYQASVLPSAVSRTVFSTSVDSNDVSSFRSLPAKECIPITRSGNFRTNMCNGSKKHVDPCAALSTDNQGTSHSKLDPIFSPANIGMAFMKLPGLQRMEILNYNAKIGENRFSNAESMNTVRYQKQQLLSGMTYVMQGQKQIGLGSSQVKRPALDDYGGQGDHHLQQPTVRLMGKTVSVCSHSKDHNVSTMDKVSPNNVAIEASRLSTISCQLPPKRSFPCQNSVTQRVHLNNSSDFLARIPNNSVPGQNTTLHELHDQRPQPTNSSATVKGCTWNFGNQFVCQAELDKAAMVSANSQTRHLELHQPPHLISIPQNQQSHLWTPAAHTRKDQCFVGPAVNQSSPVPKSLLNASMKEKYQNSTLLSYNDPSSMPIRQPYQIPGAKSSSASVISFFEYGADNSLSRSSSPGLSLSLTTGLANESVSTSRAACAGSLTNADGRKAASFVEPIRSAYADNVSQPPAKPISNRTVYAADNVSQQPAKRQLVTGRKDFMSMGPNIVNHSPGWSLSDAVGPQVLDFSKRMGRDAAQMSKNESDNPRASSGSVPPIETWSRPGVVAGANTNTMLNPGQNLNDHSKLLYSTKFSVDSGINSVIL

SEQ ID NO: 653 - protein, 131 aa, Zea mays
MASIAGSSALSFARPVKAINTNSLAFSPARKGNTFLRLQPMPMRSVSCAAKKDTTDKVCEIVKKQLALPDHTEVCGESKFSELGADSLDTVEIVMSLEEHFDISVEESSAQTIATVEDAADLIDKLVAGKA

SEQ ID NO: 654 - protein, 873 aa, Zea mays
MVTEMAARGGEAAAFGAETDRGDFEVFRSGSAPPTVEGALGAAGADGGLLVDDDLRADPAYQSYYYSSAHLNPRLPPPLLSKEDWRSSHHRLRSAGFGGIGDGRRQQQQASAAEGTVGLPGIDLGRQRSFSTIFQEDSYQRDMDRHTASHNSNDLLGSSGIQYGLNRGSGTIGGLHSSNSLRSLDEIQNNDLPSNTFASILGSSLSRSASPDPELVRRAPSPSLPPIGVKVGNTDKKINGGSTSFRRSSSAIGESDDLVAALSGMNLSSRAMSGQTMDQSQLYQDVDNVQKFLFDRQGDQTTGNQQHYMRRPEQGQSKLPDGYSANLANSSTMRNQINAGSFTSFDSLSLGSGFASPRIGSRSPGGTVSSRQNLAGMSNMLNYNGIGSPTASPSLQTSIDPAYIQYLAQLAATCDDPLMDRGHLGNSYMDLLGTHKANIGPLLQSQKQYGYYGNLGFNLGYPGSPLASPVLPSSPIAPGSPLRHGERNMRFPSGMRNFGNSFGSWNSGMGGKMDANLMPSLLEEFKSNKSKSYELSEIAGHVVEFSADQYGSRFIQQKLETASTEEKDMVFSEIMPQALTLMTDVFGNYVVQKFFEHGSTAQIKELAGQLIGRVLALSLQMYGCRVIQKAIEVVDLELQTKMVAELEGHVMRCVRDQNGNHVIQKCIECIPQHAIEFIVSTFYGQVVMLSTHPYGCRVIQRVLEHCDDPKTQQIMMDEILQSVCLLAQDQYGNYVVQHVLEHGKPHERSAIIEKLIGQIVQMSQQKFASNVIEKCLVFGNPVERQVLIGEMLGSTSESEPLEVMMKDQFGNYVVQKVLETCDDQQREMILTRIKTHLNTLKKYTYGKHIVARVEKLVAAGEKRLGLQPACTAA

SEQ ID NO: 655 - protein, 374 aa, Zea mays
MARLVSSGIIGKGHNIFDDGGFGEVHADPIKVERPHKRPPQKQNAENGTTTKVDEPKELPKHVCFKGDNGLYLSARMVEGYPYLQFASDDIGDPSVRFTTYNYMIDGKRVIRVKSDHFGKFWRRSPNWIWCDTDDTSTDNRDTLFEVVRVGDDADAVYGLRNLGNNHICHRLTYEGKESCLNASIPSVRKEAQLKIEEAVLLRKIYGVDYHLKDAKILNNKVRTLVTREAVNAGSMPSKNTLTLKYVVSNGKIWDASRSLRLGIKSSFQAGVPEVVTGSITLESEFDTSYIWGENTVNTEEFSTDYEVIVPPHTVITVRILATQGTCQVPFSYTQEDILTTGEKKVTKYDDGIFRGVNSFGFKSEVTERKINGE

SEQ ID NO: 656 - protein, 542 aa, Zea mays
MAAQLHHALYELLHEAAAAQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVVSSPRVAEAVLRTYDHVFSSRPRSLVSDIIMYGATDSCFAPYGDHFRKARKLVTVHLLNASKVRSQRPAREEEVRGALDRVRRAAAAREALDMSELLHSFVNNLVCRAVSGKFSMEEGRNRLFRELTDINAGLLGGFHIQDYFPSLGRIELVRKVACAKTRRVRKRWDDLLDKLIDDHAARMATHQDEDDDKDFIYVLLSLQKEYGLTRDHIKAILIDMFEAGTDTSYMTLEFAMTELIRKPHLMKKLQEEVRRNVPAGQEMVTEDNLPGMTYLKAVIKETLRLHPPVPLLLPHYSLDACEVAGYTIPANTRVVVNAWALGRHSGYWERENEFVPERFLSGDVAGGVDLKPNEFQFLAFGSGRRMCPGVHSASATIEAMLSNLMYRFDWQLPAGMKAEDVDMTEVFGITVSRKEKLLLVPQAA

SEQ ID NO: 657 - protein, 244 aa, Medicago truncatula
MATSENAVESKSSLTKLAPIEAVLFDIDGTLCDSDPIHYYAFREMLQEIGFNGGNPITEEFFIATVAGKHNDDIALDLFPGDRERGLKFVEDKEAMFRRLAAEQLKPLNGLDKVRKWIEDRGLKRAAVTNAPRPNAELILSKLGLSDFFHAVIIGDECEHAKPHPEPYLKGLEALKASKDHTFIFEDSVSGIKAGVAAGMPVIGISTRNPEDLLMGAKPAFLIKDYDDPKLWAALEELDKSGSH

SEQ ID NO: 658 - protein, 665 aa, Medicago truncatula
MQMELATMRMRKSLIYWICFLVIGFVQISKSNGFYLPGSYMHTYANGDPIYAKVNSLTSIETELPFGYYSLPYCQPLGGIKKSAENLGELLMGDQIDNSPYLFKMNVNQSSYLCTTAPLNEHEVKLFKQRTRDLYQVNMILDNLPVMRFANQNGVKIQWTGFPIGYTPTDGSADYVINHLKFTVLVHEYEGNDVEIIGTGEEGMGVIAETDKKKESGFEIVGFHVVPCSVKRDPEVMTKLHMYDNISSINCPNELDKYQPIREQERISFTYEVEFVKSDIRWPSRWDAYLKMEGSRVHWFSILNSLMVIFFLAGIVFVIFLRTVRRDLARYEELDKETQAQMNEELSGWKLVVGDVFREPGCSKLLCVMVGDGVQILGMAGVTIVFAALGFMSPASRGMLLTGMIILYLFLGIASGYVSVRLWRTIKGTSEGWRSISWFAACFFPGIAFTILTALNFVLWGSNSTGALPISLYFKLFFLWFCISVPLTLIGGFLGTKAEQIEFPVRTNQIPREIPARKYPSWLLVLGAGTLPFGTLFIELFFILSSIWLGRFYYVFGFLLVVLLLLTIVCAEVSVVLTYMHLCVEDWRWWWKAFYASGSVALYVFLYSINYLVFDLQSLSGPVSAILYIGYSLLMAIAIMLSTGTIGFLVSFYFVHYLFSSVKID

SEQ ID NO: 659 - protein, 747 aa, Medicago truncatula
MAVEEGTGGGGTTIIDEIYEFCAPRFFDFLKGESDDDVRRAELWFHTALSYAPSPFMPKIKAGRSITVDTLCDFSEADNMPKVEDSVLESNTRPQSITSKVKEDDRAKEEKVTIVPHMNSTTKKEDAPCCEAEENSSTSLEDGVGKKMSKGEILNTATSTRGASVEVGKDACTPKPALRKSVNATSTNSKKQQNSKKVSTNTKTRLQSGASKSAAGTLHFTQENQAIKRQKLEGGKTRQILNLKPQTLPHDKSKLGYSSSTSKTQKEDRKVYVRDTPKTPAAPFKSMAEMMKKFESSTRDLPLPNTLSHTKPKLTLTKPKSPEFETNQRVRPARVKSAAELEEEMMAKMPKFKARTLNKKILQTSTLPPMPRSTPQPPEFKEFHLETLARAHQNTDSASKASSEVSHKENSSKPHLTEPKPPLLQTSLRARPPTVKSSLEIEQEELEKIPKFKARPLNKKIFESKGDIGLFCHMKKHVTEPQEFHFATSERFPPPTAVADLFDKLSLKSEPARNTIPRTTTPNPFHLHTEERGAEKEKKLYMELLQKELEEEATRVPKANPYPYTTDYPVIPPKPEPKQCTKPEPFQLESLVRHEEEMQREQEERLRMERQEAQMRKFKAQPVLKEDPIPVPEKVRKPLTQVQEFDLHLNHRAVDRAQFDQKIKEKEVVYKRYREESEAARMIEEEKALKQMRRTMVPHARPVPNFNNPFCPQKTSKTTKPKSPNLRVLQRRRFNGSTTSSPATSMR

SEQ ID NO: 660 - protein, 325 aa, Arachis hypogaea
MGVKGFVEGGIASIVAGCSTHPLDLIKVRMQLQGESNPTSVPSLRPALAFQTGSRSIHVSPPPQITQPPRVGLVTVGVKLVQQEGLAALFSGVSATVLRQTLYSTTRMGLYDLLKQKWSVPSPVPGGATTMPLSRKIEAGLIAGGVGAAVGNPADVAMVRMQADGRLPPAQRRNYKSVVDAITKMAKQEGVASLWRGSSLTVNRAMLVTASQLASYDQFKEAILEKGLMRDGLGTHVTASFAAGFVAAVASNPVDVIKTRVMNMRVEPGAEPPYTGALDCALKTVRAEGPMALYKGFIPTISRQGPFTVVLFVTLEQVRKLFKDF

SEQ ID NO: 661 - protein, 521 aa, Arachis hypogaea
MLTRISHRKLWTSARRVLRPSLCRTSSAPLPSPLSHSHTFSSSAFALRSTTYAYFDFDFLHWKRHCFSTQPALELPAGKIVDVPLAQTGEGIAECELLKWHVQEGDYIEDFQPLCEVQSDKATIEITSRYKGKVAHVLHVPGDIVKVGETLLKILVDETAFPSATVGDSEITKSLHSDQVLVNESASAIAALGNSNNAELLDSDLEKRKRAAVLSTPAVRSLAKQHGIDINEVCGTGKDGRVLKEDVLNFAAKKGIIVSVSAVLDADNVEKPRGAEGYTVTPEYKSPSEDRILPLRGYQRAMVKSMSLAAKVPHFHYVDEINCNALVELKTAFQKNNPYPDVKHTFLPILVKSLSMALTKYPALNSCFKEDSMEVILKGSHNIGVAMATPNGLVVPNIKNVQSLSILEITKELARLQQLASENKLTSDDISGGTITLSNIGAIGGKFGSPLLNLPEVSIIAIGRIQKIPQFDGNGNVYPVSLMTVNVGADHRVLDGATVSRFCNEWKQLIENPELLMLHLK

SEQ ID NO: 662 - protein, 725 aa, Physcomitrella patens
MCACLLPPRIASLSLCSWAFCCCYCCWVVELARIMVRGGGESAMVSSSPNRDGFVKQIRGGGGAMDLKVRVGVLLVSFLVMLFPPVQAFYLPGTYLHPYKKGDKLEVKVNSLTSIETELPYSYYSLPFCKPPEGIQKMAENIGEMLMGDQIENSPYKFQMKVDQKDLLACVAPPLTENDVKHFNQRIDDLYQVHLILDNLPVTRLTTAAKEPNSQLRWTWSPIGFKFDDKPEHFIYNHLEFKVLVHPYDKDSASGAVLGTGEGLDTMPAATMQNLTGTYMVVGFEVAPCSVVRDAKAAKELKYQGLLPASDCDPNKPHQVIKVGEEIVYSYDVVFEESNIRWPSRWDAYLKMEGARVHWFSILNSLMVISFLAGIVFVIFLRTVRRDLTKYEDLDKEAQAQMNEELSGWKLVVGDVFRAPENPQLLCVVVGDGVQILGMAVVTILFAAMGFMSPASRGMLLTGMVLLYMFLGIIAGYVASRMWCTLKGVRDGWRPIAWKTACFFPGIAFTIMTVLNFLLWSRDSTGAIPISLYFVLLLLWFTISVPLTLLGGYLGAKAEPISFPVRTNQIPREIPPQRYPSWLLVLGAGTLPFGTLFIELFFIMSSIWMGRVYYVFGFLFVVLILLVIVCAEVSVVLTYMHLCVEDHKWWWKSFFASGSVSLYVFLYSINYLVFDLHSLAGPVSAALYLGYSLLMVITIMFATGTVGFLTSFYFVHFLFSSVKID

SEQ ID NO: 663 - protein, 714 aa, Pinus taeda
MERQQQQRQELRAEEITKYAHSPVHCAVAGRDYPALRRILSTLPRLPKAGEVTTEEESILAEQRADIVSGCIDRRDVPGRETALHVAVRLGDCTAVEMLMAAGADWSLQNEQGWNALQEAVCAREDAIAMTITRYYQPLAWAKWCRRVPRIIATAGRMRDFYMEITFHFESSVIPFIGRIAPSDTYRIWKRGSNLRADMTLAGFDGFRIQRSDQSFLFLGEGTEDPRLSAGSLIVLTHKEKEISNALEGAGSPPSDAEVAQEVALMAQTNLYRPGIDVTQAELVPHLNWRRQDRTEMVGPWKAKIYDMLHVMLSVKSRRVPGAMTDEELFAAENDKFADEPVGYEEMLTKEEKEQLDQALNMGNSEAIEDEGAIFSGPVDRDECHQNGGLSGSAGDPDASESSEASEANCDKDKRGWFGWSKKMTKTDGLKRTSLSSQINKLDKQLEKPLPECNGSGTLVNEDSTRILRKFPKLAPESSQKSVDHQPSEFQKDDAVGSRKGKEKANKSINKKDSSKKKRSSGTNDIKQESEYKKGLRPVLWLTPDFPLKIEEFLPLLDILASKVKAVRRLRELLTTKLPPGTFPVKVAIPLVPTIRVVITFTKFEELQPVEEFSTPLSSPGHFQDAKGKETQASNSSVSWMSWVRGSHSRTSSEPTNLEDHLRDDLDPFYIPSNYTWVDMNEKKRRMKARKSKNRKGKAHSSRLADGSLTDIDE

SEQ ID NO: 664 - protein, 106 aa, Plantago ovata
MAIRKSNKMMSQKAMIKHIMKRCSSLGKRQGYDDEEQGLPLDVPKGHFVVYVGARRTRYIVPISILNLPEFQNLLRRAEEEFGFDHDMGLTLPCDEEVFESLTSQL

SEQ ID NO: 665 - protein, 249 aa, Populus trichocarpa
MARYDRAITVFSPDGHLFQVEYALEAVRKGNAAVGVRGTDIVVLGVEKKSTAKLQDSRSVKKIVSLDDHVALVCAGLKADARVLINKARIECQSYRLTVEDPVTVEYITRYIAGLQQKYTQSGGVRPFGLSTLIVGFDPHLGVPALYQTDPSGAFSAWKANATGRNSNSMREFLEKNFKETSGQETVKLAIRALLEVVESGGKNIEIAVMTKDQGLRQLEEAEIDAIVAEIEAEKAAAEAAKKGPPKDS

SEQ ID NO: 666 - protein, 359 aa, Solanum tuberosum
MSCSSSLILPSISSNGFRRFSPLKLDKSRVFMSSISVGSRIAAVDDALFTDYKPTNAFLFPGQGAQAVGMGAEAQKVPAAAELYKRANEIMGFDLLDICINGPKEKLDSTVLSQPAIYVTSLAAVEILRAREGGQQIIDSVDVTCGLSLGEYTALAFTGAFSFEDGLKLVKLRGEAMQDAADAAKSAMVSIIGLDSDKVQKLCDAANEEVDEANKVQIANFLCPGNYAVSGGVKGIEAVEAKAKSFKARMTVRLAVAGAFHTSFMNPAVSRLEAALGATEIRTPRIPVISNVDAQPHADPDTIKKILASQVTSPVQWETTMKTLLSKGLKKSYELGPGKVIAGIVKRMDRGAEIENIGA

SEQ ID NO: 667 - protein, 451 aa, Solanum tuberosum
MSQSLNPNPTYDVIILGASGFTGKYVIREALKFLNVPSSPLKNLAIAGRNTSKLSQALQWASRPNPPPEIPILTANTTDPSSLRDLASQTKIILNCVGPFRLYGEPVVEACADSGCDYLDISGEPEFMERMEVKYHDKAVENGSLVVSACGFDSIPAELGLMFNSRQWLPPAVPNSVEAYLSLESDKRIVGNLGTYESAVLGVANVDKLQELRRSRPRKPRPVIPGPRPPKGPLMNHLKEVGVWAIKLPSADAIVVRRTLSCLAENPHGLPGVNESTEQVERREAFWSSIKPAHFGVKIASKSPLGVVRFIIVGLFIGLFGKTGLGRWLLLKFPSLFSLGWFRKKGPTEDEVASATFKMWFVGHGFSDGSLASQGNRKPDTEIITRVMGPEIGYLTTPIILVQCALILLKERNNLPKGGVFPPGIVFGPTDLQNRLQHNGISFDVISKKTI

SEQ ID NO: 668 - protein, 367 aa, Solanum tuberosum
MVLKVSVFLLFSFLFTASAVRPAPPLEGLLPNGNFEELPKPKDLKKKTVLQGKYALPKWEINGLVEYISGGPQPGGMYFAVAHGVHAVRLGNEASISQTIPVKKGSLYALTFGASRTCAQEEVLRVSVPPQTGDLPLQTLYSSNGGDTYAWGFYATSNVVKITFHNPGVQEDPACGPLLDAVAIKELFPPRPTRVNLVKNAGFEEGPHLLINSSHGVLLPPKQEDLTSPLPGWIIESLKAVKFLDSAHFNVPFGQAAVELLAGRESALAQIIRTVPKKVYAFTFTVGDAKNGCHGDMMVEAFAAKETFKVPFKSQGKGSFKTVSFKFTAIADRTRITFYSSFYHTKINDYGALCGPVVDEVKVTPVA

SEQ ID NO: 669 - protein, 329 aa, Oryza sativa
MAASVPNGHSVAGEGGTPAPPPSSSSLVFLGTGCSSAVPNARCLIQPPDPPCAVCSQSLSVPPELNPNYRCNTSLLIDYCQDEVTHKYILIDVGKTFREQVLRWFIHHKIPCVDSIILTHEHADAILGLDDVRIVQPFSPTNDIEPTPIYLSQFAMNSIAQKFPYLVRKKLKEGEEVRRVAQLDWRVIESDLQKPFVTSGLEFVPLPVIHGEDYVCLGFLFGRKSKVAYISDVSRFPPSTEHAISKSGEGQLDLLILDCLYRTGSHNVHLCWDQTLDAVKRICPKRALLIGMTHEMDHHKDNETLEEWSRREGIDVQLARDGLRVYIDL

SEQ ID NO: 670 - protein, 792 aa, Oryza sativa
MAPDANPEAAAPPPQLLVDEGYEFCAPKFFDFVCDETEEEIRAAERWFEASASHAPSPFAPRIKESRAEVKIESLCDFTDAEPIPKEVAVEEAAGSAANPSQNSDGNVQQNKDGSIKLVHEANPSENCVTDGDHKHQESDAMLESPPAEEDEKESPKSFEFVPSNAKSADVASSTPKIQRPPPVKAVTTVPTCPKLTVKTEAFTPKVQATNSSRGLAPLTGSRAHPSALKQSMSVKRSVIKCPRELLAGKAATAANEIAQENQAVKRQKLDDGRTRQILNVKTRTLPHKGRGGGLAGSTEMSLSAMRKHRDDSRSLKEVTHYISAAEMVKKFESGTRELAIPHNRSLSHEDAATALQRRTKLMLTRPKEPEFQTSHRVRAVRVKSSAELEEEMLAKIPKFRARPFNKKIAEAPSFPPLPRKAPQLPEFNEFHLKTMERATRHADTCSEASSVGTIRSQSSKPLTLTAPKPPQLETALRARPPRVKSSQELELEELEKAPKFKAKPLNKKILESKGDIGVFPHLKAQPTAPKEFHFSTDDRLGPPAVVDLFDKLSLCSESSYHSKKDVPRLTIPNPFNLHTDERGHEKERQLAAQLLQKQLQEEKARIPKANPYPYTTDYPVIPPKPEPKPCTRPEGFQLESLVRHEMEQQRIMEERERMEREEAQRRVVKAHPIMKEDPIPLPEKERKPLTEVQPLKLHVDERAVQRSEFDNMVKEKEITYKRLREENEFAQKIEEEKALKQLRRTLVPQARPLPKFDRPFRPQRSTKQVTRPKSPQLQVDQRGARRHAFIR

SEQ ID NO: 671 - protein, 322 aa, Oryza sativa
MVSMEVTDEMFKCMEVGLAFRDYNGRISSMDFHSKATNYLVTACDDESIRLYDIQNAVCLKTINSKKYGVELVCFTENPTYVLHSSKNGWDDSLRLLSLVNNCFLRYFKGHLDRVVSISLCSENGNILSGSLDRTVLLWDSRVEKAQGLLRVQGRPAVSYDDQGLVFAIAYGGYIRMFDARNFEKGPFDIFSVGNDDSEANVIKFSSDGRRLLLTTKAGRVHVLDSFHGNNIATYNVKPVVSNSTLEASFSPDGNHIISGSGDGSVYAWNVRSGKVARWGSTDSEPPLIRWAPGSLMFLTASSELSCWVPDLSKLGSFTVSK

SEQ ID NO: 672 - protein, 405 aa, Oryza sativa
MRSMPFQLKNGHHHHGAMEGKPPVTPMQQQQQHAPPPRVSRFRRLLVRVSASERLAGDGKERGEKEAEKVSASAAGGEVEAGSVGLDRMVLSFMEDSAAVERPQRGRCNCFNGSNYEESDDEEGFFLPSDHSSASAPAAAGDALESLKGLVQSASVAERNLLADASRIAERCCKGSKGKAECRRAVADGLRALGYDAAVCRSRWEKTSSYPAGEHEYIDAVVGEEVRLIVEVDFRSEFEVARSTKAYRAALQALPPLFVGTPDRLGQIVAVVAEAARQSLKKKGLHFPPWRKPEYMRAKWLSPHVRSGDKAAAAAKTVTSTTSATATPVSAASFSGAFELLFDRKQSGEIPAAEKITVVVSPSPWRPTEEASKKKPPPSPSPPQLWQQHQQPPKAKVVTGLAAVL

SEQ ID NO: 673 - protein, 286 aa, Oryza sativa
MKAAASPLRAALLLFLSSSPSPRLALPMNPSSSSSSRGAASYHSKAAAFASPQPRGGGGGRGGRRGGGRGRGGDGSDRIDALGRLLTRILRHMASELNLEMRTDGYVRVRDLLKLNLQTFAKIPLKSHTVDEIKEAVRRDNKQRFGLLEEDGELLIRANQGHTVTTVTSESLLKPILSADEVSVCVHGTYRKNLDSILHQGLKRMARLHVHFSSGLPTDGGVISGMRQSVNILIYLDVSMALQDGMKLYISDNKVILTEGFDGVVPVKYFEKIETWPGRAPIPFEK

SEQ ID NO: 674 - protein, 170 aa, Oryza sativa
MATLARVSLPSVLLTLRHGATTQGFAAARPAAVVAKRLLGSVRCGGAAEALGADMAVPRSVPVRVAHELQQAGHRYLDVRTEGEFAGGHPVGAVNIPYMYKTGSGLTKNTHFLEKVSTTFGKEDEIIVGCQSGKRSLMAASELCSAGFTAVTDIAGGFSAWKENELPTNK

SEQ ID NO: 675 - protein, 562 aa, Oryza sativa
MSVALYARGGGCGAKAAAARRSGRGGGGRRRAAVVLLLALAYVAGLLVFVLAGGGGVGVGGRVEVGREVGVMTVASLRRRRAAAAAAPQPGSVYRSHLVFERLWPDIRDDASSASAAASSLSSTSWRRSMLMTSHYQNPGELWMPCVNRKLIRPELPPSNGYLMIEANGGLNQQRLSICDAVAVASLLNATLVIPAFHFNSVWRDHSKFGDIFDEDHFIETLKQHVRVVKELPVDVLTRFDHNISSIPNMRTKAYSSPNHYMQKVLPELLELGAVRIAPFSNRLAQSVPSNLQALRCFVNYQALRFAGPIRVLAEDMVERMVKRSTLTGGKFVSVHLRFEEDMVAFSCCTYDGGLKEKTEMENARERSWRGKFHRHGRVINPEANRRDGKCPLTPLEVGMMLRGMGFDNTTSLYVASGKIYNAEKYMAPLRQMFPLLATKDTLALPEELAEFEGHSSRLAALDYSVCLPSEVFVTTQGGNFPHFLMGHRRYLFGGNAKTIKPDKRKLVLSFDDPNIRWNRFKRHMQDILHHSDMRGTALRKPNDSIYTFPMPECMCQQDGMM

SEQ ID NO: 676 - protein, 664 aa, Oryza sativa
MESVAAAARSLRAGVEKSRALGQALARAGPRVEEIQLALPALEAAVRPIRAPRAELAAAGPHIDRAVGPAAAVLKVFDAVHGLEPPLLAAGAVAGDLAGYLAVLGRLEEALRFLSDNSGLAAQWLADIVEYLGDHDLADPRFLADLAVTLEGLKKPSGDLDGGLLAAALDMLEAEFRRLLADHSAPLPLAMQQLNTTSASTAAPSLIPAATVHKLSLILDRLIANGRQDRCLSVYADARGGVVSASLRALGLDYLRNPVDVAQALGPGVELWGRHLEFVVRCLLESERQLCNKVFGQRKDDASACFADVAAHAGILDFLSFGRAAADAKKDPIKLLRLLEVFDSLNKLRLDFNRLFGGKKACVEIQNQTRDLVKLLVDGAVEIFEELLVQVELQRHMPPPPDGGVPRLVSFVVEYCNRLLSEKYRPVLAQVLTIHRSWRKETFSDKMLVNAVLNIVKALEANFDVWSKAYDNVTLSYLFMMNTHWHFFKNLKATRLGELLGDAWLQEHEQFKDYYLTVFMRDSWGVVSPLLNREGLILFSKGRATAKDLVKQRLKTFNASFDEMFRKQSAWVIPEKDLREKTCGLVVQAIVPAYRSYMQNYGPLVEQDVSASKYVKYTVDGLEKMLSALFIPRPRRAGSFQIRHTNDKITSAMTGFYRSASTVK

SEQ ID NO: 677 - protein, 809 aa, Oryza sativa
MATLPDLGVSAFINILGAFVFLLIFAALRLQPINDRVYFPKLYLTGQRRHHPHPHGFVNLDLCSYLRFLAWVPGALRMSQPDLIHHAGLDSAVYLRIYTLGLKIFLPIMTVALLVLIPVNVSGGTLLNLRKEIVFSDIDKLSISNVNPGSNRFFIHLLMAYVFTFWTCFMLYKEYSNVAFMRLHFLASQKRCADQFTVIVRNIPHVSSHSTSETVDEFFRRNHPDHYLGQQAVYNANRYAKLVKKKERLQNWLDYYQLKFERHPGKRPIGRTGCLGFCGREVDQIDYYRARISELDKKLASERQRVLNDPKAVMPVAFVTFDSRWGAAVCAQTQQSKNPTQWLTDWAPEPRDVYWQNLAIPFFSLSIRKFLISIAVFALVFFYMIPIAFVQSLANLEGIEKVAPFLRPVIDTPVVKSFLQGFLPGLALKIFLYILPTVLMIMSKVEGYVSLSSLERRAASKYYYFMLVNVFLGSIIAGTAFEQLNAFFHQPPSQIPRTIGVAIPMKATFFMTYIMVDGWAGIANEILRVKPLVIYHLKNMFIVKTERDRERAMDPGSIGLAENLPSLQLYFLLGLVYAVVTPILLPFIIIFFAFAFLVYRHQIINVYNQEYESAAAFWPQVHSRIIASLLISHVTLFGLMSTMKAAYSTPLLIFLPLLTIWFHKYCKSRFEPAFRKYPLEEAMEKDNLERTSEPNLNLKSYLQNAYLHPIFHMFEQQQQEQEQQREEKVEVRIDKAQQHHHRQVEEEEEESKSSQATTHYYHHHHEQTTTTTHHHYHQHEHMSHYHMGPSDTADSPSPPHFVYHYGVDP

SEQ ID NO: 678 - protein, 690 aa, Oryza sativa
MVVVHGQRAEDSFGGFFSFDEDAASEDMSLDGLDEELEEHKDYDVLISILANGEKQRDMATLVEGNLGHAEQDLIQDYVEDSDNLVLLHDQIHDCDIILSQIGSLLTGFQVHIGSINSELRSLQERSLDISVRLKNRKLVETKLAKFVEEIVAPPSLVTVIIDGEINDGYAKSLEILSKKLRFSQVDPMINASNSLKDIKPELERLLQKALCKVSDYLTELFFSMRKPGTNIQILQQNMVQKYRYLILFLREHGSKVYTDVRATYADTMNKVLSAHFQVYIEALEKLKLDIGVSSDLTGYDTNIIDLISRGREHLRNHRFMFSLGERASILKEIDRPGLVPHISEVNPVKYPYEVIFRSIQKLLMDTASSEYLFIKAFFGEESLFYQVFQGPFKVINGHLDHTLRNYHDAVCLMLMICITRKHQLVMLNRRLPCLDAYLDKVLIYLWPRFKTVFDMYLQSLYRCDTKLLWVDGSHPHHIVRCYVEFTASLIQLNAECGDGQLDMNLERLRLAVDNLLGRLAENFANPKTQHLFLLNNYDMTISVLKEAGDEANKLQSYFEEKLESNMISFADELLMEHFKDLIKFVRSRVSEDLILYTECPSIADVEPIVKNFAVTWKTALELMHNEVVTSCSNLLAGMEILKAAMVQLLNDYNRLSECVKIIPGGSTLNRNLVSITSISYEMRKYSITL

SEQ ID NO: 679 - protein, 344 aa, Sorghum bicolor
MALGGLASRYSLTDPPGTGTGTGTAPRPRSSRQEPMATIAPRSHLLLLGLTRPQQPTALRACAAFSRSRGAPVPPRAAQPRRVFLGLGATFIDQVTRMASGGTSSRSFVAGARPRQGVSPVEQILKNVEWPDEFPFKPEDFSRFDESSDTLFYSVPRFVTHIDDQAIRALTEYYSEVLPPINTPGATILDMCSSWVSHYPPGYKQEKIVGMGMNEDELKKNSVLTEYVVQDLNVNPKLPFEDNTFDVITNVVSVDYLTKPIDVFKEMRRILKPSGLAIMSFSNRCFWTKAISIWTSTGDVDHAWIVGAYFHYAGGFEPPQAVDISPNPGRTDPMYAVCSRKKIG

SEQ ID NO: 680 - protein, 935 aa, Sorghum bicolor
MTIPSAEGFLQASSCLPCTAAEEREVVDALTREAEKNVKHGDLRYLVSQSWWMEWQGYVGIFSHGENGTEQFPQAMNRPGEIDNSKLVSAERINGSEEPELQRTLREGEHYTLVPQEVWQRLYEWYKGGPEIPRKVIFDNPIDKTYIVDVYPLCLKLIDGRDSCQKVFRISRKAKVHELYSMVCSLMSVEQSEIVIWDYYQRSKGKKLLNQNETLEEAQLTMDQEILLEMKLGESSSGFSTRSTNDELALIPLEPSTSSFSIAGGPTFSKGFSSGIGSSFSQDNSFSPLLRDSEDGYNSLSNGTKDGTHGLSGLHNLGNTCFMNSAIQSLVHTPPLVQYFLEDYTCEINTENPLGLQGELAIAFGELLRKLWSSGRTSVAPRAFKSKLSRFAPQFSGYNQHDSQELLAFLLDGLHEDLNRVKKKPYIEAKDADGRPDDEFAEECWNYHKARNDSIIVDRFQGQYKSTLVCPVCNKISVTFDPFMYLSLPLPSTVTRMITVTVFSGTGDVLPMPYTVTVQKNGNCRDLTKALADVCCLKDSETLLLAEVYERRIYRYLTNPIEGLHSIKDEDILVAYRLPVGYEKLLRLEILHRRADRFLVEPQFNINRKLIGCPIVTCIPNGSTGKSDIYAAVSAVLVPFVRAKAHSPDVSAVKLNGNGPSLDGIVLTDNGTTSEEGLSISRSSEDDNAAVDELLPFQLSLTDEKGSIRNAIDTDSNRGLGLVIRVLMDWSEKEHGMYNIDYMDGLPEVFKPGFMSKKTRQEAVNLFSCLDAFLKEEPLGPDDMWYCPGCKEHRQASKKLDLWRLPEILVVHLKRFSYSRYMKNKLDTFVNFPIHDLNMSKYVKLTSRGDQHPMYELYAVINHYGGLGGGHYSAYAKLVEENNWYHFDDSHVSSVNEDEIRTSAAYVLFYRRVGGSSTVANGGAVDIEMVDSIEM

SEQ ID NO: 681 - protein, 208 aa, Sorghum bicolor
MSKMAEQKAAAVDGLGGAGAADAAPAGEAAAARVRPVETLLRAAPLGLCVAAMTVMLRDQQSNEYGTVAYSDLGGFKYLVYANGLCAAYSLVSAFYTAVPRPATVSRSWVVFLLDQVFTYLILAAGAAAAELLYLAYNGDKEVTWSEACGVFGSFCRQARTSVAITFGTVLCFILLSLISSYRLFSAYEAPPSSALGSKGVEIAAYPR

SEQ ID NO: 682 - protein, 107 aa, Sorghum bicolor
MMRLLTGGGGSSGGFRFVPRSVDALVAPTPTTSTTVIAEGHEGRCYWVHAWTVGADGVITQLREYFNTDLTVTRLAAVAVAASAKCVWQSRRPDSATNSLPGLLLAL

SEQ ID NO: 683 - protein, 399 aa, Sorghum bicolor
MNGEVECSVCHAKVQVPPAVSKAYDSHRSTVSSRQRALNVLLVSGDCVLAGLQPILVYMSKVDGKFKFSPISVNFLTEITKIIFAIVMLFIQARRLNVGDKPLLTVSIFMQAARNNVLLAVPAFLYAINNYLKFIMQLYFNPASVKMLSNLKVLVIAVLLKMIMRRRFSIIQWEALALLLIGISVNQLKSLPEGSSALGLPVAAGAYLYTLFFVTVPALASVYNEKALKSQFDTSIYLQNLFLYGYGAIFNFLGLVITAIIQGPSSFNILEGHSKATMFLICNNAAQGILSSFFFKYADTILKKYSSTIATIFTGVASAVLFGHTLTINFVLGISIVIISMHQYLSNQIKDEVPSSKVEMAEAHDHSRKEPSYVNVPDSVASEAKHRHGSDERQPLLPV

SEQ ID NO: 684 - protein, 414 aa, Sorghum bicolor
MRRVRVSSQQAPVHKLGDAQMKLTPRFRLAATSTSTSDPEHQQQQPPSSWEEEQAPLIPGLPDDAALNCLLRLPVSAHDACRLVCRRWRVLLADKARFFAQRRQLGLRTPWLFTLAFHRCTGKIQWKVLDLGHLTWHAIPAMPCRDRACPRGFGCVATPGGDGADGALLVCGGLVSDMDCPLHLVLKYDIYKNRWTVMTRMLTARSFFAGGVIDGRVYVAGGYSADQFELNSAEVLDPEKGVWQPIASMGMNMASSDSAVIGGRLYVTEGCAWPFFSSPRGQVYDPKIDRWEVMPVGMREGWTGLSVVIEGRLFVISEYERMKVKVYDAEADSWDSVSGPPMPERIMKPFSVSCLDSKIVVVGRGLHVAIGHVQKEPAGDPDSRSSGYSICWQDVDAPKEFSDLTPSSSQILHA

SEQ ID NO: 685 - protein, 419 aa, Sorghum bicolor
MESNNPSHSQIAEVKMDISASASGAAGYKFCKGAACDFSDSSNSSKDAKERSASMRKLIIAVILCIIFMTVEVVGGIKANSLAILTDAAHLLSDVAAFAISLFSLWAAGWEATPQQSYGFFRIEILGALVSIQLIWLLAGILVYEAIVRLINESGEVQGSLMFAVSAFGLLVNIVMAVLLGHDHGHGHGHSHGHSHDHGHGDSDDDHSHHEEQEQGHVHHHEHGHGSSITVTTHHHHHHHSGTGQHHDVEEPLIKHEADCEGTQSAAKAAKKPRRNINVHSAYLHVLGDSIQSIGVMIGGAIIWYKPEWKIIDLICTLIFSVIVLFTTIRMLRNILEVLMESTPREIDATRLQRGLCEMEGVVAVHELHIWAITVGKVLLACHVTIAREADADQILDKVIGYIKTEYNISHVTIQVERE

SEQ ID NO: 686 - protein, 621 aa, Sorghum bicolor
MEPKGELAQKPIEEAIDGLKIDASTKASNVNLPAKKDASSSDAVSCISSGDAASTVKETEMNQETYFGDQGMYYYGYYYPGSYGGLDENGNFVGYNGLEVHPAVVQADNGSYLCHLPGYENGYASYSPVVPGGIASVDGQYVSKEQYYSTAIPLQDLSTPGIFAQPIAYGTELVPAYSWDPSFVLLDGVQGHPVGVHQTNYAARPKYSSNKHAIPSSKAARSAKPAADTVKGSSSGLETVANAANSSPSSKGANKASGASITKGYLPSSKFVMHSNNQGKISVYQSKGINVKESGRSWNNGEKLKMRSKLNGHGDSESNESNHTDNSKHSLSPQSDVGLPSSGGANASIPSHVAISKNAYNLSDFVTKYEQALFFVIKSYSEDDIHKSIKYNVWASTPNGNKRLDSAYRLAQERMAEKGTKCPVFLFFSVNASGQFCGVAEMVGPVDFNRNMNFWQQDKWNGFFSVKWHIIKDVPNPQFRHIILENNENKPVTNSRDTQEVKFSQGTEMLNIFKNFACKTSILDDFDFYENRQKVMQDRRGKPLTTLFDHPLPKAEKTAEIKRQTHATEFGRAKSNEGQGNNVGVVHDTTKKNEEQSNNVSEVVDAACSNKEQPNKVATQC

SEQ ID NO: 687 - protein, 394 aa, Sorghum bicolor
MLLLPGRPVLPSPALPYCPSPSPSRFRPLPCTSNAPTSASTAASADATASSSFSVEEYLVNRCNLYPNVAARVAPELSAIRSPSKPDAVLAFLADALELSPPLIAVAVARDPTILTCSVPRTLAPRADELRALGFTTYQMGLIVVRCGAAAFRSRALVSSVQFWLPYLRGRVDKLVAALKGNPGLLTADLRTVKSTIALLQEEGTLTDGDVGWFALSYCSKLLVASPDEVDTVLARADEFGVPRKTRAFKDAIIAAFSATPERLAWKAAFFRDKLGWTEAQVKTAAAKMPTLMTVSAERIRRNWEFLTTEVGMDAERVASFPALLRYDLEGRLVPRFQVMRVLQARRLWRGRDFNNIAAITEEDFVAKFIRPFLVQVPDLAKIYEAAVVEKEEQ

SEQ ID NO: 688 - protein, 457 aa, Sorghum bicolor
MGTKNLTRNRPASMATASTTLLLSLALLAFAWAASPSPDAEAISRFQEYLRIDTAQPAPDYAAAVAFLRNQASEAGLEARTLELVAGKPLLLLRWPGRRPSLPSVLLNSHTDVVPSEPSKWDHPPFSAALDEASGRIYARGSQDMKCVGMQYLEAIRRLRSSGFIPDRTIHVIFVPDEEIGGHDGVELFVSSKEFKDMNVGLVLDEGLPSPGEEYRVFYAERSPWWLTIKAKGAPGHGAKLYDGSAMENLMKSVEAIRRFRTSQFDLVKSGQKAEGDVVSVNFAYLKAGTPTPTGFVMNLQPSEAQVGLDIRMPPDVHTEALERRLIEEWAPSSRNMTFEFKQRGSVLDNFGKPAFTPADSSNPWWPVLGEAVKKAGGKLGKPEVFPASTDARYFRKIGLPAFGFSPMANTPVLLHDHNEFLSKDEYIKGIGVYESIIRELATHNDEARDEESRAEL

SEQ ID NO: 689 - protein, 311 aa, Sorghum bicolor
MACSTASLAATLLALALMFQASLAGRRLTALVQEPAITMKYHKGALLTGPIAVNFIWYGDFSAPQRAVITDFVSSLSAPPAAVQPEPSVATWFKTARKYYASSKVRFPALRLGSHVVDQNCSLGKRLTERDLLRLAAKGGPSRAINLVLTAADVAVDGFCMSRCGTHGASPRSRSGRFAYVWVGNPASQCPGQCAWPFHQPVYGPQAAPLTPPNGDVGVDGMVISLASMIVGTVTNPFGNGFYQEGSADAPLEAATACAGVYGKGAYPGYAGSLLVDQASGASFNANGAHGRKYLVPALVDPDTSSCATLG

SEQ ID NO: 690 - protein, 384 aa, Sorghum bicolor
MGELIPGLPEEVARECLVRVGFDQLPVVRRISRQWKAEVESPDYHRQRRAEGLARPVLALVQAQPTAPPADDAGPVADKHSTAAAGSGGGPANSYRMVLLDPVEGRWAPLPPLPGPSESLPLFCQVAAVDGGQGRRKRLVVVGGWHPETWAPTDAVFVYDFLTGAWRRGAPMPGPRRSFFACAAVGGAVYVAGGHDDEKNALRSALAYDPEADAWAQLPDMAEERDEPRGLCVAGRFFLVVGGYPTQAQGRFVGSAECFDPATSTWAPVDDLVEDGVCPRTCCAAPPGSGSERLYMLSRDGHLVARDGGAAWRPVAQVPEDARTAATVSVIPDGRVVVIGSGCHGGDQTVYVLREEAGKGASWTRAAAPPEFSGHVQASCFLEI

SEQ ID NO: 691 - protein, 196 aa, Sorghum bicolor
MAAAARAIICELAPQKVSSSTASGPVAPKKRDAGTKVVLQPRLCTLRSYGAGSGVVTRRILAGEEDGSGAADSGGSAASPFFASLADYIESSRKSQDFETISGRLAMLAFAAAVAVETTTGSSLFKKLDTMEIEEAAGVCVAVVACAAAFAWASSARNRIGQMFTLGCNAFVDSLIDNIVEALFSEGELQDWSDDI

SEQ ID NO: 692 - protein, 370 aa, Sorghum bicolor
MAPQSRLLPPALQMLRRCRCRASRSHFSTAPTLVSPPSKAVVYDEHGPPEQVLRTVDVPPVEVGDRDVCVRMLAAPINPSDINRVEGVYPVRPPLPAAIGGYEGVGQVHAVGPAVTAPLSPGDWVIPSPPSFGTWQTYIVKDENVWHKVRSDVPMEYAATITVNPSTAFRMLQDFVKLNPGDSIVQNGATSIVGQCVIQLAKVHGIHTINIIRDRPGSEEAKNKLKQLGADEVFTESQLDMKNVKSLLGAMPEPALGFNCVGGNAASLILKLLKQGGTMVTYGGMSKRPVTVPTSYFIFKDLSLRGFWLQKWLNSDKTEDCRRMIDYLLGLVHEGKLKYEMESISFGEFSLALEKALGKHGSHPKQVIRF

SEQ ID NO: 693 - protein, 945 aa, Sorghum bicolor
MPAPVAAYPAKMACCLQLHLLRRSAPAPLPARVLLLLSTPRLRLRPVRASPGPGSSPPNSFAGWSSDSADDGADKSTLGFGPAGGLLGPGLAAFFFLAGLTFAAVSIRSSGNHAAAKMQNLPAETAATESYSDYHSHKEDDAISVREEDAQASLPTDWEENNDSLDETKSTDEFLAPLLQSNEEVPGVQAEHEVGHPLQNTEPVTNGNHLVGEEVQQFDNLIASDGNQNPASPPLPISSEYAQVSFAPSSTLDAADPSEGIPNVEETSDLKMALPENEHLDETLTSDAMVLDSDGVVLIQDIADSAVAAAFHPEDKGVEQNPQTHDKDEFSPSGLPDYMEHVSAEEMHPLGSNELSMATGTSEPGDGEETIVEDLYERESELENQNKPFKSTPPDQYFSSPGIPAPSIVSTASQVPVGQIVVPASVDPTQENAIAALQILKVIEPSARAGDLCTRREYARWLVVASNCLSRNTFSKVYPAMYIDNVTELAFDDVTPEDPDFPFIQGLAEAGLISSKLSRSDMNIPEDVHDNHILFSPESPLSRQDLVSWKMVLDRRQLPEVDRNCLFKVSGYIDIDKINTAAWPALVADLGAGDQSITALSFGFTRLFQPNKPVTKGQAALAISTGDSGEVVLEEVARIEAEKIAEAAVNAHGALVAQVEKDLNARFERELKEEREKVETLEKLAEEARMELDRLREEREEEKNILLRGRAAVESEMEVLLKLRSEVEEQLQNVLSKKVEVSFEKSRIEKLQKEIENDNLAVVQLQYELEVERKALSLARAWAEEEAKKAREHARALEDARNQWERQGIKVVVEGGLQDDASAGVTWANAGKEHPVDEVINRAESLLEKLKSMSAEMKVRSRGALERVMQHVRSFIASLKQQAADARQWCSEFGASAASKALMVSAEVQGSVSAFGATLGDKSKRVMEECKDGLEKFSHRFKTSD

SEQ ID NO: 694 - protein, 502 aa, Sorghum bicolor
MQQLQPKQMHWVRADSSDFGFGGDRPAPRSGHTAVSIGKSKVVVFGGFADKRFLADVSVYDVENKLWYTPECTGNGSDGQAGPSPRAFHIAVVIDCNMFIFGGRSGGKRLGDFWMLDTDLWQWSEMTGFGDLPSPREFAAASAIGNRKIVMYGGWDGKKWLSDVYVMDTMSLEWTELAVTGSVPPPRCGHSATMIEKRLLIFGGRGGAGPIMGDLWALKGITEEDNETPGWTQLKLPGQSPSPRCGHSVTSGGPYLLLFGGHGTGGWLSRYDVYYNECIILDRVSVQWKRLPTSNEPPPPRAYHSMTSIGSRFLLFGGFDGKNTFGDLWWLVPEDDPIAKRNIVLNIDSNSKPSTVTGDNQQSNLKESQALENPVTELAKRMGIPLSEEVSASFIDEVNDKELAELSSRLAGQSLPATDQVASIQVLRDHWKSSPASSLQLQELGPLLRDYQRLILQRYSGNPLPAFHEMEALRFFHLKSASQLRMDDIPVLLSEYGRLLST

SEQ ID NO: 695 - protein, 82 aa, Sorghum bicolor
MALSSRRMAAAPVLVLVLLLVATELGTTPVAEARHCLSQSHRFKGLCMSSTNCANVCQTENFPGGECKAEGATRKCFCKKIC

SEQ ID NO: 696 - protein, 658 aa, Sorghum bicolor
MMATYYSSQGSERDSQNMYSREPSNASYPMSSALGNLLYLNNPASGPYTEFSGILQSQQNCMEMPEPGHPSVMSQDSSARESDMLGSHQGQRSFGLVKDMKNEMLMHMMDGSQSSTADLIHDDAQNGIQLDFGVLNNHGSSNIPSVQGQGLSLSLNTQILAPSLPYWSVKPDMLSPHSYHDSLRVDDIRMKSMQSESSRAIRNSRYLKAAQELLDEVVNVWKNIKQKAQKEQVEAGKTDGKETEGGPKSEGVSSNPQESGANAAPELSTAEKQELQNKMAKLMAMLDEVDRKYKHYYHQMQSVVSSFDMVAGPGAAKPYTAVALQTISRHFRCLKDAINDQINVIRKKLGEEESSSGKEGKLTRLRYIDQQLRQQRAFQQYGMIPQNAWRPQRGLPENSVTILRAWLFEHFLHPYPKDSEKLMLARQTGLTRSQISNWFINARVRLWKPMIEDMYKEEIGDIEQDSNSSSDNTPRSKGKMVSSEDKEDPRSCTPRVCESSQLSESRGSMRTMNAVGGGAAMGFQNEPNPDDTFMNLMLKDQRSNGEEDGGLLLHNAVAQHQDENARFMAYHLAELGRYGNGNVSLTLGLQHSSSSSLSVPNAQQSFPGVGVGVGDDDIYNAAAAPLGVSVASSDYETMNQMDQRQRFEQSPLLHDFVA

SEQ ID NO: 697 - protein, 338 aa, Sorghum bicolor
MRRFLPAGGGGGGGGEPSSSSSSGGQHQHGGGLAGERAAAGLRYRGGDISLGHGHDDGHRRHQYHLGAGDAADRQNDGSMDMLARHSSSPVGFFSNLVMDNGYPRSNKAGVSGGGEGQRDPSTANNNSGSSSSGRKMKPSSSGFNFAGGTQQQGQQQGAAGGHLSRISEDGCASFPAGGLVGDRAAGGRGSGESSSGGAAAAARSYSGGFSIVGPWEESRDIITTLGAYDPQFSGAMAGTALEMAGMDRYMQLQQDQVPFKVRAKRGCATHPRSIAERERRTRISEKLRKLQDLVPNMDKQTSTADMLDLAVEHIKGLQSELQALKHEQEKCTCCRKR

SEQ ID NO: 698 - protein, 521 aa, Sorghum bicolor
MEMVLDWRSLGSLLATVVVFRTALRDFLPPEAEALLRRFIAWVAAAFRPPRDTILIDEADGPTGGANDLYDSAQLYLGARCLATAPTVRLHKPRQSPRPVASLPDSHTTHDTFRGVQVKWTSTARAVDRGSGGGGGGGYGNPYNMFGRGGHGGDQRGLELQFPRQHRDLIHHHYIPHLIDEATRMRLKSRERRLYTNRATGPGDDHHRLWTSHAFSHPSTFDTLALDPTLREEIRADLLRFAARRDHYARVGRAWKRGYLLHGPPGTGKTSLVAAIANLLEFDVYDLELTTVPTNSHLRRLLVSTTPKSVVVVEDIDCSLDLSDRNKKKKKGGLGAGGNGGADNDEDAAAQLAVMSMSPAAAAAMAVMGRESISLSGVLNFVDGLWSSCVGERLMVFTTNHPERLDRALLRPGRMDKKIELGYCTPPALRVLAKNYLGVGDEGCEDADEDPDTVNTLMAEAEGLLAPDEVQITPADIAEVFMGCDGAGAAAGLRKLVGELHRRRDAAAATAVVAPGEETPE

SEQ ID NO: 699 - protein, 355 aa, Sorghum bicolor
MGGAARVLPRPIAHHHFHQSASLPYLHAAAPVAASSALFAPRPTPSPSVRVSRPRRHAAMSAAAADSSSSSSIGIPRDAAVSSLSPESVSNNDLLIVGPGVLGRIVAEMWKQEYPGCKVCGQTATTDHHSELTDIGIIPSLKRSVAGPKFPNVIFCAPPYRSEDYAGDLRIAASNWNGEGSFLFTSSTAVYDCSDNGFCGEDSPCVSIGQSPRTDVLLKAENVVLEAGGCVLRLAGLYKSDRGPHVYWLSKGTLDVRPDHILNLIHYEDAASLAIAIMKKRLRSRIFVGCDNEPLSRLEIMDRVNRSGKFETQFQGFTGTDGPLGKRMENSKTRAELGWQPKYPSFTEFLGLSNL

SEQ ID NO: 700 - protein, 474 aa, Sorghum bicolor
MAERLAASLLPAASPSPSARRATVAAAAAASFPSPCSARAGLRLRSRQPLLSHSQKAAGRGRGVRVVRCMAASDAAQLKAAQEDIKELLKTTYCHPILVRLGWHDSGTYDKNIEEWPQRGGADGSLRFDAELSHGANAGLINALKLIQPIKDKYPGITYADLFQLASATAIEEAGGPKIPMKYGRVDVTAAEQCPPEGRLPDAGPRDPAEHLREVFYRMGLDDKEIVALSGAHTLGRSRPDRSGWGKPETKYTKDGPGEPGGQSWTVEWLKFDNSYFKDMKFLSQLPSEEQKEQDLLVLPTDAALFEDPSFKVYAEKYAEDQEAFFKDYAEAHAKLSDLGSKFDPPEGFSLDDDMSTAPADEKTEEDISFVAVAPSPVAPEPEPAAEPTPEPVAAAITTATADDNNGAAPQPEPFVAAKYSYGKRELSESMKQKIRAEYEGFGGSPDKPMQSNYFLNIMILIAGLAFLTSLVGN

SEQ ID NO: 701 - protein, 1041 aa, Sorghum bicolor
MLLSFSPHPSPLLLSLPSSTPACKPHARLRPVHASASAPPSPELLGKSALRRISEKLRSLGYLETGSETPTPAPNKSGDAPSPGEIFVPTPAQLPRHRVGSTIDPSWATGDGEAGSAARQRRRGRGRDASGSAASAPPSAAELALPRDELRRLQGIGIRVRKRLKVGKAGITEGIVNGIHERWRNAEVVKLRCEDVWAMNMRRTHEILERKTGGLVIWRSGSTIILYRGTNYKYPYFHYSERVDSFLDKESSDLSSSGDEDEEDETSSQHDSSHEESSENPVVACTEQINAGEGKSQTVGYLNQSLSREKDTTHPISSTKRLVFDTNEGNLDIRTGAPNEQHARLQENTRADRPSKFGPRERSSLVAGVGSPNKFRLQLPGEVKLAEEADKLLDGLGPRFSGWWGYDPLPVDADLLPAIVPGYRRPFRLLPSGVPPKLTDREMTILRRLAHPLPFHYALGRSSNLQGLAASMIKLWERCEVAKIALKRDAHNTDSELITEEIKDLTGGTLLSRDKESIVFYRGKDFLPPAVSLAIEKRRKLGSSTIYKPKPDIEENMPTQDDSVLKVSNDVSVHIREEGTSVTEVRAKSLNTVAKNVEARLSQAIAEKERAEKLLEELEKASPLSKAEVRETISEDERYMLRKVGLKMKQFLLLGRRGVFDGTIENMHLHWKYRELVKIICKEHRLEDVEYAARTLEAESGGILVAVEKVSKGHAIIVYRGKNYQRPSKLRPKTLLSKRDALKRSVENQRCKSLKVHVLKLSKNIDYLKDQMNSSYYHKDMHDPSVNSGTLQQHDEEVPEVAPMSSEPEVECASVEMDRALNLTKSGVPVEDMQSKVCFDKLEDDSSAAAGPCLTGSSSASLSNLIRHQNQHSSTVTFSPDSHCENDSKDVDGIKLDVESSSVLPLRGTPLSNQERLVLRKQALKMKKRPVLSIGRNNVITGVAKTIKTHFKKHPLAIVNIKNRADGTPIQQLISELEEATGSVLVSRETNKVILYRGWGAEVAQESSKESSADEGEKEVISPQLLEAIRLECGLLPGDSE

SEQ ID NO: 702 - protein, 604 aa, Sorghum bicolor
MGPPHAAQDPVPSPSPSDGSGSGSSRRRLRRLDRRNASKHIGYTAPNYCQYPPSPQPAASAPGSGPASLAASVACSLDLVNSFRIGGSGDGGGDLRFLCESLGLSGPDDFAIPLADWEAHKAVRSSASASSSPSSARPNHDSPQRDSPLCQVGAEEPAQAADADPELPAATGRDGPIEAPERPARLDPPPESTCPDARRAAGEGGIKGVRPPPVLKPPPSMALPAVCGVGSTWDILRSFAPDEKEDAPASRSDRRFGHRDAVEKDDDENAAVLLNLDDLGLEESSEGFTGTSSLSTTNDDETSSTTTESMFYISPNGRFRRRIRSWSRGVLLGSGSFGTVYEGISDEGVFFAVKEVNLFDQGSNAKQCIIQLEQEIALLSQFEHENIVQYYGTDKEDSKLYIFLELVTQGSLASLYQKYRLRDTHVSAYTRQILNGLIYLHERNIVHRDIKCANILVHANGSVKLADFGLAKEITKFNAVKSCKGTVYWMAPEVVNPKKTYGPAADIWSLGCTVLEMLTRRIPYPDLEWTQALYRIGKGESPAIPNALSKDARDFISQCVKSNPEDRPSASKLLEHPFVNKSIRSVRSMRTISSRSNSSTRGIN

SEQ ID NO: 703 - protein, 382 aa, Sorghum bicolor
MGVEEAGRAATGKKLALASIGFADVRVGAAVPGGAGVYKDGLLVVGLPVPKDDGLDAAARVVGDLAARLPDVGAAARTFLRNREVAEFVSGALAGAMTKAVLAPLETIRTRMVVGVGSKHIFGSFVEIVEHNGWQGLWAGNTINMLRIIPTQAIELGTFECVKRTMASAQEKWKEDGCPKIQLGNLKIELPFHLLSPIAIGGAAAGIASTLVCHPLEVLKDRMTVNRQAYPSIAIAINKIYRTDGLGGLYAGLCPTLVGMLPYSTCYYFMYETIKTSYCRAHKKKSLNRPELLIIGALSGLTASTISFPLEVARKRLMVGSLQGKCPPHMIAALAEVVQEEGVKGLFRGWAASSLKVMPTSGVTWMFYEAWKELLLGSRLHA

SEQ ID NO: 704 - protein, 124 aa, Sorghum bicolor
MAGTTRRSRKSSSSSSSAQQQLAAGALLVAVVVLVAASSSGVLVAVEAVCDMSNEQFMSCQPAAAKTTDPPAAPSQACCEALAGADLKCLCGYKDSPWMSVYNIDPKRAMELPAKCGLATPPNC

SEQ ID NO: 705 - protein, 253 aa, Sorghum bicolor
MGSLGADAEPQGARRRPRFLCLHGFRTSAEIMRKQVLGKWPADVTARLDLVFADAPFPAEGKSDVDGIFDPPYYEWFQFDKSFMEYRNFDKCLAYIEELMIRDGPFDGLMGFSQGSYLSAALPGLQEQGLALTRVPKIKYLIIIGGGKFQSPTVAEKAYANKVACPSLHFIGDNDFLKVHGEKLIESFVDPFLIRHPKGHTVPRLDDESLAVMLRFLEKIEGEVLEYSSKDKIEGEVLEYSSKDVNENEEVCL

SEQ ID NO: 706 - protein, 314 aa, Sorghum bicolor
MGDKVNPWCHWHNPPWKFNTEGSGGNLRPPDVGLVNTNSVALPAYLNTVAAPVPFFTASIAERPLSIAPRYATTLAPSLELPALYPSRKRPLVFYQKENHAPSAAPLLSKGPLDPVPELQGSNETNVTDVGAEETEGIHENSDEINALLDSDSDEGYEKLQELDRVRRQSAAENDTLSVESVGSAGAAAGSAPPAKKRRLSSCTDKSVVDTASSARPDHSIEQKLLVNDCDAQSCCVGEVESDHKFSLGEVEAAEGDSPDDQKRRRERIQETVAALRNIVPGGIAKDATAVLDEAICYLQYLKLKVKTLGAVSL

SEQ ID NO: 707 - protein, 330 aa, Sorghum bicolor
MAAASSPTSPPPPPATDVAAPGLPDLSIPYDLATRGQWQALFSHLSHPAHTPHPHHRLLLSALSALSLAKLRRFPDAAALLASLHPDPACPPPPFLIRLLHALLPLFLPDRPLALDRLYTLLSSVRARPDAGHPEWRRRDALVASVLAADHLSHREFDVALALLADIAAREPGNPVLLSRLAYAHLQIGNLGAASAAFRHVESVAAASEDPTRHANLLARNRALECIVAKDYAAAVREYERCIEADPADAVALNNKALCLMYSRDLGDAIKVLEGALERVPTAALNETVVVNLCSMYELAFVNHGEVKRSLAEWIARVAPDDFDTSCTRM

SEQ ID NO: 708 - protein, 216 aa, Sorghum bicolor
MAKTKQGKRDVDAYTIKGTNKVVRVGDCVLMRPADTDKPPYVARVERMESDGRGGVRVRVRWYYRPEEAKGGRRPFHGAKELFLSDHFDTQSAHTIEGKCIVHSFKSYTKLDNVGPEDFYCRFDYKASTGAFTPDRVAVYCKCEMPYNPDDLMVQCEGCKDWFHPSCMGMTIEQAKKIDHYMCSDCAKENGAKRPSNSYPVSPNSDSKIESKRRKR

SEQ ID NO: 709 - protein, 556 aa, Sorghum bicolor
MVAAALDAMAGTRWGRWLGLVTAVWVQCISGNNYTFSNYSHALKTLMGLTQLQLNGLSVAKDVGKAFGLLAGLASDRVPTWLLLAIGSLEGLLGYGAQWMVVSRTVAPLPYWQMCVFLCLGGNSTTWMNTAVLVTCIRNFRRSRGPVSGLLKGYVGLSTAIFTDTCSALFADDPASFLVMLAVVPAAVCALAMVFLREGPAAGAAAGADEEDDGRCFAAINSLAVAIALYLLAADLTGLGGDGGVVSAVFVAVLLVLLASPATVPALLAWKSWVKTRKAANADLEEADSLAAAAAAPLLLAAKAAGRTEEEQEARIPGERPRLGEEHTIAQALTSLDFWLMFASFLMGVGTGLAVMNNLGQMGVAMGYVDVSLFVSMTSIWGFFGRIASGTISEHFIKTRAIPRPLWNAASQVLMAVGYIVMALAMPGSLFIGSVVVGICYGVRLAVTVPTASELFGLKYYGLIYNILILNLPLGSFLFSGLLAGLLYDAEATAVPGGGNTCVGAHCYRLVFLIMALACVVGFGLDVLLCVRTKRVYAKIHESKRLSRSAVAQRVG

SEQ ID NO: 710 - protein, 1345 aa, Sorghum bicolor
MEAASASDETLAAVFAQLKPHTVALLDLLRSRRPASSSASSLREMAAFLRAAPAPALQLCFDYTVFPLLLLLDAAVQCRKQSNAPGQGSGGIDISDAVAEVGLTCLEVLLTKCRLTSVNQMVAMLKKLTSGAMLSPSEASEEFRGAIIRCFKALVLQLQPCLDNFCSCKQGTLLPTTPTSTGLEVVSVSRSNYSAQPEECLLAFLQSQNASAAVGHWLSLLLLASELEASRGHRGSADVRKESLHTLRILIGKVGSADALAFFLPGIVSRLGKVLYTAKAMISGAAGNSLSTEQAILGLTEALMIVLNDKENLSALGKHMNENHSHSPGGSGSTEHVLQMLRQLPTKSLSDEIGHDETTDDSISNVNNSFADRKALHVKRNKKWLEETTSNVDKLLCATFPHLALHSSEKVRKSVVSGVKGLLSSCSSTLKRTKMLLLECLCVLACDDAAAVSEAAQDALDYLFNQGHNLVTENEISDTFTRLVERLPQVVLGSEETTALSHARMLLALTFYAGPQFLINHLHCSPVIAARFFDCLGLCIGHSSQFSGSMDKLIVSKPLSIGYLYSVAELKSGAYAKDTTNKSLHAMSTSAASKISVIHDNALPNALLGTVEYELPHVPPWFSHAGSQKLYGVLAGIIRLVGLSTVSGKGTAASLSLFVDILLDQFRRLSTELREKSIYKDGLQRWYMKSEAGQTLRQASSAVCMLNELMYGLSGRSLGMFLQLFNNRSAQMSRTVCQKNQLLACVEHNGVTNEREVWGFNEQKGTKDNILHCIGSILHEYVSPEVWDLPTEKDTELRLIELNLPLHFYRDTTALHTVVLEGIGVLGVLLGQDFALSGFMHSSLYLLLRELISSSAQIRTASDAVLRALATAGGYCSVGQFVVANADYIIDSLCRQLRHLDLNPHVPDVLASMLCYIGASRDILPFLEEPMQAVSSELEVLGRHDHPHLTVPFLKAVSEISMACRHESTCLPDEAQSFYVKVSSEGQEVKNTIEKRMESSAISERMNVDARPYFMSLEYWEDLLCKLNEMRRYRRIVGSLAGSCLSAAIPLLSSIKEAACLVALDIVENTTISIAKVEEAYKCECQSKGVIEEAIQFLSFDELLDGTDATEDVDENRLLPAMNKLWPYLVICLRNKISVPVVRKCTEVLSRAIIISGGDFYVRRFHKDGSIVWRLLALSPFRRTSKMDEKAIILPYRDTSLTSEEPMAEISSQKIQIAVLDMIAAISSNKRSAVALESVLKKVCGLVVGIAYSSLTSLQEAAIRALAGLACMDADLVWLLLADVYYSLNQREPLLPNQDLALVSDLLPPPMSSREYLFVQYGGEGVRYDVDPSSVHEVFRRMQDV

SEQ ID NO: 711 - protein, 295 aa, Sorghum bicolor
MGKNGTQYAVLDAFTAEPFRGNPAAVCLLQDAAKAADERWMQSVAAEFNLSETAFLLRDSSASGAAPRFQLRWFTPAAEVELCGHATLASAHFLFTSVLAEHETLIEFSTKSGILTAKRVPAPESTGVSGEGKLFIELDFPMIDLVDCHPSELPSIPKTLNGASIVSVHKATTAGDLIVELSSGKEVADIIPNIHEIKICSGRGIIVTGPAPDGSGYDFFSRFFCPKFGIPEDPVCGSAHCVLAPYWGGKLGKHKLTAFQASPRSGILYLELEAAGRRVRIQGEAVTVMTGTLLA

SEQ ID NO: 712 - protein, 301 aa, Sorghum bicolor
MAILAVASPLKTLNPSQADHSRIRLSSSLLRLPLPVPRWRRLRCSAQYSEAAAAPPTSTTTPRPAEIPWSKELCNSVRLIGTVGTEVELRQLPSGSAVARGRLAVWKSATETTWVTLQFWDDLAIVASEHVKKGDRIFVSGRLVSDTVDEGPEKRHVYYKLAVQQLNFIESQPVRLYEPEASQDAPGGRRADYFNSTSNSTEDKNRDNMSSSRSTEELWQAFFANPLDWWDNRTNKKNPRYPDFKHKHTGEALWVDGRNNPNWVISQLAVLDSRMSSLQDNGRKPVSYMYADEFMTLDGNR

SEQ ID NO: 713 - protein, 362 aa, Sorghum bicolor
MDMEQGCKTAHGWAARDASGHLSPYSFSARIQGDADVTIKVLFCGICHTDLHVIKNEWGNAMYPVVPGHEVVGVVTDVGHGVTKFKAGDTVGVGYFVDSCRTCESCSTGHENYCPDLVLTSNGVDHHHHGATTKGGFSDVLVVSQDFVVRVPESLPLDGAAPLLCAGVTVYSPMAQYALNEPGKHLGVVGLGGLGHMAVKFAKAFGMTVTVISSSPGKRDEALGRLGADAFLVSHDAAQMKAAAATLDGIIDTVSAGHQIVPLLALLKPMGQMVVVGAPSTPLELPAYAIITGGKRVAGNGVGSVADCQAMLDFAGEHGVTADIEVVQMDYVNTAIERLEKNDVRYRFVIDVAGSKMEETVA

SEQ ID NO: 714 - protein, 324 aa, Sorghum bicolor
MRSLRAAQTLVSRSLLSARHLNGAASPATAAAAAGARWCATPAPVPPPRSPLPSSKVMPAGVAGAVSFSLTFATVAVAEAKAKERPQPDLLPQNVVLYQYQACPFCNKVRAFLDYHDIPYKVVEVNPLSKKEIKWSDYKKVPILTVDGEELVDSSDIINILQRRINPDEPTNDEEAKWRRWVDEHLVHVLSPNIYRTTSEALESFDYIAKHGNFSSTERFAVKYAGAAAMYMVSKKLKKKYNITDERASLYDAANTWIEALNGRDFLGGSKPNLADLAVFGVLRPIRYLRAGKDMVENTEIGDWYQRMEVAVGEPSRIQDAEGN

SEQ ID NO: 715 - protein, 197 aa, Sorghum bicolor
MGSGKASSPAPPGAAAAAAAGGSGSPSPPGGAVCCMCGDRGLLPELFRCSACSVRSQHTYCTDRYPKVESYGTCNWCLRADGAVASTSNSPRSAGKAAARPPAPHHHGGDTTTGGSGRSPKVVAARGDFASSNLSKPIKKQPQQQHAQRLLLRRSASDLGTRVVRNDHDAPPPPSPGVARGRPRVRRYKLLEEVITS

SEQ ID NO: 716 - protein, 1091 aa, Sorghum bicolor
MAGGQAPEASPGRYQRRRDEIDDDDCADVLGIDVRGPDADPFDIPAKRAPVERLRRWRQAALVLNANRRFRYTLDLKKEEEKEQIRRKIRAHAQVIRAALLFKEAGEKQNPDTELPEILPRGFGIGEQQLTVMTRDHNYSALQEYGGVKGLANLLKTNLEKGIHGDEADLSCRANAFGPNRYPRKKGRSFWVFLWEACQDMTLVILIIAAVISLVLGIATEGIKEGWYDGTSIAFAVFLVIVVTAVSDYKQSLQFQHLNEEKQNIQVEVIRGGRRIQVSIFDIVVGDIVALKIGDQVPADGVVISGRSLAIDESSMTGESKIVTKDQKSPFLMAGCKVADGYGTMLVTAVGLNTEWGLLMASISEDNNEETPLQVRLNGVATFIGILGLSVAAMVLVVLFARYFTGHTTNSDGSVQFVKRHTSVKSAIFGSIKILTVAVTIVVVAVPEGLPLAVTLTLAYSMRKMMADKALVRRLSACETMGSATTICSDKTGTLTLNQMTVVQSIVGEVKLQPPANVDKLSPTVVSLLLEGIAQNTSGSVFEAQDGSIEVTGSPTEKAILSWGLDLRMKFAEERSRSSIIHVSPFNSEKKRAGVAVVARDSDVHVHWKGAAEIVLALCTSWLDVDGSAHVMTPDKADQLKKLIEDMAEQSLRCIAFAYRNLDLKVVPSEEQIINWQLPDNELILIGIIGMKDPCRPEVRDAVELCKKAGVKVRMVTGDNLKTARAIALECGILDDSEASAQAIIEGRVFRAYDDAERENVADKISVMARSSPNDKLLLVKALKKKGHVVAVTGDGTNDAPALHEADIGLSMGIQGTEVAKESSDIIILDDNFSSVVKVVRWGRSVYANIQKFIQFQLTVNVAALVINVVAAVSSGNVPLNAVQLLWVNLIMDTLGALALATEPPTDQLMRQPPVGRREPLVTNIMWRNLFIQAVFQVAVLLTLNFRGRDLLHLTHDTLDHSSKVKNTLIFNTFVLCQVFNEVNSRKPEELNIFAGVSRNHLFLGVVSITVVMQVIIIEFLGKFTSTVRLNWKLWLVSVVIAFLSWPLAFVGKFIPVPRTQLKDIILRCWPKSGESAEQQDQDDRTAHPPV

SEQ ID NO: 717 - protein, 94 aa, Sorghum bicolor
MSLRYMSRVGARAAQAVRESTGRSVKDKAQSSASASMARSGGGSRPAPAAGSSVESGRASAAAVARRKAEEEKRRRAEQALRTVMFLSIWGPNT

SEQ ID NO: 718 - protein, 288 aa, Sorghum bicolor
MQPPPAEMHPAVAVEASASTAQADTTASAAAAAVPAPDPSPPPPAPAAETVDPPPPPPAPAPKTVTWSEKLTSDSPTHVHAAAAAESSQYVSRGPASSSSKGAVEVMRETLSRWGKSWGETTKMVESLSRDTWQHFKTGPSFTEAAMGRLAQGTKVLAEGGYEKIFKQTFEVLPDEQLKICYACYLSTSAGPVMGVLYISTAKIAFCSDNPLSYKAGNKTEWSYYKVVIPLHQLRAANPSVSKVNSAEKYIQVVSVEGHEFWFMGFLMYDKAAASLQEALATARELQP

SEQ ID NO: 719 - protein, 399 aa, Sorghum bicolor
MVESEGEAEAACAAVLTPPLSLEGGLAAELRPANIVQRVLSLFRNVRPGSDLSHFQLPATFNLPKSQLQLYGEGVYCVGDDLLGRCARGADSLERLAAVVAWSISTTRPPIFGFAPYNPVLGETHHVSTSSGGSTLNVLLEQVSHRPPVTALHAADARGDVRLVWCQSPAPRFHGASVEAAVRGARELRLPRHGETYVVGCPNLVIRLLPSPGVDWAGDVRVVCAESGLEAKLSYCRTRRSFLGFGGGDARCVRGRIFRSSAPDETLCEVDGFWDRQVSIKDVATGEVSVLYDAQRAIGDLATPVVQDQKGVSASESAVVWGEVSDAILKKDWETARQAKRRVEDTARRLAKERNERGEVWTPKHFSLSQNKDGDWECWPLEETVPPAPIVVPSSSSSS

SEQ ID NO: 720 - protein, 412 aa, Sorghum bicolor
MYHQHQGPSELFTTRTSFPMEQHLFLRGGNAQGDSGLVLSTDAKPRLKWTPELHQRFVDAVNQLGGAEKATPKTVMRLMGIPGLTLYHLKSHLQKYRLSKNLQAQANVSTSKNAIGCTSVADRIPGTSAATMSSTNVVPQAEKTIQIGEALQMQIEVQRQLNEQLEVQRHLQLRIEAQGKYLQAVLEQAQETLGKQNLGPANLEDAKIKISELVSQVSTECFSNAITDVKGSSSVHRLEPRQIQFVESSTNSYLSVAEGFIKEHRLQHHGVLKAYDDSSLFCRKRSHEHETQFALNRSLSERRMAHLQNEEGYSKAEFGYESDTEMAHEYAEPQKNGGGSTTSSASGSKVDAEKLYLEEQNCARQAVEYPRESKLVDFEHPCSGKKLDLNTHNVDDTDQAYRHFDLNGFSWS

SEQ ID NO: 721 - protein, 1934 aa, Sorghum bicolor
MASGGAGPSGPVRSTSQTRQRTMGRIPTRAYTMRPDGLSGEDGPGFEEEELVPSSLAPIVPILRAANEIEEENPRVAYLCRFTAFEKAHLMDPISGGRGVRQFKTYLLHRLEKDEHETNRRLATTDAKEIQRFYEQYCKKYLEEGHDKRKPEEMARHYQIASVLYDVLKTVTPGKNEYDKYAKGVEKEKASFSQYNILPLNISTPRQPIMEIPEIKAAVALLRQMDDLPMPRIELTQSSDGKTVPDEMDKPLVQDLLDWLWQTFGFQKGNVENQKEHLILLLANIDMRQQGTSHHSGRHVHVIHSSTVIYLMDKIFQNYNSWCRYLHLDSNIIIASDASTQRPELLYIGLYLLIWGEASNVRFMPECLCYIFHHMARDLHDIISDRREGPFEPPFQREGSDDAFLQLVIQPIYSVMQKEAARGKHGTVSHSMWRNYDDLNEYFWSKKCFKKLGWPMNPTADFFADTRATNETEQHDHVISRRRQHDHVISRRRASKTNFVEVRTFLHLFRSFDRMWAFFILAFQAMVIIAWSSSGALSSIFEPEVFRNVLTIFITAAFLNFLQATLEIILNWKAWKSLECSQRIRYILKFAVAVAWLIILPTTYSSSIQNPTGLVKFVSNWINLQNESIYNYAVALYMLPNIFSALFFMFLPIRRVLERSNSRIIRFLLWWTQPKLYVARGMYEDTCSLLKYTTFWILLLICKLAFSYYVEIAPLVEPTRIIMSLERPPYEWHEFFPNLRHNLGVVVTVWAPIVMVYFMDTQIWYAIFSTICGGVYGAFSRLGEIRTLGMLRSRFEAIPRAFGKKLVPNHGSRLKRDEEDKNPPFDKFADIWNAFINSLREEDLLSNREKNLLVVPSSGGETSVFQWPPFLLASKIPIALDMAKSVKKKDEELMKRIKQDPYTEYAVIECYETLLDILYSIIVEQSDKKVVDRICESIKDSIHRRSLVKEFRLDELPQLSVKFDKLLDLLKKYDENDPVNNNTQIANLLQDIMEIITQDIMKNGQGILKDEGQKQLFANLNLDSLKDVAWKEKCIRLQLLLTTKESAIYVPTNLEARRRITFFANSLFMKMPRAPPVRSMMSFSVLTPYFKEEVLFSPEDLRKKNEDGISILFYLRKIYPDEFRNFLERIDFKPKDEEELKDRMDEICPWASYRGQTLTRTVRGMMYYRKALEIQCLQDTKDPAKFDQDGLIESYRELQSSIEMAQAIADIKFTYVVSCQVYGMQKTSKDSKDKSRYQNILNLMIINPSLRVAFIDEVEAPTGNGATEKTYYSVLVKGGEKYDEEIYRIKLPGKPTDIGEGKPENQNHAIIFTRGEALQAIDMNQDNYIEEAFKMRNVLEEFESRKYGKSEPTILGLREHIFTGSVSSLAWFMSNQETSFVTIGQRVLANPLKVRFHYGHPDIFDRLFHITRGGISKASKTINLSEDIFSGFNSTMRGGNVTHHEYMQVGKGRDVGMNQISSFEAKVANGNGEQTLSRDIYRLGRRFDFYRMLSFYFTTVGFYFSSMVTVLTVYVFLYGRLYLVMSGLERSIMLDARNQQNVKALENALASQSIFQLGLLLVLPMVMEVGLEKGFRTALGEFVIMQLQLASVFFTFQLGTKTHYYGRTILHGGAKYRPTGRGFVVYHAKFAENYRMYSRSHFVKGLELLILLVVYLVYGRSYRSSSLYLFVTCSMWFLVASWLFAPFIFNPSCFEWQKTVDDWTDWRKWMGNRGGIGMSVEQSWEAWWLSEQDHLRKTSIRALLLEIILSLRFLIYQYGIVYHLNIADHHKSIMVYGVSWVVMLLVLVVLKMVSIGRQKFGTDLQLMFRILKGLLFLGFVSVMAVLFVVLHLTISDVFASILGYLPTGWCLLLIGQACSPLIRRTMLWDSIMELGRSYENIMGLILFLPIGFLSWFPFVSEFQTRLLFNQAFSRGLQISRILAGQKGIGEFEFE

SEQ ID NO: 722 - protein, 308 aa, Glycine max
MATPIPPPPAAAAAAAADTKVDYLNLPCPIPFEELHREAMMSLKPDLFEGMRFDFTKMLNQKFSLNHSVLMGPTEVPSQSTETIKIPTAHYEFGSTFIDHPRLLLWGRILTDGRLNARVKCDLSENLTFKANAQLTNEPHMSHAMINFDYKGKDYRTQFQLGNGALLGASYIQSVTQHLSLGGEVFWAGQHRKSGIGYAARYNTDKSVATGQVASTGMVLLSYVQKVSEKVSLASEFMCNYLSRDVTASFGYDYILRQCRLRGKIDSNGCVAAFLEERLNMGLNFILSAELDHRKKDYKFGFGLTVGE

SEQ ID NO: 723 - protein, 137 aa, Glycine max
MGVVVIDGSTVRDFVNDEAAFAKSVDEQFGVLDLNNDGVLSRSELRTAFESMRLIETHFGIDVATPPDQLAKLYDSIFDKFDGDRSGAVDRREFRDEMRKIMLAIADGLGSFPIRMVLEDDPNSLLQKAADLEASKT

SEQ ID NO: 724 - protein, 871 aa, Glycine max
MANPTQPNVGFTPERESSNPEKSPIPPPPSFVASPPGFPPPKLHLQQDQASSRSVKTPNVLSPANGVTTGSPVPHLSTPPGPPVFTSPVRPAAVPFRTSPASPQPLAFSSASSLPTSSSPLQFSNGSFESQHQVSDSIEDHVPLGESSFVLFSAHKVLKRKKQANVPSLGFGALVSPGREVSMGPQIIQRDPHRCQSCGAYANIYCNILLGSGQWQCVICRKLNGSEGEYIAHSKEDLHRFPELSSPMFDYVQTGNKRPGFVPVSDSRMSAPIVLVIDECLDEPHLHHLQSSLHAFVDSLPPITRLGIILYGRTVSVYDLSEEAMASADVLPGDKSPSQESLKALIYGTGIYLSPMHASLAVAHSIFSSLRAYKLNVPEVSRDRCLGTAVEVALAIIQGPSADLSRGVVKRSGGNSRIIVCAGGPNTYGPGSVPHSFSHPNYPYMEKTAIKWMENLGCEAHRHNTIIDILCAGTCPVRVPILHPLAKTSGGVLVLHDDFGEAFGVNLQRASARSAGSHGLLELRTSDDILITQVVGPGEESHVDTHETFKNDTALYIQMLSVEETQSFSLSMETEGDIKSDFVFFQFAIQYSNVYQADVSRVITVRLPTVDSISAYLESVQDEVAAVLIAKRTLLRAKNHSDAIDMRATIDERIKDIALKFGSQLPKSKLHSFPKELSLLPELLFHLRRGPLLGSIIGHEDERSVLRNLFLNASFDLSLRMVAPRCLMHREGGTFEELPAYDLAMQSDAAVVLDHGTDVFIWLGAELAADEGRSAAALAACRTLAEELTEYRFPAPRILAFKEGSSQARYFVSRLIPAHKDPPYEQEARFPQLRSLTSEQRTKLKASFVHFDDPSFCEWMRSLKVVPPQPS

SEQ ID NO: 725 - protein, 344 aa, Picea glauca
MGAFACVGLLFFIVLSSVEAWRPWPQYFNQTTTALGLKQQPNKADLQFGASKKHEGSSPYVNMRYHMGPVLTSAINVHTIWYGRWSKKEKRVINEFLLSISNNTKSPSVGQWWQTVQLYTDQTGANISRNIVIANEHEDYYSHGKILSRLTVQEVIKNAITTKSSPLPIDPKNGLYLLLTSSDVAVQDFCRAVCGFHYFTFPSIVGYTLPYAWVGHSGKQCPEVCAYPFAVPSYMTGMKAFKAPNGDVGIDGMISVIAHELAELSSNPLINAWYAGEDPTAPTEIADLCEGLYGTGGGGSYTGQVLTDKFGANYNVNGIRRRYLVQWIWSPIMSACSGPNALDS

SEQ ID NO: 726 - protein, 958 aa, Helianthus annuus
MAGGNTGGENRPNESPSSSDHGGNLNSSQFNGNPPSTPDSPTSAGFNTDQLPFNSRTSENYSDYDDDEAAVDPDIIPDEPEDIGDEEGEGEGEDLYDDNYINDYRRMEEHDQYESVGLDESLEDERDLDQIMADRRAAEMELDARDGVASQRKLPHLLHDQDTDDESIRPSKRTRADFRPPPSPAFSSGGGGGGGGDDPPTTDQTDDDMFDDDDNDEGEFEMYRVQGTLREWVTRDEVRRFIAKKFKEFLLTYENPKTHDHDYLTQIREMIAVNKCSLEIDYKQFIYTHPNIAIWLADAPQSVLEVMEEVANKVVFNINPNYTKIQQKIYVRVTNLPVYDQIRNIRQIHLNTMIRVGGVVTRRSGVFPQLQQVKYDCNKCGAVLGPFFQNSYSEVKVGSCPECQSKGPFTVNIEQTIYRNYQKLTLQESPGIVPAGRLPRYKEVILLNDLIDCARPGEEIEVTGIYTNNFDLSLNTKNGFPVFATVIEANHVTKKQDLFSAYKLTQEDKEEIERLSKDPRIGERIVKSIAPSIYGHEDIKTAIALAMFGGQEKNVNGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPIGGRYDSSKNFSQNVELTDPIVSRFDVLCVVKDVVDPVMDEMLATFVVDSHFKSKPKGANLDDKSVNNSQEDIHDTAMLADPEILSQDMLKKYITYAKLNVFPRLHDADLDKLTTVYAELRRESSHGQGVPIAVRHIESMIRMSEAHARMHLRQHVTQEDVDMAIRVLLDSFISTQKFGVQKALQKSFKKYMTFKKDFNGIVLHLLNQLVKEALRLEEIVSGSRRDVTHVDVKVADLQNRALDYEITDLKEFFTSTDFERGNFELDEERGVIRHLLVR

SEQ ID NO: 727 - protein, 419 aa, Helianthus annuus
MKDSPKPWKPHCCSSESKVSFSFSRCRPSRSEFSKNVAPCPSFRRLSFSDLSRSSSMCINEDIAQAFGPDLIDFKLSELRAMTQNFSSSFLLGEGGFGKVHKGYVDECMRTGLKAQPVAVKLLDIEGLQGHREWLAEVIFLGQLKHPNLVKLIGYCCEEEDRLLVYEFMARGSLENHLFKRISVCLPWGIRIKIAIGAAKGLAFLHGAETPVIYRDFKTSNILLDSEFNAKLSDFGLATMGPEGSNTHVTTRVMGTYGYAAPEYVNTGHLTTKSDIYSFGVVLLELLTGRRAMDKNRPKREQNLVDWAKPYLTSSRRIRAVIDPRLGGQYSVRGAKEMALLALYCVSPNPKDRPKMPSIIEVLESVKHFKDMAITCGQWPPASQKTSRNAVYSPKDAKEINGGRIYWKQTPVKTVRSRG

SEQ ID NO: 728 - protein, 170 aa, Helianthus annuus
MQTLQQKASEWSGVKQEDAFAIDQVNLFDKLGLQPFINLSTDFYTRVYDDQEEWFRSIFADSKKEDAIQNQYEFFVQRMGGPPLYSQRKGHPALIGRHRPFPVTHKAAERWLHHMQQALDNATDIDQESKTRMLNFFRHTAYFLVAGNDLKNESQGPPPCKHGNNKPAAD

SEQ ID NO: 729 - protein, 260 aa, Helianthus annuus
MAKIRAFFILALLLLSSSFFLQVARSQSDPDAEADAELVAETVEEGSHVGDDVEDIGIGNYNPAPGVETVSVFPKNFAKLVVAGQETELLIGLKNEGEQNVKVFAVHASIHLPFDHRMLVQNLSTVAFNDASVPASVQATFPYTFAVSKFLQPGTFDLVGTIVYEINQLPYQNVFYNGTIEVTEAGGLVSVETVFLVSLGLALLVLFGLWVRTQLQSLSKKTKKITKVEVGTRTVDASMDEWLQGTAYTQSQSNKLKKKK

SEQ ID NO: 730 - protein, 161 aa, Helianthus annuus
MSLVTKAIRESASEIYHGDAICQEKSKELLTEMGLPNGLLPLEDIVECGYVKDTGFVWLIQKKEKKHKFEKIGKLTTYGTEVTAYIEKFKIKKLTGVKSKELLMWITLSEITLDNPPTGKINFKATSGLYRSFPVSAFQLDDVKKDVGGASVTKDAQVKEV

SEQ ID NO: 731 - protein, 560 aa, Helianthus annuus
MAEETLNTTAAAAESTAVTAEVAVAPEAEKVEEAPVVVCEKDGSPETEKISESTSFKEESNVAGELPDPEKKALDELRLMVQEALNKHEFSAPPAAAAEEKPVKEEVPAKEEKATAVVEEEAKACAEAAGKDESTPSQATAVTPEVVPVTEVPEPEKKVSETETEVTEPEKKVTEPEKEVPEPEKEVPEPEETTEPEKKVTEPETKEKTTEPASEPGRSFNLGNTLLADERSDVILLKFLRARDFKVKEAFTMLKNVVAWRKQFGIESLLSEDLGTEQEKVVYMHGVDKEGHPVCYNAYGEYQNKELYNETFSTEEKRTRFLRWRIQFLEKSIRKLDFSPNGVCTIVQVIDFKNSPGPFKWELRQATNQALQLFQDNYPEFVAKQVFINVPFLYLAFYKIINPFFTQRTKSKFVFAGPSKTAETLFKYIAPELVPVQYGGLSREGEFVSTDSVTEEIIKPSTKHTIEIPAPESCTLVWEARVVGNEMTYGAEFVPVSADSYTVIVQKSRKLAAATNEPVISGQFKCDEPGKVVLTFDNQTSKKKKVLYRSKTKVTESIKC

SEQ ID NO: 732 - protein, 765 aa, Helianthus annuus
MAATSQKASHSSSDDSVSVHRHVVSDDWRNDDQNMPIKSSSIVSLINPTDSNANASAKGIQILTRAQTSHPLDPLSAAEIKVAVATVRAAGATPEVRDGMRFVEVVLSEPDKTVVALADAYFFPPFQPSLLPRKGGAIIPSKLPPRRARLVVYNKKSNETSIWIVELSEVHATTRGGHHRGKVISSKTIRDVQPPMDAVEYAECEEVVKDYPPFQEAMKKRGIEDMDLVMVDAWCVGYHSEADAPSRRLAKPLIFCRTESDSPMENGYARPVEGIYILVDMQNMVVLEFEDRKLVPLPPADPLRNYTPGHTRGGVDRSDVKTLQIIQPDGPSFRVNGQYVEWQKWNFRIGFTPREGLVIHSVAYVDGSRGRRPIAHRLSFVEMVVPYGDPNDPHYRKNAFDAGEDGLGKNAHSLKKGCDCLGYIKYFDAHFTNFTGGVETIENCVCMHEEDHGILWKHQDWRTGLAEVRRSRRLTVSFICTVANYEYGFYWHFYQDGKIEAEVKLTGILSLGALQPGEVRKYGTTIAPGLYAPVHQHFFVARMDMAVDCKPGEAYNQVVEVNVKVEESGKNNVHNNAFYTEETLLKTESQAMRDCNQLSARHWIIRNTRTVNRTGQLTGYKLVPGSNCLPLARPEAKFLRRAEFLKHNLWVTPCALDENFPGGEFPNQNPRVGEGLASWVKQNRSLEETDIVLWYVFGITHVPRLEDWPVMPVEHIGFMLQPHGFFNCSPAVDVPPGACESDVKDTEHKETIASKPVSNGLIAKL

SEQ ID NO: 733 - protein, 592 aa, Helianthus annuus
MGRIKDIIVTFFNNRWLVFVAAMWVQSCAGIGYLFGSISPVIKSSLNYNQKQVARLGVAKDLGDSVGFLAGSMSEFLPMWALLLIGAVQNFVGYGWVWLVVTGKAPMLPLWVMCLLIFIGTNGETYFNTVALVSCVQNFPKSRGPIVGILKGFAGLSGAILTQIYALINSPDKASLIFMVAVGPTMVGISLMFIVRPVGGHRQLRISDRSSFSLIYCVCLVLAAYLMGVMLVEDLVDLNQTIVQILTSILFVLLVLPIGIPLWLTFSSDPRPSEEEPLISESQNKDQPESSHDPNEIIFSEVEDEKPADVDSLPANERQKRILQLQSRLAQAAAEGAVRIKRRKGPHRGEDFDLTQALIKADFWLLFWTLLLGSGSGLTVIDNLGQMSESLGYDNTHIFVSMISIWNFLGRVGGGYVSEIVVRDYAYPRPVALAVAQGIMSIGHLFFAMGWPGAMYIGTLLIGLGYGAHWAIIPATASELFGVKKFGALYNFLTLANPGGSLVFSGLIASYIYDSEAEKQAKERGEIIIKSTSSMLTKLFETDDALKCTGSICFFLTYMLMSGLCIIALILSLILVRRTKTVYQNLYGKTRT

SEQ ID NO: 734 - protein, 406 aa, Helianthus annuus
MPTATAISLSILFLLSLTTTIHAHNITRILAKHPEFSTFNHYLTITHLANEINRRQTITVCAVDNAAMSDLLSKGLSIQTIKNVLSLHVFADYFGSKKLHQVTKGSTSTATMYQATGEAPGTAGYVHITDVKGGKVRFTPEDNLSQTDSVYVKSILEMPYNISVIQISSILQSPEAEAPTAAPDLNLTSLLDRDGCQSFHNLLTTSGAIGTFLSSVEAGVTVFCPDDDAITAFAPKYKNLTAAEKTSLLLYHGIPVYNSMGMLRSSNGLMNTLATEGAKKKYDFTVQNDGNDVKLKTKVVTATVTGTVVDDEPIAIYTLDKVLQPRELFKGAVEEADEPAPAPKGAKKKKKAAKKGDEAEEDAEAPGPGSDEDYSDDDAADQTASSGERVVAMVSVVVMAVVLNLF

SEQ ID NO: 735 - protein, 453 aa, Helianthus annuus
MPIDQADLNSDQVLRRDIPWETYMTSKLITGTALQLLRRYDKKSEHDRAPLLENDGPSYVRVFISILRDIQKEDTVEYVLALIDEMLTEKPNRAKLFHDKSLADEDIYEPFLRLLWKGSWFTQEKSSKILTLVVSARPNKNGLTANGKATDSKKKITTSDDVLKGLVEWLCIQLKKPSHPNRSIPVSINCLAALLKEPVVRSSFVQADGVKLLVPLISPASTQQSIQLLYETCLCVWLLSYYEPAIEYLATSRALPRLSEVVKGSTKEKVVRLIVLTFKNLLSKGSFGAQMVDIGLPQIVQSLKAQAWSDEDLLDALNHLEEGLKDNIKKSSSFDKYKQEVLLGHLDWSPMHKDPNFWRDNITNFEENDFQTLRVLLTILETSSDPRALAVACFDLSQFIQYHPAGRVIVTDLKAKERVMKLMNHENAEVTKNALLCIQRLFLGAKYASFLQA

SEQ ID NO: 736 - protein, 208 aa, Helianthus annuus
MMSPGINLVMTVIGFTVSTMFIVFVCTRLICARIHYISSRRSFRMSSRSDLNAMERGMRGAETFVAASFPTKKYSDPFFSCSKDAQCIVCLSEYHADDTLRILPSCGHFFHSSCIDIWLQQHCTCPVCRVSLREVFDKRCLMQPMFSSAVRFPSSADDSRRMDPTTNGQPRSTGNVQEAGLHNSNVSENVPAGSKSPGNKQFESPSDV

SEQ ID NO: 737 - protein, 415 aa, Helianthus annuus
MVIASARISTCGSMELAPASFSTRHVGRDCVYLKSTSSQWLKKPPRWFGFSHDKISKFNHSACSVSMVSNNYVGRSTYRIKKDNDDKIYRRLDSCLVIPPPKGKKPKAVIKFLGGAFIGAVPEVTYSYLLGLLANEGYLIISVPYNVTFDHSQAAREVYERFHSCLNSILTSGLPDDGLLAAELVDLPLYSVGHSNGALLQVLTGSYFSDKLPKANAIISYNNRPATEAVPYFEQLGPLVSQLMPVVEASPVSSMAKGAADAWKALLDTAEAMTPDYDPEARVSLDKFVDQLPSVFNQVAQGISEFKPTPTENRECCKNSYNVKKTLLVKFNTDAIDETDLLEETLRPRVEAIGGTLEKVSLSGNHITPCIQEPKLQVGDVYTPADAIAQGLKNLSLNETKVAARTIADWLSSIS

SEQ ID NO: 738 - protein, 571 aa, Helianthus annuus
MSSYIRSSENARDSTPMLYLREPLQQSYSSEPPILAGNEMMYMNYSSSSAGEFSGSLAGNSQQLNSCIDIPNIGVHDSNVVSHQELLSSIGEPWRDGRNHGMMLMDQMGSRNSQGQGLSLSLGSHIQPAGIQFHSGDYRNPNMGFSSFLSADSDSIKTDVSNSPYGMGNGSRGITDSRYLKAAQQLLDEIVNVGKALKQHNARKEAMDYSKEIDSEAKNVASSNQQEANELSAAEKQDLQNKMMKLISMLEEVDRRYKQYYHQMQIVVSAFDVIAGCGAAKPYTALALQTISRHFRCLRDAINGQIKATHRSLGETDSTANEKGVGISRLRFVDQQLRQQRALQQLGMMQQHTWRPQRGLPETSVSILRAWLFEHFLHPYPKDSDKTMLARQTGLTRSQVSNWFINARVRLWKPMVEEMYKEEAGDAEIESNSSSEFAPKTTKGDRKTSVDQEDLNQSTAASGFDSNQAPNVELIGTSNDSDFQHMMVQSNRGEHERLMAAAYQMPPQLVSLTLGLKHSEDGGLPPMASHGRGDGDSGSSVGPEAVDFDGVSSDNQQQRYGSSHLLHDFVA

SEQ ID NO: 739 - protein, 467 aa, Helianthus annuus
MSSSLNYDALNFKLIFFTILLINATALTNQNPKSNSTQTQINSNSVLVALLDSHYTELSELVEKALLLQTLEQAVSQHNITIFAPNNEALERHMDPEFKRFLLEPGNLKSLQKLLLFHIIPTRVGSDQWPGQDTGSVAVTHHKTLCVEESENRLPLTRGNSGEKIVGGLAKVTRPDDVTRPDGLIHGIERLLVPRSVQEEFNRRRSLTSISAVLPEGAPVVDPRTHRLKKPAPVPAGAPPVLPIYDAMAPGPSLAPAPAPGPGGPRHHFDGESQVKDFIQTLLHYGGYNELADILVNLTSLATEMGRLVSEGYVLTVLAPNDEAMAKLTTDQLSDPGAPEQIMYYHLIPEYQTEESMYNSVRRFGKVQYDTLRLPHKVVAEEADGSVKFGSGEGSAYLFDPDIYTDGRISVQGIDGVLFPVEETREKPASKVSPATATKVVANQRRGKLLEVACSMAGVFGHFTSCN

SEQ ID NO: 740 - protein, 306 aa, Solanum lycopersicum
MEFWGVEVKAGQTLKVKPELFKLIHISQAAIGEVKDVKEAKYVPLRLTVGDNKYVIGTLSAEDRPQLMFDLVFEKEFELSHGWKNGSVHFMGYSADDPSSEEIDSGDDVFSDEENVMEALNGKLEADVKDVKPDAKKSAPVKDEKNAKVAESKKEAESDEDDDDSEDDSDDEDDSEDDSDDVPLGMDGPEGMDLSDDSEDDDDSEEDDDSEEETPKKVEQKKRPAPSPKVAPGSGKKAKQATPDNKSGGKKGPATPSAKQNGKPAFNGNNKPKTQSPKSGGQFSGNKSNNKNFSGQKNFKGKQGRK

SEQ ID NO: 741 - protein, 739 aa, Solanum lycopersicum
MEESLLPGESSSNSWGRIRNRRRVGSMFDPRDAIAHGSAYQKAAALVDLAEDGVGLPEEILEGTSFEKAAQLYFMFTRFDFLWSLNYLALVLINFFEKPLWCSRHLAESCNNRDYYYLGQLPFLTGAESLIYEGVTLLLLVVHILFPISYEGFHLYWRSLLNRLKVVLLLILVADIVVYILFLADFYYLPFRIASYLRVVFFILNIRELRDSFFILAGMFRTYLNVVALTALFLLFSSWLAYVFFEDTQQGKTMFTSYGTTLYQMFVLFTTSNNPDVWIPAYKESRWYCLFFVLYVLLGVYFVTNLVLAVVYDSFKSELVKQVAEKDRRKLRTLKKAFSLIDDSNTGVLDKKQCILLFEELNKYRTLPKISGDDFESIFNELDDTGDFKINLEEFADLCTAIGLRFQKEDSLPIFEACPNFYHSAASEKLRDFVRGDTFEYIIVSVLLVNLVAVIIETTLDIQNNSGQTFWQKVEFTFGWLYVIEMALKVYTYGFENYWRDGQNQFDFIVTWVIVIGETATFVAPDDLTFLSNGEWIRYLLIARMLRLMRLLLHVERYRAFVATFLTLIPSLMPYLGTIFCILCFYCSLGLQIFGGIVNAGNPNLAQTELSDNDYLLFNFNDYPSGMVTVFNILVMGNWQVWMQSYKELTGTAWTYVYFVSFYLISVLWLLNLIVAFVLEAFQAEMDLEAAANCADGDDKESRSERRRNVGTKTRSQRVDFLLHHMLSSELTECSHDDP

SEQ ID NO: 742 - protein, 287 aa, Triticum aestivum
MSAGDGAAVSAVEGKLAELSTSCDLRTLPKRGKSASARTLNTAQIQLVASHPEVYEPCDDSFALVDALLSDKAQLLTLQPSLCMEVGCGSGYVITSLAIMLRQLGSGTQYLATDINQHAVETTQATLEAHGVHADVIATDIVSGLEKRLAGMVDVVVVNPPYVPTPEEEIGMKGIASSWAGGLNGRQVIDRILPAVRELLSEKGCLYMIALEDNDPLGICHLMNEKGFASRVLLKRCTDEESLYVLKFWQDAAAGANASQSGRSPRAESWLSQLPFKSFWHKNTGSS

SEQ ID NO: 743 - protein, 232 aa, Triticum aestivum
MAESDTAAGKMAEPDAADGKMANGEVSDDGRAVEVSGGGDDTLPAVLRGFVDGVWPPGDGGDPLLRRLRAATCEAAPRLRDASRNSARDLLAWTKQGSGLRAILVISVGTITMISLTGLLIFMSFLLVATANAIIVSVLMSLAAAGGFLALFFACLVAVYVGAVSIAIFVISATVISAIVGVLIATGWIGFFWMIWFAARKSLDLTKHSIGMTTSAMQSYSASRSVGQKPTD

SEQ ID NO: 744 - protein, 675 aa, Triticum aestivum
MIASVTPFSHSSTASSAEFERRKRSIPLLAAMSRNLKNPVQTQMAVSALSSSLIGDYPSKTRSEGKAVGWKRVFVQTDTGFVLPVQLDRGDSVHTVKRKLQVALNVPTEESSLTLGDHVLKNDLSSIRNDSPLLLTKTFMHRSSSSPCLSPTSKDLQQQRDRGGPIEVLVCPTRCIQAKQLVKDVARAIRNGVDPKLVNSGLGGAYYFKNSKGENAAIVKPNDEEPFAPNNPKGFTGRALGQPGLKRSVRVGETGFREVAAYLLDYDNFANVPPTVLVKISHPVFNVNEGVGSTNKKASVGDPRTVSKIASFQQFAPHDFDASDLGTSSFPVAAIHRIGILDIRIFNTDRHAGNLLVRKVTGADQFGNQTELIPIDHGLCLPECLEDPYFEWIHWPQASIPFSEDELEYIGKLDPVKDAEMLRMELPMIREACLRVLVLSTIFLKEGTLFGLCLAEIGEMMSREFNGMDDQPSQLEVVCMEARRLATEREECSTEHDSADEDVTQFELDCEDHEMPKTPPAYHFEFKGGSSRNPLSKLEEAIEEEEDDIQEEEESNAEKLACPKPVNKWLPNISKLSTSLSSVSLMDKSQRQVPAIPKGADSVKTSENSQVGNWRTANEQLPTSASFVKLADMGVDTWGLFLEKFQELLPGAFRAHKLGATGQRGRLRMGTSCQF

SEQ ID NO: 745 - protein, 765 aa, Triticum aestivum
MDTPDRPRAGAAAGFEDSPVFNFINNLSPIPPPKPQDTSHNVHLFKSSDLAPVSSIFASPHVNPPKESKLLIRDDSVQLSQDSNSPNSVRTRLGSAIRLIKCKNIVSENCSFTCHLNQGPIDSSANRSNSTSKLPQTIQFVGDSSECGKNQNADGKKDLARDQESIELEGALLDHTGPDKIDSSQPGRIVHENQQCEQQKDGFTAYDGDYLITHESSMDMLRLAPPCETDTQLVNETLNADNVFSGNSLLTDGPSGSYISNAAHDPNLYWDGTVEGPTTDYTPQLLPGACQSQSVSNDQICNAVEEPSDHIPIDQSALSQNMRGMRRRCLFNEKAGAVNKAAKKTSDRHSANTTTPRCKTNSGDKPVRTPPCALPGIGLHLNALAPISTDKIVPQAAQSSINQASNFPCAVSSSTSEPNIVNEDSSQAIVVANADESGQGSPKKKRHKFDDGDGTSCKRCSCKKSKCLKLYCECFHAGVFCSEPCSCQGCLNKPSNMEIVLSTREQIESRNPLAFAPKVIRTSEPGQELGEYSNKTPASARHKRGCNCKKSSCLKKYCECYQGGVGCSISCRCEGCKNAFGRREGLGPLSIEEAKQGNEENSACVKEEKKEDDNNQLVICPAANPAPAENVLTTPSAMDIRPLASLPPSSSKRPRSTTKVLGHPSRLCNSQAPLKTDTVLSPFENYAEIMFGVGTSDSLKGGLSPQTSVKVVSPNKKRVSPPRIGTGLSPICKSGRKLILKSIPSFPSLGGDVNNADTKTTLPAP

SEQ ID NO: 746 - protein, 411 aa, Triticum aestivum
MAAARARWRFLALPLALLLAIGSSRGLDAAPKPPVPKAISDLREAIVKGLGLQSEELKVSGFDVRDALVGHAVAYEFDMEVGRKAVPVRLLEDVNRWDFVDLPIFRSQADADDTALAEIGRGSFDPTLPPFQLAGPMELWIQDGDDVRLALPHDVEAGTLKKVVLADGAVVTVKGARAVSLRLPLELPLPLNRTTYKGRLSSLLSIARALRGAARSNQKPLMSLRIEGPTSLSSTPSMSPNDKLKLKRLAPGQVELSSRAIPAVTDDEDESPSPGLWPFLSLNASDGSLQGLEELLAKVLGKKAGEKGTFKLVNARASAQTYVKMGFTVEKRIADGEVNWSNLPEWKTKPKKLRAHYEVLARVERGQAIPERIAQVQPFQVDEAMSESMLTGNVSRSKMEVVNPPPVYFTL

SEQ ID NO: 747 - protein, 418 aa, Triticum aestivum
MEAVAAAGGAGLTGWQAAALSGAAGWVWAASYYDLTRRARALAQPWVTRRVHAETPSILTFQRLQHRLLDNFFSVLSCVVSVPFYTGFLPLLFWSGHGKLARQMTLLLAFCDYLGNAVKDLVSAPRPCSPPVRRVTATEDEKENAMEYGLPSSHALNTVCLMGYMLHYVLTYGPCDGFMIATGLSLAFMLVTLIGIARVYLGMHSLTDVIAGISFGIVILAFWLVVHDHVDAFVVSGQNVTFFWASLSLVLCFAYPRPEFPTPSFEFHTAFNGVAFGIVYGVQQTYTRFHGPEAPLILSHQLPLLAYAGRVLVGIPTILAVKSCSKALSKWLLPVMCSTLGIPIVSSCYVPALKPSDIGGGSGNKDEAKQAGGYLQRLFSLFPQKAYDVDTGIRFVQYAGLAWSVVDLVPVIFTHLNL

SEQ ID NO: 748 - protein, 204 aa, Triticum aestivum
MAMAGGAPPAPLPVVGHQFCAPYVVPLTVTKKALSLSDGDFAITDANGAVVLKVKGAIFSIRSRRTILDGAGMPLLTMQEKVFSMHHRWEVFRGDSTNAGDLLFTVKTTSLIQLKTEMDVFLAGNTAQQVCDFKIKGSYFDRSCVFYLGDSNNMVAQMSRKLTVSNVLLGRDTFSVTVFPHVDYVFIASLVVILDEVHRDKRDD

SEQ ID NO: 749 - protein, 108 aa, Triticum aestivum
MAPSISIAAAAPASGWKGGRKAGAAPAEGEAETEALLLRRRNAELEREVALLRAELEAARLRAEAAEEAEERLCAQLGEAECEALELARAYQGRVQELARGLAAARSC

SEQ ID NO: 750 - protein, 251 aa, Triticum aestivum
MASVHLCGPKVASAAMAKPALADGLRVPTSSSARPVPTGRRLRGLVVRAATVVSPKYTSVKPLGDRVLVKTKTTEDKTAGGILLPTTAQSRPQAGEVVAVGEGRSLGSNIVEISVPVGAKVIYSKYAGTELEFNDTTHLIMKEDDIIGILDTDDVKDLKPLSDRILIKVAESEEETAGGLLLTQASKEKPSVGTVVAVGPGGLGDDGSRTPLSITPGSSVLYSKYAGSEFKGSEGEYIVLRSSDVIAVLSS

SEQ ID NO: 751 - protein, 878 aa, Triticum aestivum
MLLHGLVDRLTGKNKQAWKEGKIRGTAVLVKSDVLNLGDFHASLLDGVHDILGKDDGVIFHLVSATAPDPQNPRRGKVGKPAHLEEMVVTMKSKAAGESVFKVTFEWDDSQGIPGAVVVRNTYRSEYLLKTLTLHGVPGKGTVVFVANSWIYPNVDRVFFANDTYLPSKMPALLVQYRQDELNNLRGDGTTGKYEEWDRVYRYDYYNDLGEPDKGHPRPVLGGTQELPYPRRCRTGRPPTKTDPRSESRIPQYKIQEALNIYVPRDERFGHLKLSDFLGYSLKAITEAILPVIRTYVDTTPKEFDSFQDIYDLYDGLLKVPDNQHLKELKKKIPLQFIKSLLPVAGDDLLNLPLPHVIRSNDYAWRSDEEFAREMLAGVNPVCIKRLTEFPVKSTLDPSVYGDQSSTITEDQIQQNLEEGLTVKQAMEKNRLFILDHHDNFMPFLDRINKLEGNYIYASRTLLFLKADGTLKPLAIELSLPHPDGIQHGAKSTVYLPADIDSGVDGQIWQLAKAYASVDDSAWHQLISHWLNTHAVIEPFVIATNRQLSVVHPVHKLLSPHYRDTLNINALARTTLINAGGVFEMTVFPEKYALEMSSIVYKNWKLTEQGLPDDLVKRGMAVPDSSSPYGVRLLIKDYPYAVDGLVIWWAIERWVNEYLAIYYPNDGVLRADKELEEWWKEVREVGHGDLKDADWWPKMVTVQELAKTCTTIIWVASALHAAVNFGQYPYAGYLPNRPTVSRRKMPEEGEEEYKQLQKGGKEADKVFIHTITSQFQTILGITLIEILSKHSSDEVYLGQRDTPEWTSDAKALEAFKRFGTRLMEIEKRILDMNKDPALKNRNGPVKMPYMLLYPNTSDAGGEKGLGLTAMGIPNSVSI

SEQ ID NO: 752 - protein, 287 aa, Triticum aestivum
MATPDLLFNLRNLFYLGAYQSAINNSDVPGLDADAAAERDVIVFRSYIALGSYQLVISEIDSSAATSLQAVKLLALYLTGDKEGAISSLKEWLVDSAIGSNPVLRLIAGIIFMHEQDYNEALKHTHTGGTLDLHALNVQIFLKMHRSDYADKQLKIMQQTDEDHTLTQLANAWLDIAVGGSKIREAYLIFQDFAEKYPMTGMVLNGKAVCCMHMGSFEEAETLLLEALNKDAKDPETLANLIVCNLHLGKPSSRYFSQLKLSHPDHVLVKTTTSAEGNFERALQAVA

SEQ ID NO: 753 - protein, 205 aa, Triticum aestivum
MRRGYSYSPSPPPRGYRGRARSPSPRDRYDGRGRDLPTSLLVRNLRRDCRPDDLRRPFAQFGRLKDVYIPRDYYTQEPRGFGFVQYFDPNDAADAKYYMDGQVILGREVAVVFAQENRKKPAEMRTRESSRGRSYDRRHSPSPRGRPSYRGRSYSRSPSPRPARRRFRDESPSRSRSPSGSRSASPLDGKYGRSSRRERSISVSG

SEQ ID NO: 754 - protein, 423 aa, Triticum aestivum
MSPTTAASPAPAPATDAHPKPSPGAKRSLMGSLIDATALLRAASFKEDSYVAAALPASDLRALADLRALLATHPDQISIWGVPLNPPSDAPADERTDVVLLKFLRARDFRVRDAHAMLLRCAAWRAEFRADAVLDEDPGFKDLEGIVAYMHGWDREGHPVCYNAYGVFKDRDMYNRVFGDGDRLSRFLRWRVQIMERGVRALQLRPGGVNAIIQVTDLKDMPKRELRAASNQILSLFQDNYPEMVARKVFVNVPWYFSVLFSMISPFLTERTKSKFVIAREGNVAETLFKFIRPELVPVQYGGLSRASELENGPPKPASEFTIKGGEKVFLEIDGIEAGATITWDLVVGGWELEYGAEYVPAAEGGYTLCVERTRKVPAAAAEPVHNAFTAKEPGKMVLSIDNSGSRKRKVAAYRYFVRKPSA

SEQ ID NO: 755 - protein, 505 aa, Triticum aestivum
MAARKDNAVLIACQAPNGRVTRAQAANCGRFGVPHPAPVPVRTERKPATKGKAKRGASDENTCASALTSAPPPKRRAALKDVTNISCANSFRNCTAVTKLQSRPTQKVGRNPSKNKQCAKKAPKPPLPTVSGTSFVVNDSHNVEETQKAELLPPKEEPTALLENKGSLSLWNFARNRESGVHEPFFQGRNTRDKSETADSNTGDYVGLNVIDIDKDNGNPQMCASYAAEIYRNLMAAELIRRPKSNYMETLQRDITKGMRGILIDWLVEVSEEYKLVPDTLYLTVYLIDQFLSRKYIERQKLQLLGITSMLIASKYEEICAPRVEEFCFITDNTYTKNQVLKMECEVLNDLGFHLSVPTIKTFLRRFLRAAHASQKAPCATLGYLGNYLAELTLTDYSFLKFHPSVVAASAVFLAKWTLDQSDLPWNSTLEHYTSYKSSDIQGCVRDLWELQQGNTSGSPPLNAIREKYRQEKFECVANMLSPAMPGSLFHRQANGTSPLLINNS

SEQ ID NO: 756 - protein, 515 aa, Triticum aestivum
MELPQLASFLGVVLATVLFLKAVLRRRRRRQYNLPPGPKPWPIIGNLNLIGTLPHRSIHALSKQYGPLMQLQFGSFPVVVGSSVEMAKFFLKTHDVVFTDRPKTAAGRYTTYNYSDITWSPYGAYWRQARKMCLTELFSAKRLESYEYIRREEVLALLGDLYRGGAGRVVVLKDYLSTVSLNVITRMVMGKKYLEKEVRDEAGAVITTPEEFKWMIDELFLLNGVLNIGDSIPWLDWMDLQGYIKRMKKLSKMFDRFLEHVVDEHSERRGHEGESFVVKDMVDVLLQFASDPGLEVKLNREGVKAFTQDLIAGGTESSAVTVEWALSELLKKPEVLAKATEELDRVVGRGRWVTEKDMPSLPYVDAIVKETMRLHPVAPMLVPRLSREDTSINGYDIPAGTRVLVMVWSIGRDPELWEAPEEFMPERFLGSRLDVKGQDYELLPFGSGRRMCPGYSLGLKVIQVSLANLLHGFTWRLPDGVELSMEEIFGLSTPRKFPLEAVMEPKLPAHLYVEA

SEQ ID NO: 757 - protein, 168 aa, Triticum aestivum
MRPQSAGALAATTLVFLSLICNIQILVSVTGLSSFAMDNSPNKPELGAAAAAGNPEAVVPDAANVEVNSVPAVDAQHPDPADVLAWALRQGQIHADPLMQRLETVGALLDIEMQIVPPVPHQVILAALDQLAMMPMPAADHAPPEASQEIDVDTEGVEGDVPPPPASP

SEQ ID NO: 758 - protein, 673 aa, Zea mays
MRALLSLSRLARRLPASLSPVRAPTTLLLRHIHADAPPPPPSHDSTPFVSRILESEPCLTPNDESEPASDPTLDEFLARFVAAFRPRLAAAFPNHDRDVLDEMLRLVADAVLCRLTGTDRGGDAIELNDDLWAAVWEVSASVREAMRRDQVRADLRQYLHCDEVKEMTRFAVDVGIRGSMLRELRFKWAGEKLDEVEFYRGLDDKHADAEAGADRAPVPRLTALPKRKGEVKFTMYGLDMSDPKWAEVAERVAEAEAHFVPEEAKAVEGRAKKAEERLLSVDPRSGDPVPAIEEWKEDLRPNRVDWISLLERIKARNVELYLKVAEILLDQESFEANIRDYSKLIDLHAKANNVESAERVLGKMKEKGIAPDVIISIVLVHMYSRAGKLEQAKEAFDFIRREDFKPDRKLFSSMIKCYINHGEPEQAENLIKVMRDTRVKPTREIYIGLLRSYVQRGLMAYAERVLKTMSFDRVEPTQELYTICIEAYGRVGDPKEACAMFDQMRRKFGHEADDSSIAGVVAAYMKNNQLDHALQWLLSLEKEGLQLGVKTNLMLLDWLSMLQLVPEAEQFVQKIKNLGEEPIEVHVFLADMYAKSSQEDKARRSLKILEEKKKLLKSDQFERVIRGLVDGGFSEEANKFYKMMKSCGFEPSKTIEVAVKALRIRGGSHRTGR

SEQ ID NO: 759 - protein, 612 aa, Zea mays
MAAPPATTATTHHRALLPPTRTHAAATHSALRLPLRAHPHAHAQRARLTAAAAPAPAASTASLESSAAGKPTVLVAEKLGAAGLALLREFANVDCSYGLSPEDLRAKISLCDALIVRSGTKVGRDVFEASGGRLRVVGRAGVGIDNVDLAAATEHGCLVVNAPTANTVAAAEHGIALLTAMARNIAQADASLKAGKWQRNKYVGVSLVGKTLAILGFGKVGSEVARRAKGLGMHVIAHDPYASADRARAIGVELVSMEEAMTTADFISLHMPLTPATNKMLNDEAFAKMKYGVRIINVARGGVIDEDALVRALDSGIVAQAALDVFTKEPPAPDNKLVLHENVTVTPHLGASTVEAQEGVAIEIAEAVIGALKGELAASAVNAPMVPAEVLSELAPFVVLAEKLGHLAVQLVAGGGGIKSVKVTYASARAPDDLDTRLLRAMITKGLIEPISSVFVNLVNADFTAKQRGVRITEERIILDGSPETPIDYIQVQIANVKSKFPSAISETGEITVEGRVKDGVPHLTKVGAFQVDVSLEGSLILCRQVDQPGMIGSVGSVLGEENINVSFMSVGRIAPRKHAVMAIGVDEEPSKVTLRKIGEIPAIEEFVFLKL

SEQ ID NO: 760 - protein, 1027 aa, Sorghum bicolor
MARRGYAMRMRAVDAAECYPFVGGGCSEGEGEPPPPPRFPPMDPKPLSRWWKHELAAGQARLLAGAKGGEAAAAGVRGSALRKGTKRKGSRSNSTGERARKRRRVLQFRSFLSNKERTAKPQSTFRLHEQKLHMAMLRKHKSSTVHTSTVLEPRKKLEEACDRMPTHENSVKKRHRERTDPSSEMNSDLYGIKEVTSSVNKQVIEVNGSTNKPTNTGHEMVKTSTGPKDDIFGDLPLLELESSKVMFRTGVHELPTVIEESFITNQTEADSIPEVVPLELIDASDITAQTPSPLEDLVKSEDSEPACISHNDVAGSHPSTVGIDGLPNHKNINMVKPGLGDMQLKFTDVSALGSHSVLRSKSGSGYPLQGCFDVNKNCSQEIKKHGTNSTSSPPAMRTRTEETKYKDAPVKGKKSTDITSAAVALPVPANQLSYQASALPSAVSHSVFSTRVDSNDMSSFRSMPAKECIPTTRPGNLRTNVCHGSRKHVDPCVALSTDNQGSSHSKLHPICSPANIGMTFMKLPGLERMEISNCNVKIGENRFSNAESMNAVRYQKQPWLSGMTYVMQGQKQIGLSSSQVGKPALDGYGGEGDHHLQQPTVRLMGKTVSVCSHSKDHNVSTMDQVSPDNVAIEASRLSTISCQLPQKRSFPCQDSVTPRVHLNNSSDFLARIPNNSMQGQNTAFSGLHNQRPQPINSAPTVKDCTWNFGNQFVRQAELNKAAIVSTNSQTRHLELHQPPQLISIPQNQQSHLWTPAAQMSRKDQCFVGPAVNQSSLVPKSLLTASMKEKYQKSTLLSYDDPSSMPICQPYQIPGANSSSASVTSFFEYGADNSLSRSSSPGLSLSLATGLANESVSTGRVACAGSLTNADGRKAASFAEPISNSSAYADNVSQQPAKPISNRTAYATDNVSQQPAKRQLVTDTQDLMSMGPNIVNHSPGWSLSDAVGPQVLDFSKRIARDAVQTSRNESNNPRASSGPVPPIETWSRPGLVAGANTMLKPGQNLNDHSKLLYSTKFSVDRGINSVVL

SEQ ID NO: 761 - protein, 415 aa, Oryza sativa
MEAVAVAGGGAGLTRWQAAALSAVAGWVWAASSFDLTRRSRALVQPWVTRRVLAETPSIVRFQKVHHKLLDSFFSVLSCVVSVPFYTGFLPLLFWSGHSKLARQMTLLMAFCDYLGNSVKDAVSAPRPSSPPVRRVTATEDEKENAMEYGLPSSHALNTVCLMGYLLHYVLTYGSHDNVMVVTGLSLAFLLVMLVGIGRIYLGMHSLIDVIAGICFGVVILAFWLAVHNHVDAFVVSGQNVTTFWASLSLLLCFAYPKPEFPTPSFEYHTAFNGVAFGIVYGIQQTYFHFHNPDVPLIFSPQLPLIVFVGRVLVGIPTILVVKFCSKALSKWLLPVMCNTLGIPIVSTCYVPALKASEKCKVKSDAKQGGYLQKVFSLFPQKAYDVDTGIRFVQYASLAWSVVDLVPAIFTHLSL

SEQ ID NO: 762 - protein, 809 aa, Zea mays
MKGAMPPRQFMVPGPGGPMLPPQQQFGLVETRPPLAAVLRPRFNIPGLHPSAAAAAAASGAGKIASTYDLVEPMRFLYVHVVKARDLPAVSATGAIDPFVEVKLGNFKGTTPVRAASHNPSWQQVFAFSATHLQSHLLEVALKAKDLAGDDLVGRVAFDLAEVPVRVPPDSPLAPQWYRLETKRGEKLPHGEIMLSVWLGTQADEAFPDAWHSDAHAAAGPAAVASTRAKVYFSPKLVYLRVAAIAAQDLIPHDTSRPMSACVKLQLAGQLRRTRPGAPPGTPNPIWNEEFMFVASEPFDEPLVVTVEDRVAPGRDEMLGRIFLPLAAAMPRHDHFGKPVEPRWYSLMRPSDDPDKKEVKFASKIQIRMSLDFGYHVLDESTYYSSDLQPSSKPARKPSIGMLELGVLGARNLVPMKPKDGRTTDAYCVAKYGPKWVRTRTILDTLNPQWNEQYTWEVFDPCTVITVVVFDNGQIGSKNGGGPDQRIGKVRIRLSTLETDRVYTHFYPLLVLNPSGLKKTGELHLAVRFTCTAWVNMMALYGRPLLPKMHYTQPIAVMQLDYLRHQAMQIVAARLSRAEPPLRREVVEYMLDVDSHMFSLRRSKANFHRITSLFFGFLAMLKWYDGIRSWWNSITTVLVHMLFLILICYPELILPTIFLYMFMIGLWNYRFRPRHPSHMDTKLSHAELTHPDELDEEFDTFPSSRPAEIVRMRYDRLRSIGGRVQTVVGDLATQGERAHALLSWRDPRATAIFVFLSLVVAVVLYVTPFQVLMVIGMLYLLRHPRFRSRMPSVPFNFYRRLPARSDMLL

SEQ ID NO: 763 - protein, 1344 aa, Glycine max
MDKLGEEEQLRTSTFQRLKSHTLHLLDLLQNPHIQYQKHCSLTVIPQLLRFLQSSSPSTLQPFFDYTLFPLLLLLDAAIQCRSTQKVDSQENYNMPGVLKTPVNVSDGVAEGVVNCLEELLRKCRLNSVDQMVVLLKKLTYGAMLSPSEASEEFREGILLCVKALLLSLYSCSDVSCLCEQIPGLPALSDDIYNDELHKTFKYGSESDKCLLAFLQSQFASAAVGHWLSLLLKIADTEAARGQKGSARLRIEAFKTLRVLVAKVGYADALAFFLPGIVSQLAKVLHSAKTMISGAAGNVESIDQAIRGLAEFLMIVLQDDANAPALDIEASSDFYSNECNSTLSLLDELRHLQVKNCVKTKAAEDTDVESEKISCSQTQLQEMGNTDPGRENMSLHVNRTKDWMQKTSAHVNKLLSATFPHICIHPSQKVRKGLVDAIKGLLSECFYTLGESRLMLLECLCALVVDVSNDVSSTAQDFLECLFSQNLKHVIKHNAAEIFIRNLEKLPRVVLGHEESHAVLHAQQLLTIIFYSGPRLLVDHLQSPVEAARFLDLFAACLSHNTVFSGLLGIITKTDRSSTLGYLPSIAELKSGANFFNYGPLLINSALSEVPKCRLIEEKSIDEPVKTAQNNYELPRMPPWFSYVGSIKLYQPLAGILRFVGLSLVADNISEGLLSHVIDILLGYFRRLVSELRLKEYNKESWQSWYDRNGSGQLLRQASTAACMLNEMIFGLSDQATNDFARIFHRSTLSRGVQVQSYKHDSAFHEFSWKKSKDKGVRSCLVECIGGILHEYLSTEVWNVPIDGRIADLQLNAAVEEDISLYFFQDAAMLREVIIDGVGIFNLCLGRDFVSSGFLHSSLYLLLENLSSSNYRVRNAADSVLHILTTTSSYTTVGQLVLENADYVIDSICQQLRHLDLNHHVPNVLASMLSYIGVAHKILPLLEEPMRSVSTELEILGRHQHPDLTVPFLKAVVEIVKASKREACLLPTQAESFARYVRSMVSNSEETTQDLWEDILFKLNDSRRYRRTVGSIAGSCITAAIPLLASFKQEICLAALDIIEGGTLAIAKVEAAYKLEREIKEATEEALQSLSLYQLKDTLEANEEAADENRLLPAMNKIWPFLVTCIQNRNPVAVRRCLNVISIVVPVCGGDFFTRRFHTDGTHIWKLLITSPFHKKSNFKDEKTPLQLPYRSSSVCSEDSFAETSYLKIQIAVLNMIADLCRNKSSSSALELVLKKVSGLVVGIACSSVVGLRDASLNALHGLASIDPDLVWILLADIYYTAKTENFPPPTPDLPEISEILPLPISPKEYLYVQYGGQSYGFDIDLASLDIIFTKIDSQYQMYS

SEQ ID NO: 764 - protein, 345 aa, Triticum aestivum
MASSSLVVLAAMATVAALLLSPATSLPVFTGDASPGFHAASCPQLDGIVWSSVEAALRQEVAVAAGLLRLYFHDCFPQGCDASILLNNTAARETALGPNLTIQPRAMQLIESIRARAHAVCGPVVSCADITLLATRDIIVISGGPWFNVPQGNLDSLAPAAQEKVFDLPAPKTASVATLVESFATRGLGDVADLVALSGAHTIGRSQCGSFEDRSQRADDTFSRKLAANCSKHPERLQNLDVITPDLFDNAYYKALGFNQGVFTSDMALVKNKTTAAIVKRFAESKDAFFGQFARSMEKLARVPKPAGNVGEIRRFSCFRSNAQRADAAVDAAGEEEEEGFSASA

SEQ ID NO: 765 - protein, 308 aa, Glycine max
MNDLLTESFEIPRGQGHGGGGDIELGEYARNSGDLGLDSFFKKVQELDKQYAKLDKLLKKLQDAHEESKAVTKAPSMKAIKQRMEKDVDEVKKTAHYLKTKIEELDKENLANRQKPGCGKGSGVDRSRTATTISLKKKLKDKMAEFQTLREAIHQEYREVVERRVFTVTGTRADEETIDRLIETGDSEQIFQKAIQEQGRGQIMDTLAEIQERHEAVRDVERKLLDLQQIFLDIAVLVDAQGDMLDNIETQVSSAVDHVQQGNNALQKAKKLQRNSRKWMCIAIMILLIVVIIIVVAVIKPWVTKKGA

SEQ ID NO: 766 - protein, 596 aa, Sorghum bicolor
MVGPQYDLVGNPLGAVRATFERTAAAAAAESGGADPVAAFRGKDWGAGDLFRSFLFEQDGLGKVPVLDASNLGLIKPNTLVRYRGMVQDMLGNEYYIGAFKDGSTWRTNKFTDVSPFSMPHPCDSHLWERHLFHCVPAPGQNSWTLESSPGPDVRRMSNCLAPELREKRKRDGDDDTMDVSENGHRESSSFCKKPKEGDAHVSSSSTEVAGTVPEMNGGDHHIPGSSFSCLVKIYDMPESQVKLNDVIEFIGVYTFDPELAAPSDNPDDIMLDLMEDVTVQLPPSKVPRLHCLVWRKLSSHDYISRPVVEPSPSLLKGIRQSLLSHLTLVLGNDELAAQCLLLHLLSRLRNRVDVVTVGRLSLNFTGFNKESASIFGNQLYSLIQKLVPYSQAIPLSIDYLNTATLQPRKDNKSGRLVTGVLQLPQGTHLTFDETLLQTGSLTSKGVENTMLLKNLMESQKVDYDFEYYKLEMAADVQLLTLSEGKSNILPSDLVVPFRPSSVPTVNAGAEETESWRWYLATVRSLPQSTEPETYQMIQDEMVSAMRDDRSLGCSELSRWLTMAQIMASSFGEKSLSLEHWQMVKELERLRKQRMQ

SEQ ID NO: 767 - protein, 623 aa, Sorghum bicolor
MDAANSVTPGAVSHILAHPSTGSDGAVPDLVVQVLDLKSIGTGSRFSFMATDGKDKIKAMFPTSFASEVRSGNLKNLGLIRILDYTCNAVNGNNGKVLIVIKCELVCQALDAEINGEAKKEEPPIVLKPKDEGVVVAEQANAPPVAIKPKQELKSASQIVNEQRGNAAPAARLSMTRRVHPLITLNPYQGNWVIKVRVTSKGNLRTYRNARGEGCVFNVELTDEDGTQIQATMFNEAAKKFYPIFELGKVYYVSKGSLRIANKQFKTVQNDYEMSLNENAIVEEAEGETFIPQVQYNFVKIDHLGTYVGGRELVDIIGVVQSVSPTLSVRRKIDNETIPKRDIVVADDSGKTVSISLWNDLATTTGQELLDMVDSSPVVAIKSLKVSDFQGVSLSTIGRSTLAINPDLPEAQNVKSWYDSEGKDTSLAPIGAEMGAARAGGLKSMYSDRVFLSHITSDPAMGQEKPVFFSLNAIISHIKPDQNMWYRACKTCNKKVTEAFGSGYWCEGCQKNDSECSLRYIMVLKISDPTGEAWVSVFNEHAEKIIGCSADELDRIRKEEGDDSYILKLKEATWVPHLFRVSVTQHEYMNEKRQRITVRSEAPVDYAAESKYLLEEIAKLTAC

SEQ ID NO: 768 - protein, 292 aa, Sorghum bicolor
MGSPGSANGRRGEYVRIPEEVEVASKGEGDAAAAVKAAAAAECPRVLRCRAIRWWAKVAVLGIFLAGAGAAAVVFLGPLLIKKVVSPILYWESTTFSRPAIALICFGAIALFPSVLLPSSPFMWLAGMTFGYLYGFLIITVGMSIGMSLPYFIGSAFHSRIHRWLEKWPKKAAFVRLAGEGDWHHQFKAVALLRISPFPYIVFNYASVATNVKYYPYIAGSMAGTIHETFLAIYSGKLLQSLAVATSHGSFLSLDQIIYNGIGFTIAAASTAAITIYAKKALQKLQAEDEIF

SEQ ID NO: 769 - protein, 995 aa, Sorghum bicolor
MDDSLYDEFGNYIGPELADSDADDDSDAGGASPSPSASGSPSPAARSSSGSPSRPAALMDVDDDEGDPSQQAVVLAEDKKYYPTAEEVYGPGVEALVMDEDEQPLEMPIIAPPRVVKFEVGTRAAATSTYASTDFLLGLAGNPALVRNVTLVGHLQHGKTVFMDMLVEQTHEVDTFDSEGERHVRFTDTRVDEQERQVSIKAVPMSLVLEGGNGKSYLCNIMDTPGHVNFSDEMTAALRLADGAVLVVDAAEGVMVNTERAIRHAIQERLPIVVVINKVDRLITELKLPPNDAYFKLRHTLEAINDLISSCSTTVGGTQLVDPAAGNVCFASGAAGWSFTLQSFAHLYLKIHGIQFDHEKFASRLWGDLYFHPDSRTFKKKPPKEGANRSFVEFILEPLYKIYSLVVGEQKGNVESKLAELGVTLSNAAYKLNVRPLLRLACRSIFGTATGFTDMLVKHIPSVKDAAARKIDHIYTGPQDSSIVDAMKKCDPNGPLMVNVTKLYPKSDCSVFDAFGRVYSGTIQTGQTVRVLGEGYSPDDEEDMTVKEVTKLWVYQARYRVAISKAPAGSWVLIEGVDASIMKTATICPMNIDEDVYIFRPLRFNTLPVVKIAAEPLNPSELPKMVEGLRKISKSYPLAITKVEESGEHTILGTGELYLDSIMKDLRELYSEVEVKVADPVVTFCETVVDTSSMKCFAETPNKRNKITMLAEPLEKGLAEDIENGLVSLDSRQKEITDFFRQRYQWDVLAARSIWAFGPDKQGPNILLDDTLSIEVDKNLLNAVKDSIVQGFQWGAREGPLCDEPIRNVKFKILNANIAPEPLHRGGGQIIPTARRVVYSAFLMANPRLMEPVYYVEIQTPIDCVSAIYTVLSRRRGHVTADVPKPGTPIYIVKAFLPVIESFGFETDLRYHTQGQAFCLSVFDHWAIVPGDPLDKSIVLRPLEPAPIQHLAREFMVKTRRRKGMSEDVSINKFFDEAMMNELAQQAADIHLQMM

SEQ ID NO: 770 - protein, 732 aa, Sorghum bicolor
MAEETANEVQVAQDNEIVPGNEAIQGDEFVHGDELIQGEELAHGEELPQGDDLVQGNELVVSEVATPPTTGTRRRRKKSLVWEHFTIEAVAGGATRACCKLCKQTFAYSSGSKIAGTSHLKRHITLGSCPKIKNQEQRLALPSTGGTDNDGEGTIERPTKRRYRYTGYANAAFDQDRSCSHLAKMIIQHDYPLHIVQQPAFSIFIESLQPRFKIVDVDTMEGEVYAVYQKEKENLLQSFSTMPGRISLTIGLWTTSQTLGYVSLAGQFIDSEWKVHRRMLNFMMVSSPHSENALSEAISLSLSDWNMKDKLFTITLDNDCSSHDIYSANLRDHLSNKNNLMLKGQLFVVRCYAHILNAVAQDVIASIHGVVYSIRESIKFIKASSAREEKFAEIALQLEIPSTKTLCLDVTTQWNTTYLMLLAALDYKQTFTTLETCDDNYNEAPSAEDWKKVEAACNYLKLLYDSAHSIMAAANPTANIFFHEAWKLQLELANGTGHEDPAFSSIAKDMHERFDKYWKDCSLVLAIAVVMDPRFKMKLVEFSYSKIYGAEAAKYVKVVNDAVHELYKEYVAQPLPLTPAYVEQGEGNNGPANANNSQGPPASTGDGLLDFDMYLSEIQSSQPSKSELEQYLDESLTPRIQEFDILNWWKLNTVKFPTLSKMARDILAIPMSMVSSGSSIFSAGTGSHMLDDYRSSLRPEIVEALVCAKDWLQYSPPATEAPSSALVKAEGS

SEQ ID NO: 771 - protein, 679 aa, Oryza sativa
MRREEASAAAAAAEAGTPRSPDLHDLSDDSDYAAAAAASSSHSAMRSDLVDQGSGETAKVDVVYEKERVTIHPTQYGSGRISGKLRLYLQQGSLFLSWEPNEGVDSLSSNSATMEIEKYRNLYTIKALPLSDVRFIRKHTPTFGFEYIIIVLSSGLAFPPFYFYNGGLRELFATLKKHVFIIRSDDDPNVFLVNDFQDPLQKSLSSLELPGVATVANAMSRQNSLSFTSSVDEARHGSDAKHGASSSMTEYVSKQKHRSNDPGRDLSIQVLEKFSLVTKFARDTTSSLFRENHSSGGHTYGRQQQEYVLDNRANDKYKDQQITPDKDSLLSDSMESNKILAWGKPREQPLSVDEWRSFLDPEGRVMDSKALRKKVFYGGIDHVLRKEVWKFLLGYHEYDSTYAEREYLAVMKRTEYEAIKSQWKSISSTQAKRFTKFRERKGLIDKDVVRTDRSVPYYEGDDNQNVLVLRDILLTYSFYNFDLGYCQGMSDFLAPILYVMEDESESFWCFAILMERLGANFNRDQNGMHAQLLALSKLVELLDPQLHNYFRKNDCLNYFFCFRWVLIQFKREFSFDQIMLLWEVLWTHYWSEHFHLYLCVAILKRYRSRIIGEQMDFDTLLKFINELSGEINLDRAIQDAEALCDQAGPNGAACIPPGTPPSMPIETDGGLYVQEDEVM

SEQ ID NO: 772 - protein, 600 aa, Oryza sativa
MDKGALMPSPDETCCVGGGGGSSFSSLRAYGRALAQTPRRLAARACAAASPGEEMSRVRARSGADMARALRWPDLVGLGLGGMVGAGVFVTTGRATRLYAGPAVVVSYAIAGLCALLSAFCYTEFAVDMPVAGGAFSYLRVTFGELAAFLTGANLIMEYVFSNAAVARSFTAYLGTAVGVDAPSKWRIAVPGLPKGFNEVDLVAVGVILLITVCICYSTKESSSVNMVLTAVHVLFIMFVIVMGFWRGDTRNLTRPADPEHNPGGFFPHGAAGVFNGAAMVYLSYIGYDAVSTMAEEVERPSRDIPIGVSGSVVLVTLLYCLMAASMSMLLPYDAIDTEAPFSGAFKGSSGWGWVSNVIGAGASLGILTSLMVAMLGQARYLCVIGRSGVMPAWLARVNPRTATPVNASAFLGVFTAALALFTELDILLNLVCIGTLFVFYMVANAVVYRRYVAAAEDDEEGRRRGAVPTLAFLLAFSLVALCFTLVWKLAPRGGARTGLLVACGAAAAAAVAAFRALVPQARRPELWGVPAMPWVPAASVFLNVFLLGSLDRPSYVRFGFFTAAAALVYVLYSVHASYDADEAAAALDGAKVLDEGCKV

SEQ ID NO: 773 - protein, 330 aa, Oryza sativa
MNNLFSSSWKRTGGGGGGDGDIESGGGVEMAPPPGAAAGASLDRFFEDVESIKDELRDLERIQRSLHDANEGGKSLHDAAAVRALRARMDADVAAAIKKAKVVKLRLESLDRANAANRSVPGCGPGSSTDRTRTSVVAGLRKKLRDSMESFSSLRARISSEYRETVARRYYTVTGEQPDEATLDNLAETGEGERFLQRAIAEQGRGEVLGVVAEIQERHGAVAELERSLLELHQVFNDMAVLVAAQGEQLDDIETHVGRARSFVDRGREQLVVARKHQKSTRKWTCIAIIILLVLILVVVLPIVLKFVNNNKSSSSSPAPATPSPPPPTA

SEQ ID NO: 774 - protein, 372 aa, Zea mays
MGGAAGEAMWAAVVAATVVFLAVEVSGAASALPRFAEAPEYRNGEGCPAAAAGVCDPGLVHIAMTLDTHYLRGSMAAVYSLLKHASCPESIFFHFLAAEAGAVDGADPEPELLRRAVAASFPSLRFEIYPFRAEAVAGLISASVRAALEAPLNYARNHLADLLPRCVPRAIYLDSDVLAADDVRRLWETRLPAAAVVAAPEYCHANFSRYFTPAFWSDPVLGARVFAGRRRPPCYFNTGVMVIDLRRWRAGNYRQRIERWMEIQKQKRIYELGSLPPFLLVFAGEVEAVDHRWNQHGLGGNNVHGSCRPLHAGPVSLMHWSGKGKPWDRLDAGRPCPLDHTWKSYDLYIPGDSGGAASPASGPALSASVFSW

SEQ ID NO: 775 - protein, 499 aa, Zea mays
MMAPPISADALVEAASAVAAYPAIAPNRMLCKDAPAPAISVVSKQTVRPAGASAAVGSGDLRLSVSDMPMLSCHYIQKGLFFPPPPPGVLAASLVSSLVAALSRALGVFPALAGRLVTLHDDSIVIRCGGDDAAVEFYHAVAPSLSLGDFLVPGADVPTRLTNGLFPMDRTVSYGGHGRPLTAFQLTVLGDGAVFVGFVANHAVVDGTSFWHFFNTWAGLCRGAPVREPDFRRNFFGDSTAVLRFPGGASPAVTFDADAPLRERILHFSAAAISELKATANRSKRAGQEAEANGKLAHDDSRLEGRSGEISSFQSLCAHIWRAVTRARRLLAADKTTTFRMAVNCRHRLRPAISPLYFGNAIQSVATTATVAELASNDLGWAAARLNATVASHKDGAIRRAAAEWEAAPRCFPLGNPDGAALTMGSSPRFPMYDGNDFGWGRALAVRSGRANKFDGKMSSFPGQAGDGSIDVEVCLAPDTMAHLLLDKEFLQYVSSPAP

SEQ ID NO: 776 - protein, 320 aa, Zea mays
MAATATAMAIATISPAAPIPSAPFPSLPLPLGLRLRSQPLLFAASRRRFLHVPKAASWDESVPEDGGDAEESVAAGDDEDEEEKQRPEPVSSSEFQFAAPPEGYVEPAAFDELPPESPEDVAAAYESLYGPAFSGETLLGNNVFEVKVVDPIDMDREQRPNDDFTERVVQVNRVTKVVKGGRQLSYRAIVVVGDMKGHVGVGVGKAKEVTEAITKAAMNGRRNLVTVPLTKYSTFPHRADADYGAAKVMLRPACPGSGVIAGGAVRVVLEMAGVENALGKQLRSKNPLNNARATIKATQMMKQFKDVAEERGIPMEELWK

SEQ ID NO: 777 - protein, 540 aa, Zea mays
MGIVAAATTAAATCTSRLLHHHATYHRHQLRYSASPFPLSLHCGSGRREAAARALLPDRVTPFSYGVDEDADDHPREECGLVGVVGDPDASSLCYLGLQKLQHRGEEGAGIVAVGGDGKLKSVTGLGLVADVFGDPSRLASLPGPAAIGHVRYSTAGAAASLRNVQPFLAGYRFGQVAVAHNGNLVNYQALRNKLEARGSIFNTSSDTEVILHLIATSLSRPLLARVCDACERLAGSYSLLFLTADKLFAVRDPHGFRPLVMGRRRNGAVVFASETCALDLIDATYEREVEPGEVVMVDRRDMSVASACLLPHRPRRACVFEHIYFSLPNSVVFSHAVHERRTAFGQALAEESPAPGADVVIPVPDSGFYAALGFARASGLEFQQGLIRWHYSGRSFIQPTQAIRDLAVKLKLAPVRGVITGKSVVVVDDSLVRGTTSSKIVRLLRDAGAREVHMRIASPPVVGSCLYGIDTPSEGELISNRMDMDGVRREIGSDSLAFLSLGKLHSIYGEESRDYCDACFSRKYPVLPTLADPAAEPEE

SEQ ID NO: 778 - protein, 106 aa, Zea mays
MAKNPKDAAPEEEMPAAAEEQAAPAATVKVLFFARARDLTGVADSAVEVPPGSTAGECLARVLAQFPKLEEIRGSVVLALNEEYAADSAAVADGDELAVIPPISGG

SEQ ID NO: 779 - protein, 448 aa, Zea mays
MGEGEAEVKGGVLQGRYELGRVLGHGNFGRVHAARDLRTGRAVAVKVLDKDKMLRTGMMEQIKREIAVMKRVSHPNIVELHEVMATRSKIYLALELVRGGELFARIVRAGRVKEDVARRYFRQLIHAVDFCHARGVYHRDLKLENLLLDDAGNLKVVDFGLSALADHARSDGLLHTLCGTPGYVAPEVFRNKGYDGAKADIWSCGVILYVLLAGSLPFPDDNVAAMFRKMSRGDYRCPPWLSTEARRLIPKLLDPDPDTRITIAQLVETPWFNKPSVSRSVRAAAGATEPPAEPASSAKDGGDKDEPPETMNAFHLISLSAGFDLSPLFDVEGGPARGPREGGMRFATREPASGVVSRLEEVAARGGGRMRVTKSGARGVRLEGAERGGRKGRLAVAADIFCVAPSVLVVDVKKDGGDSLEYRSFCSEELRPALKDIVWAADPQPAVV

SEQ ID NO: 780 - protein, 1099 aa, Zea mays
MGDAAAAGTLHKSYFDVLGICCPSEVPLVEKLLRPLPGVRTVTVIVPSRTVIVLHDAAATSPAQIVKALNQARLEASVRAYGGGSDGRQAAGSKRWPSPYVLLCGLLLVVSLFERLWPPLKWCALAAAAAGLPPIALRSFAAARRLTLDVNILMLIAVSGAIALKDYSEAGFIVFLFTTAEWLETRASHKATAGMSSLMSMAPQKAVVAETGEVVAAQDVKVGTVLAVKAGEVVPIDGVVVDGRSEVDESTLTGESFPVAKQPESQVWAGTLNIDGYIAVRTTAMADNSAVAKMARMVEEAQNSRSRTQRLIDTCAKYYTPAVVVMAAGVAVVPVVVRAHNLKHWFQLALVLLVSACPCALVLSTPVATFCALLTAARTGLLIKGGDVLETLARIKIAAFDKTGTITRGEFSVEEFQAVGERVTTPQLLYWVSSIESRSSHPMASVLVDYAQSKSVGPKSDNVAEFQIFPGEGIYGEIDGEGVYIGNKRILSRASCETVPDMKDMKGVTVGYVACKGQLIGVFTLSDSCRTGSDEAIRELRSLGIKSVMLTGDSSAAASYAQNQLGNILDEVHSELLPEDKVRIVDELKAKHGPTLMIGDGMNDAPALAKADVGVSMGVSGSAVAMETSHITLMSNDIRRIPMAVQLARRTHRTIVVNIVFSVITKLAIVGLALAGHPLIWAAVLADVGTCMLVIMYSMLLLRSESNGGRKVKKCCASSQHGSHSHARKKHCVSHHCSDGPCNKSTAGCSKESPSAGKHACSDHGHAHTHCKEPSNHRPERHACHDHGHSHNHCKEPSSHVVTEKHVCHDHGNTHSHCEEAGNQLLLVESHGCNDHGHGHSHDRCKELSSPRFTSKHECHDHEHSHCKEPKTPCADSEAACHGHGHGHEHRHCEGDSHSHATGEHGCHEHDAHSHCEEHGHSDTAVEHACEHECHGEHQTVHAVETHHCHDHDHEHGQHELGEIEEPEKDCHDHSHHCCHEPHGKDKVAAEPVEEVTISIAALPKDEGHHHSEEQHNGEHCRKAKDCGGGGGAAPTDCAASKNCCGVKGGDACSSVQAARARETGPCCRSYVKCPRTAAASRSSCCGHSMLKLPEIVVE

SEQ ID NO: 781 - protein, 369 aa, Zea mays
MVMGAASVGTLLVALAVLAPAVMTQSCDDELPAQLAGNFSGLACAPVWNSFVLRYAQDKDNVLRVVLSTMYSTGWVGMGFSKNGLMVDSSAMVGWIGKTGLPHIKPFSLRGKTPSQVVADQGFLVSSDNHKPTVLVQQAKIYLAFQLSFTEPLRRQNVLLAVGSAIPVNDRLAEHQDKTSIVFDFTTGSSSGSSSFPEGLKRTHGALNLFAWGVLLPIGAIVARYCRRWDPLWFYLHAGIQFVGFILGLAGVVAGVSLYSKIQADVPAHRGLGIFVLVLAILQILAIFLRPNKDSKYRKFWNWYHHWVGRLALFFAAINIVLGIKVGGAGNSWKIGYGFNLAVLLITIVTLEVLLWTRWKNSTGSTGAY

SEQ ID NO: 782 - protein, 315 aa, Zea mays
MKIIIDTDPGIDDSVAILMAFQMPGVQVLGLTTIFGNCTTEHATRNALILCEKASHLEVPVAEGSHEPLKGGKPHVADFVHGPDGLGNVDLPDPTIKKVEESATDFLVDKVSRFPGEVSVLALGPLTNIALAIKKDPSFVKNVKKIVVLGGAFFAAGNATPSAEANIHSDPEAADMVFTSGADIYVVGLNITTQVSFTDKDLLELRNSQGKYAQFLCDVCKFYLDWHTESYGAPVIFLHDPVSFAALVRPELFTFKKGVVRVETQGICVGHTSMDMLLKKWNSENPWTGYSPISVAWTVDVPKVVAFVKELVTKP

SEQ ID NO: 783 - protein, 501 aa, Zea mays
MDLALLEKALLGLFAAAVVAIAVAKLTGKRYRLPPGPPGAPVVGNWLQVGDDLNHRNLMAMAKRFGDIFLLRMGVRNLVVVSTPELAKEVLHTQGVEFGSRTRNVVFDIFTGKGQDMVFTVYGDHWRKMRRIMTVPFFTNKVVAQNRAGWEEEARLVVEDVRKDPEAAAGGVVLRRRLQLMMYNDMFRIMFDRRFDSEHDPLFNKLKALNAERSRLSQSFEYNYGDFIPVLRPFLRGYLNRCHDLKTRRMKVFEDNFVQERKKVMAQTGEIRCAMDHILEAERKGEINHDNVLYIVENINVAAIETTLWSIEWGIAELVNHPAIQHKLREELASVLGAGVPVTEPDLERLPYLQAIVKETLRLRMAIPLLVPHMNLNDGKLAGFDIPAESKILVNAWFLANDPKRWVRPDEFRPERFLEEEKSVEAHGNDFRFVPFGVGRRSCPGIILALPIIGITLGRLVQNFQLLPPPGLDKIDTTEKPGQFSNQIAKHATIVCKPLEA

SEQ ID NO: 784 - protein, 226 aa, Zea mays
MATSAALSTAANPTQLYRSRASLGKPVKGLGLSMGRERAQRSIVCQAASSISADRVPDMEKRKLMNLLLLGAISLPTVGMVVPYGAFFVPAGSGNAGGGTYAKDKLGNDITVEAWLNTHGPNDRTLAQGLKGDPTYLVVEQDKTLATYGINAVCTHLGCVVPWNGAENKFICPCHGSQYNNQGKVVRGPAPLSLALVHADVDDGKVLFVPWVETDFRTGEDPWWKA

SEQ ID NO: 785 - protein, 268 aa, Gossypium hirsutum
MATTDVSPMDQNPTPPKQPSFQQHCPPDFPRKVFAETIATYLLVFVTCGSAAISSVDEHKISRLGASVAGGLIVTVMIYAVGHVSGAHMNPAVTLAFAAVRHFPWKQVPFYGAAQLTGAISASFTLRVLLHPIKHVGTTSPSGSDLQALIMEIVVTFSMMFITSAVATDTKAIGELAGIAVGSAVCITSILAGPISGGSMNPARSIGPAIASGEYKGIWVYVVGPVTGTLMGAWSYNLIRMRDKPHHAISPHSSSFKLRRMNNQDGEV

SEQ ID NO: 786 - protein, 447 aa, Brachypodium distachyon
MGERKPASDRRSGRCQHYYYHCRPANTITPLAFVLLVTGALFLILGPTNSSLTLPALRVQFSNPIHIAAAESPQPPPEAGNNTATTVDDGDEDAGLPPARQLTDPPYSLGRTILGYDARRSAWLAAHPEFPARVPPAGRPRVLLVTGSAPSRCPDQDGDHLLLRAFKNKADYCRVHGLDVFYNTAFLDPEMSGFWAKLPLLRSMMLAHPEAEFLWWVDSDAVFTDILFELPWDRYAGHNLVLHGWEAKVYEEKHWVGINTGSFLIRNCQWSLDLLDALAPMGPRGPVRDMYGELFAKELTGRPPFEADDQSALVYLLVTQRERWGDKVFFENSYDLNGFWEGIVDRYEEMRSKGRGEGKWPLVTHFVGCKPCRRYVDSYPAEKCRLGMERAFNFADDQILKLYGFAHESLNGTAVQRVGNDTGGPLDADDGELARLLHPTFRAAVPT

SEQ ID NO: 787 - protein, 563 aa, Hordeum vulgare
MLSRRPLAAALRLAPLSPPLLLFFASSSSSSPAASASGPRGCSALRMDSGAAEPASTGAIWSTPSVEPRSISIGKQIFCNRSLNMRNITAVGFDMDYTLAQYKPETFEALAYHGTIEKLVKDLNYPVELLTWQFDWKYMVRGLVLDKKRGNILKMDRHKYVKVAYHGFREMSKEEKVAAYGSTLIRDSFDEPDYALIDTLFSLGEAYLFAQLVDFMDSNPAKVPSGTDYALMYKDVRSAVDLCHRDGTLKRMVAKEPSRYINEDLAIVPMLEMLRKSGRSTFLVTNSLWDYTDVVMNYLCGPYMSDVSSSHNRKWLEYFDVVITGSSKPSFFHDDNRAGLFEVEPDSGKLLNADLQIGSPRSSQHQPKPIHKVYQGGNVGHLHRLLSVASSSQILYVGDHIYGDILRSKKVLGWRTMLVIPELEQEVKLLSESKSTRKELRHLRMERDSVEDTIHRLEWSLQFEDLTENEKGKLLSEHDNLLQKLKGIRCLLRDAQMQHHQKFHKVWGQLMKTGYQNSRFAHQVERFACLYCSQVTDFGLYSPNKYYRPSEDYMPHEFDVLGL

SEQ ID NO: 788 - protein, 153 aa, Hordeum vulgare
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 789 - protein, 346 aa, Hordeum vulgare
MEAVEGNGGGSGLVVTELSHIKELVKQLDVHLGGSPGLCKHLAQQIFAVTEKSIGIIRSGHFNCPKRSAAGAGLDSPPLSATPSPVSGVSNTPFKPNKKRKTSEKGRHQIRVSSAGGGADAPADDGHSWRKYGQKDILGAHHPRAYYRCTYQKTQGCAATKQVQRADEDPALFDVIYHGEHTCLHKTAAAMVQPDGQNQDAQSLLQNLSSSLTVKTEGLIAAGTQGWSTTTPFSFSSPAVSGMTPPEHHPFSAPSTPENCFVSMPTSLEPSPATSGSNHMCFNPFQAQSELQTMVSALVEATSMPPADTEEAGFAYWSFDDSALDVNSFDEDVTNFDISAFLASDV

SEQ ID NO: 790 - protein, 355 aa, Hordeum vulgare
MASAPSRALPFLSPPSTAPRAPSVRLRCAAAAGQAGFFTRLGRLIKEKAKSDVDKLFSGFSKTRENLSVVDELLTYWNLADTDRVLDDLEEALLVSDFGPKISFRIVDTLRDEIRDGKLKSGTEIKASLKRCILELLTTKGSKTELQLGFRKPAVIMIVGVNGGGKTTSLGKLAHRFKNEGAKVLMAAGDTFRAAARDQLEIWAERTGSEIVIDNDKKAQAPSVLSQAVKRGKREGFDIVLCDTSGRLHTNYGLMEELVSCKKVIAKALPGAPNEILLVLDGTTGLNMLQQAKEFNDVVGITGFILTKLDGTARGGCVVSVVDELGIPVKFVGVGEGVEDLQPFDAEAFVEAIFP

SEQ ID NO: 791 - protein, 384 aa, Hordeum vulgare
MARPGHSTAWLPVLVLLLSAAGATAQSCLSATFTSGRTFLKCNQLPVLGASLHWTFHAQNGTADVAFRAPSGADGWVAWGINPSGAGMAGSNVFVASHSGGAVSVLTTILRSTKPALDNAALQFGVPVPASAEYAGGAYTIYATVALPGNTTSQNTVWQAGPASGGSISPHPLSGPNLQSVQRLDFLSGTSTGASNSRLHRRNLHGVLNAVGWGVLIPLGAMIARYLRVFEAADPAWFYLHITCQISGYVLGVAGWGLGLKLGSESKGLTYSTHRNIGIAIFCLATLQVFALFLRPDKKNKYRVYWNAYHHSVGYSVIVLAAVNIFKGLNILKPVTGWKTSYIVILATLAGVALVLEAITWAIVLRRRKRNRAHGGANGTGVQL

SEQ ID NO: 792 - protein, 416 aa, Hordeum vulgare
MGKVVVTEATARQVASFVLGAAAALTVVMLVQYRAPAAGLSRARTPGHFSGLRSSSSDDHHHHHRNGTTARAVVRQAPPVATNAEDDHRRPANATTITKPNSTSTAAALPLRHLPSTNHHGQKGANEESPEFRGLAAAVARAATDDRTVIITCVNQAWAAPGSLLDLFLESFRIGDGTARLLPHVLVVAMDPGAHARCLAVHRHCYHYTIPGLNIDFAAHKYFLSKDYLELVWSKLKLQRRILELGYGFLFTDVDIVWLRDPFKHVTAYADMTVSSDVYFGDPDNLGNFPNTGFFHVKPNARTIAMTKLWHGAKGKYPGANEQPVFNMMKKRMVAELGLRVQYMNPAYVGGFCSYGKDLRKIVTMHANCCVGIENKIKDLKNVLGDWRNYTRMPPWERHRAKWTVPGACIRAEKQV

SEQ ID NO: 793 - protein, 446 aa, Hordeum vulgare
MEDLQDCNSKSLVAVPGSLVLHVFRLLGQQDNSWQKYALAYFLLVRNEYFPREPRKHSAVNGQLVHCCVSSDLGSKEVEVEEQNAVVKTQSGGDSSSNGSNDCFLPGLHDDLAQDCLAWTSRSDYPSLSCLNKKFSTLVNGGYLYKLRRKYGIVEHWVYLACSLMPWEAFDPSRNRWMRLPRMPCDDCFSCADKESLAVGTQLLVFGREYAGLAIWMYNLLTRHWSRCTPMNLPRCLFASGSCGEIAIVAGGCNGTGQVLRSAELYNSEAGQWETLPDMNLPRRLSSGFFMDGKFYVIGGVTSEGHSLTCGEEYDLDTRTWRRIHDMYPGGTSASQSPPLIAVVNNQLYAADQSTNVVKKYDKASNTWNIVKPLPVRADSSNGWGLAFKGCGDRLLVIGGHRGPRGEVILLHSWCPEDGNGVADWEVLSVKERAGVFVYNCAIMGC

SEQ ID NO: 794 - protein, 530 aa, Zea mays
MATGSPRRRPLPLLLLFLLLFAANGRANAARPGGPSPIKNVVVLALENRSFDHMLGWMRRLLGLPVDGLNGTECNPNSNSTSSICVSADADLVVPDDPGHSFEDVLEQVFGNVSAAAAQPQPSMSGFVRSALSVNAVLSSAVMRAFRPSLLPAFSALAPQFAVFDRWFSSIPGPTQPNRLFLYSATSRGAVAHDKLDLLLGYPQRTIFESLAADGHDFAVYFKTIPTVLFYRRLRALRYAARAFHRYDAAFKEHARRGVLPALSVIEPRYFDLTGTPADDDHPAHDVANGQRLVKDVYEALRASPQWNQTLLIVTYDEHGGFYDHVATPTAGVPSPDGIRGPPPFFFKFDRLGVRVPTIMVSPWIKKGTVVGRALGPTDTSEFEHSSIPATIKKIFNLSSDFLTKRDAWAGTFDHIFTELDQPRTDCPETLPEVPFERPTPPKEHGWLSDFQRELVELASFLNGDYMLTSLAQENRKKKMTVKQADAYVRRAITSFLQASKQAVRLAANESAIVTMRSSLTSKSTRSSSP

SEQ ID NO: 795 - protein, 215 aa, Setaria italica
MASAVSLLLLSSPRPLHRTSGHLLCSPRRRALPPPPCPARSPRRLLAAPPRASNNNDNSGAVEAPDRLVAAVAYLYPFLDGAHHGRFLLAQFPFFSALLRPLGPAARLFHSSPLTPFLLFLTLYFAVVRNQQAFSRFVRFNAMQAVVLDVLLIFPDLLAQSFAPSGGVGFEIFQSMESTVFLFLLVCLVYGGGACLLGKTPRLPIVADAAERQVM

SEQ ID NO: 796 - protein, 279 aa, Sorghum bicolor
MAACRGFFECLLRLLNFILTVAGLAMVGYGIYLLVEWTKISEDGSGGGLTAEVLVSARPLLGAVALGDSFLDDLPKAWFIYLFIGVGAIVFLVSLFGCIGAGTRNTCCLCFYAFLVILLILAEAGAAAFIFFDQSWKDVIPVDKTHNFDVMYDFLKENWEIARWVALGVVVFEAVLFLLALVVRAMNKPAEYDSDDEIIAIGRSPTMRQPLIHAQNVPATGVPVPTLDQRASRNDAWSQRMREKYGLDTSQFTYNPSDPSRYQQNGTPQAEERSRCTIM

SEQ ID NO: 797 - protein, 496 aa, Sorghum bicolor
MTTRDAHLGVGVGVEGDAKDKNAAADALTDGGGGHEGAGSGGGRKLSLVPLIFLIFFEVAGGPYGAEPAVQAAGPLYALLGFLIFPFIWAIPEALVTAELSTAIPGNGGYVLWADRAFGALPGSLMGTWKYVSAAINGAAFPALCADYLARVAPAVSGGPARAATIVAFNVLLTAVNCAGLTVVGWSAVGLGVASLSPFLVMSGAALPKIRPRRWRVVARERDWKLFFNTLFWNLNYWDSVSTMAGEVDRPGKTLPKALVSAVSMTSLGYLLPLLAATGALDVAPDSWGNGFFADAAGMIAGNWLKYWIEVGAVLSSIGLYSATLSSAAFQLLGMADLGLLPGFFASRAPVFRTPWVSILATAAITLAMSFLSFNSIVAAANFLYSLGMLLEFAAFVWLRVKQPALARPYRVPARLPGAVLLCLVPSVFLVFVMAIAGWKVYAISAAFTAAGVAVYYLMRLCKARGCLRFSDGAGAGDQGSTAAVYQQGSSNGGDV

SEQ ID NO: 798 - protein, 794 aa, Setaria italica
MDGRHPPPSHQAPAAQPERHGSFNYDIENTDAAWRGAHTASEALLRYDDDGPREPLLRKRTRNTTSQIAIVGANVCPIESLDYEIVENDLIKQDWRSRKKQQIFQYIVLKWSLVLLIGLCTGLVGFFNNLAVENIAGFKLLLTGDLMLKQRYITAFLAYAGCNLVLAASAAAICAYIAPAAAGSGIPEVKAYLNGIDAYAILAPSTLFVKIFGSILGVSAGFVLGKEGPMVHTGACIANLLGQGGSRKYHLTCNWLRYFKNDRDRRDLITCGAAAGVAAAFRAPVGGVLFALEEAASWWRSALLWRAFFTTAVVAVVLRGLIQFCRSGKCGLFGQGGLIMFDLSSTIPTYSTQDMIAIIVLGIIGGVFGGLFNFLLDRILRAYSFINEKGAPYKILLTITISIITSACSYGLPWLAPCTPCPADAVEQCPTIGRSGNFKNFQCPAGYYNGLASLFFNTNDDAIRNLFSSGTEKEFHMSTLFVFFTAIYCLGLVTYGIAVPSGLFIPVILAGATYGRIVGTLLGPISDLDPGLFALLGAASFLGGTMRMTVSVCVILLELTNDLLMLPLVMLVLLISKTIADSFNKGVYDQIIVMKGMPFLEAHAEPYMRQLVAGDVVSGPLISFSGVERVGNIVQALRITGHNGFPVVDEPPLSEAPELVGLVLRSHLLVLLKGKGFMKEKVKTSGSFVLKKFGAFDFAKAGSGKGLKIEDLDFTDEEMDMYVDLHPITNTSPYTVVETMSLAKAAVLFRALGLRHLLVVPKTPGRPPIVGILTRHDFMPEHIHGLFPNLHKSH

SEQ ID NO: 799 - protein, 368 aa, Zea mays
MELDEETTFLDELMSLRREAAAAASAQWQAAAAYTGGGGQGMMMGDLLFYGGTTEAAATATSGGGMDQLSPFHQQEPLQVQAPPHPHSHEEFNFDCLSEVCNPYRGGGVAVITGAEAAAVPGRALAALHDAMVEDETSGHLQGQQYGAGGSPTFVFGGAAGESSEQTPVVVRGAAGGPHHRSKVHGGGAPSKNLMAERRRRKRLNDRLSMLRSIVPKISKMDRTSILGDTIDYVKELTERIKVLEEEIGASAEDLDLLNTLKASSSSGSNEMMVRNSTKFDVERRGNGSTRIEICCATNPEVLLSTVSALEVLGLEIEQCVVSCFSDFGMQASCSQEEEDGNNKRQVLSTDEIKQALFRSAGYGGRCL

SEQ ID NO: 800 - protein, 1229 aa, Zea mays
MAASPSPSTATATASPSASAAAVLAVNGERVELREGDVNPGTTLLEFLRTRTRFTGPKLGCGEGGCGACVVLLSAYDAASGAVSHAAASSCLTLVHGLHHRAVTTTEGLGGGGRLHAVHERLAGFHASQCGFCTPGVCMSLAAALAGAEAEAKAKAGRRPAPPEGFARLTAAEAEWAVAGNLCRCTGYRPIADACKSFAADVDLEDLGLNSFWRKGDAHASKLPRYDEGSIGVFPEFLKAEIRASSGVDQYTPPALLGSATTWHRPRSVEEYYKLVDSELFDQSKTKVVVGNTASGVYRETEVYDRYIDLRCIPELNSVSKEANGVQIGAAVTISQAIEILRVEAGGCNDVIFCKIADHMEKVASPFVRNTASLGGNLVMAQRDQFASDIATILLAAGSSICIQASSKRLTVMMEDFLQMPPCDHKTLLLSICIPRWTPIGGLFSGDKTMAGTESKTGTSVLFETYRAAPRPLGNAVAYLNSAFLAQVSSDGTSSRLILREICLAFGAYGSQHAIRARNVEKLLVGKPITTSVLLEACRRLKETIVPKEGTRHAAYRSSLAVAFLFTFLYPVTEGTLKTVKEVHLNGYATFGTNGNPNCGPDAHVDVSLKKVIDVNSGSCTNERILEYSNQIIEINKDYFPVGIPTKKVGAELQASGEAVFVDDIPAPKDCVYGAFIYSTKPLAHVKSIELDLSLKQLKTLGVVTVKDIPECGSNVGANTIFGPEPLFGDPVTQCAGEPLGVVIAETQRFANIAAKKAVVNYSTENLDAPILSIEEAVKRCSYFETPPFLLPLKIGDFSKGMAEADQKIYSEVKLNSQYYFYMETQAALAIPDEDNCMVVYSSSQCPETAQNVIAKCLGLPCHNVRVITRRVGGGFGGKAVRSLPVATACALAAFKLRRPVRMYLDRKTDMIVTGGRHPMKICYSVGFKPDGKITALHIGLFINAGMTKDISLIIPHNFIEALKKYNWGAFSYEAKVCRTNLATKSAMRGPGEVQGSYVAEAIIEHVASTLSADANLVRRKNLHTVESLALFHSECTEDAMGYTLHSICDQVTASENYQHRLEIIQSFNKNNKWKKRGLSFVPIVHKVLSRPTPGKVSILNDGSVAVEVGGIELGQGLWTKVKQMTAFGLGQLCPNRSQELLERIRVIQADTLSNVQGGWTTGSTTSESSCEAVRLACNVLVNRLKPVKEQSQEKQDNVSWDELISKGRGGISECWFACQPFPLLLYAM

SEQ ID NO: 801 - protein, 1402 aa, Setaria italica
MAAAAAAAASPSAAPPSAAAAVFAVNGERVELRGGEVDPGATLLEFLRTRTRFTGPKLGCGEGGCGACVVLLSTYDAASGAVSHAAASSCLTLVHGLHHRAVTTTEGLGGRGRGLHAVHERLAGFHASQCGFCTPGVCMSLAAALAAADAKKGDGRPAPPEGSARLTAAEAERAVAGNLCRCTGYRPIADACKSFAADVDLEDLGLNSFWRKGGAHASKLPRYEEGSIGVFPEFLKAEIRASAGIEGCTPPALLGSGSTWHWPRSVEEYYKLVGSELFGKSGTKVVVGNTAAGVYREAEVYDRYIDLRCIPELNLVSKEAKSVEIGAAVSISKAIEALREDGGCNDVIFCKIADHMEKVASPFVRNTASLGGNLIMAQRDQFASDIATILLAAGSSLRIQVSSERLTITLEEFLQMPPCDYKTLLLSIYIPRWTPIGDLSGDGTMDRTVSTRGNSVLFETYRAAPRPLGNAVAYLNAAFLAHVASDGTSGSIILRELCLAFGAYGTQHAIRASNVEKLLVGKPITASVLLEACTLLKKTIVPKEGTRHAAYRSSLAVAFLFSFLCPVTKETLKPVKAVHLNGSVPSGTNGNPNCGPDARVDASLKKINNVKPGSYGNDCILEYSKQKIEINKDYLPVGIPAKKVGAALQASGEAVFVDDIPSPKDCLYGAFIYSTKPLAHVRSIELNPSLKKLNTLGIVTVKDIPEGGSNVGANTIFGPEPLFGDPVTQCAGEPLGIVIAETQRFANIAAKQAVIDYNTENLGAPILSIEDAVRRCSYFETPPFLLPQKIGDFSQGMAEADQKIYSAEVKLNSQYYFYMETQTALAVPDEDDCMVVYSSSQCPETTQNVIAKCLGLPCHNVRIITRRVGGGFGGKAVRSLPVATACALAAFKLHRPVRMYLDRKTDMIVSGGRHPMKICYSVGFKSDGKITALHLDLFINAGMTTDVSLIIPHNFIEALKKYNWGAFSYEAKVCKTNTATKSAMRGPGEVQGSYVAEAIVEHVASALSTDANLVRQRNLHTIESLALFHSECTEDDMGYTLPSICGQLTASENFQHRLEVVKSFNKNNRWKKRGLSFVPIVHKVLSRPTPGKVSILNDGSIAVEVGGIELGQGLWTKVKQMAAFGLGQLWADRSQELLERIRVIQADTLSNVQGGWTTGSTTSESSCEAVRLACNILVDRLKLVKEQFQEKQSNLSWDELISKAKMAGVDLSAREYYIPGPSGSYLNYGAAASEVEIDLLTGATTIVRSDLIYDCGQSLNPAVDLGQVEGAFVQGIGYFMTEEYVTNSDGLVISDGTWTYKIPTVDTIPKQFNVKLLNSGFHKKRVLSSKASGEPPLLLAASVHCATREAIRAARREPHCSASGPSSPSHFDLEVPAIMPVVKELCGLDNVERYLESLLSSK

SEQ ID NO: 802 - protein, 489 aa, Phaseolus vulgaris
MEYFNKAKAVKLRSHLGKYLVADDDHHKLRQSKNGSTRNSIWLVELVKGKSHHVRLRNSNGRYLTATEAPFLLGVTGNKVVQGSLGDGWNGKLEWEPITEGLHVKLRSWCGKYLRGNGGTLPWRNSITHDDPYASTTHDWILWAVEPLEFPDKLLSSPETHFPSSLESEDELRGSEEPGSSLLQSTSSDTMFRSGMELFHRAKVVRLRSHHDKYLLADEDEESVTQDRNGSSRNAKWTVELIPEFDNLLRLKSCYGKYLTASNQPLLLGVTGRKVVQSVPRQLDSSVEWEPVRDGAQVKLKTRYGNFLRANGGLPPWRNSVTHDIPHRTATQDWILWDVDVLEIHVESPAPPPIPHSDSLDFDSYTPSAVSIKSTAFSRQESTDSNVGSPPKLEGRTIYYHVAEDNGDVDDENVQGYSLTFKGNGVEQLTRKFVEETGLEGVIVCTRSPLNGKLYPLRLQLPPNNVTMQVVLVLPSSKVARDFEEQGLL

SEQ ID NO: 803 - protein, 795 aa, Phaseolus vulgaris
MATLADIGVSATINILSAFAFLLAFALLRIQPVNDRVYFPKWYLSGGRSSPRSSGNFVGKFVNLNFRTYLTFLNWMPQALRMSESEIISHAGLDSAAFLRIYTLGLKIFVPITVVALLILIPVNVSSGTLFFLKRELVVSDIDKLSISNVPPESIRFFVHIALEYMFTLWICFLLYKEYDNIASMRLHFIASQRRRVEQFTVLVRNIPRMPDHAVSDSVNGFFQTNHPDHYIGHQAVYNANKFAKLSKRRDRLQNWLDYYQLKFERHPDKRSTVKTGFLGLWGGKVDAIEYYKHAIKELDNLMTSERQRVIKDPKAILPVAFLSFNSRWGASVCAQTQQSKNPTLWLTDWAPEPRDVYWRNLAIPFVSLSIRKLVITLSVFALVFFYMIPIAFVQSLANLEGLEKVAPFLRPVIELNFIKSFLQGFLPGLALKVFLYILPSVLMIMSKIEGYTALSTLERKTAAKYYYFMLVNVFLGSIVTGTAFQQLHAFLHQSPTQIPRTIGVSIPMKATFFMTYIMVDGWAGIASEILRLKPLVIYHLKNMFIVKTERDKGKAMDPGSVDFPETIPSLQLYFLLGIVYAVVTPILLPFILVFFAFAYLVYRHQIINVYNQQYESAAAFWPLVHSRIIASMLISQFLLLGLLSTKKAAKSTPLLVILPVLTFAFHKYCQRRFEPAFRKYPIEEAMSKDLLEKSTEPDLNIKAYLADAYLHPIFRSFEVEEELIEIEVDKQQTAAPSSPSTEPSSPSPPHHLDQQLSPPHHIIEPALPPQYNEYPPGYYYQYHPPSPPHYVYQY

SEQ ID NO: 804 - protein, 900 aa, Chlamydomonas reinhardtii
MRNSSTLLRSAFARRGTHLQQQSALWELHRARYSTNDDSNREEGGLLNKIWRAGLGQKPKDSSSSSSSAAGGSSSSSSSSRSSGASSGDALVPSGPERRHHKVFVVELSRKPLFPGIYTPVIISKNEALVKEIMDVKKQGAHAYVGAFLKRPEPPLGMTAAAAVAAAGETEVRDAASHLYDIGTFAQVHTVLAGDSADSAQLLLLGHRRIRKTGVISADPLRVHVDHLRDESYTSDDILKATSMEIVNTMRDLLQLNPLYGEQFRTLLSLTGSIDLQDMSRLVDAAASLTSADDTTLQTVLETLNVPERARLVLGLLKKEVELCKLQADIREQVEGKIVKEQRRMLLMEQLKSIKKELGLERDDKSALLQRFQARWDERKALAPPDVARAVQEELDKLGGLEPVSPEFNITRTYLDWLTSLPWGATTQELFDLVRAKKVLDDDHYGLEDVKDRILEFIAVSHLRGSAQGKILCLVGPPGVGKTSIGRSIAHALNRKYYRFSVGGLHDVAEIKGHRRTYVGAMPGKLVQCLKSTQSSNPLVLIDEVDKLGRGHSGDPASALLELLDPEQNAAFTDHYLDLPLDLSKVLFVCTANSLDTIPGPLLDRMEVIRLSGYAQDEKRAIARRYLEPAAAADAGVPPGSVSLADDALEALIGEYCREAGVRNLKKHVDKVYRKLKDYVGQAPFAKDKFYESTPPGVVMGLAWTPLGGATLYVEAARVAGSEARGSLTTTGQLGDVFRESATIAHTYARNFLAARIADGTIPAGAAAGALHVHVPAGATPKDGPSAGCTLVTALLSLALDRPVRPDLAMTGEVTLTGCVLPIGGVKEKVLAARRSGVKVVVFPEGNRPEYEELAEDIKQGLEPHFVSSYDQVFKLALEHDSGSGNADKAKQEAPLSTSA

SEQ ID NO: 805 - protein, 396 aa, Gossypium hirsutum
FDDACILDMDYFVKTISGIKAKGVRPDLVGSIIAHYASKWLPDLSGNDTEKGPMSLQESSPESVTVSRMKKRFFVETLVGILPPERDSIPCNFLLRLLRTANMVGVEPSYKAELEKRISWQLDQASLKELMIPSFSHTCGTLLDVELVIRLVKRFASLDEGTRSGIAVVKVAKLVDSYLAEAALDTNLSLEDFIALGAALPSHARAMDDGLYRAIDTYLKAHPGVSKQDRKVLCRLIDSRKLSPEASLHAAQNERLPVRAVIQVLFCEQSKLNRHVDWSGSFNGTRSPNPAGLEAPVRCMSKREMNAQQMEIKKLKEELLRVQSQCVAMQMQMEKLVDKKKGFFRWKKLGIMPSLKSSVSVFEKIEEEREANFGRQTPIDIKSKPVRPPKWRKSMS

SEQ ID NO: 806 - protein, 489 aa, Setaria italica
MYMYLFGCSNEYLAGPAGISVRPDSSAACLFQKVGARSNSLPGAAPVQVRRCHNKARNGQAIRCAMATGKEQGAVTTTSSDQHKGGLRGKLNKVVLAYSGGLDTSVIVPWLRENYGCEVVCFTADVGQGAIELEGLEKKAKASGACQLVVKDLREEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVAPENAPSEPEYLEIGIIAGVPVSINGRDLSPASLLAELNEIGGKHGIGRIDMVENRLVGMKSRGVYETPGGTIMAAAVRELEALTLDRETMQWKDMVALKYAELVYAGRWFDPLRQSFDAFMENITATTTGSVTLKLYKGSVNVASRKSPYSLYREDISSFENGEIYNQADAEGFIRLYGLPTRVRAMLEKGI

SEQ ID NO: 807 - protein, 330 aa, Setaria italica
GVFRVELASSSEWRDGKPVLLHHGWAGIGKGAAEARPELHLRVKMEADPRYIFQFDDEVALNPQVVQLHGSSRQPIFSCKFIRDRRRPSQGDGQYWSSSGGSEETDMEMAMRRERKGWKVVIHDLSGSAVAAAFMATPFVPAPGGDTVARSNPGAWLIVRAGTTGSSDSWQPWGRLEAWRESSSSAPAASSRDTVRLRLHLLPDGQDDCVLVSEAPLGSDKGGEFSIDMDRQAPAPVPAAAAAAGHCAVSLGAACAGGGFVMSCKVEGEARSSRPFVQLAMRHVTCMEDAAMFVALAAAVDLSVKACRPFRRKPGKKAASPSPDPLELDT

SEQ ID NO: 808 - protein, 482 aa, Setaria italica
GRRHPPPHPKSPAAAARSAPAPRLRPPPPILRTGAPRPTQRLDLRSSGRQREVGAASAFANNSTGPMEQEDESEGAAAEQPADEAEEQLADDLLLHFERVLHSDPLIDEVGFLHPTQFGSLGCGQDGDSASQAPEFQHRYFWCRDHKLAICSEILPKLYRAARDAYYNTRNAPSQAVHLMSLTKVLLILCPDMLTAWNSRKMVLSEKYDLTKLKDELQLCALILSYSPKNESTWSHRRWVLKQVAEQNQDMAQLVEKESVLVKEIAERSKMNYRAWRHRCWLIPYMTRKQVLDELKKSTRWSELHVADNCCFHYRRSLLLALLDSCLGNGEDSVSWESETCMLWKDELRWNEMLIRRYQGRESLWNHRRFLSQWWIRQLFSVEETCPSTTSQVDLFITQEIGLLSECLNDPADEFGESCVQAELSALYILWISKQVPAVKGKLEERLHSVSIVGLKDVLVRACRPEKRWLWMNLLGLPDRSQ

SEQ ID NO: 809 - protein, 339 aa, Setaria italica
SSLSLQTVSLFLSRARQGVLGRREGAMASGCGGRRGRKPRARARGKGKKTRYLSLSDVLIKVEAEAGTPPRSQEDEPAPVWEEAEVKQEDAGDGGGQQQPPQQVEPFALHNEASTLFAALPAPSLSDILGASAGGGDGDESPSPSASPDGGSGGSELPCAQEEDLARRALRGRERWVYCSSGSSPTATTATTSSSSPCSSAASTGASVRSLLLKLDYGEILAAWADRGSLYIGGGGGGADSDAAPELELNAVLVEVEPPEHAASAPPPPAPAAFAWTAAETEAAGRERAEKVRRYKEKRRNRLFAKRIRYEVRRVNAVKRPRFKGRFIKEHEDIKLQPT

SEQ ID NO: 810 - protein, 385 aa, Sorghum bicolor
MGELIPGLPEEVARECLVRVGFDQLPVVRRISRQWKSEVESPDYHRQRRAEGLARPVLALVQAQPTAPPADDAGPVADKHSTAAAAGSGGGPANSYRMVLLDPVEGRWAPLPPLPGPSESLPLFCQVAAVDGGQGRRKRLVVVGGWHPETWAPTDAVFVYDFLTGAWRRGAPMPGPRRSFFACAAVGGAVYVAGGHDDEKNALRSALAYDPEADAWAQLPDMAEERDEPRGLCVAGRFFLVVGGYPTQAQGRFVGSAECFDPATSAWAPVDDLVEDGVCPRTCCAAPPGSGSERMYMLSRDGHLVARDGGAAWRPVAQVPEDARTAATVSVIPDDRVVVIGSGCHGGDQTVYVLREEAGKGASWTRAAAPPEFSGHVQASCFLEI

SEQ ID NO: 811 - protein, 737 aa, Helianthus annuus
RNDDQNMPIKSSSIVSLINPTDSNANASAKGIQILTRAQTSHPLDPLSAAEIKVAVATVRAAGATPEVRDGMRFVEVVLSEPDKTVVALADAYFFPPFQPSLLPRKGGAIIPSKLPPRRARLVVYNKKSNETSIWIVELSEVHATTRGGHHRGKVISSKTIRDVQPPMDAVEYAECEEVVKDYPPFQEAMKKRGIEDMDLVMVDAWCVGYHSEADAPSRRLAKPLIFCRTESDSPMENGYARPVEGIYILVDMQNMVVLEFEDRKLVPLPPADPLRNYTPGHTRGGVDRSDVKTLQIIQPDGPSFRVNGQYVEWQKWNFRIGFTPREGLVIHSVAYVDGSRGRRPIAHRLSFVEMVVPYGDPNDPHYRKNAFDAGEDGLGKNAHSLKKGCDCLGYIKYFDAHFTNFTGGVETIENCVCMHEEDHGILWKHQDWRTGLAEVRRSRRLTVSFICTVANYEYGFYWHFYQDGKIEAEVKLTGILSLGALQPGEVRKYGTTIAPGLYAPVHQHFFVARMDMAVDCKPGEAYNQVVEVNVKVEESGKNNVHNNAFYTEETLLKTESQAMRDCNQLSARHWIIRNTRTVNRTGQLTGYKLVPGSNCLPLARPEAKFLRRAEFLKHNLWVTPCALDENFPGGEFPNQNPRVGEGLASWVKQNRSLEETDIVLWYVFGITHVPRLEDWPVMPVEHIGFMLQPHGFFNCSPAVDVPPGACESDVKDTEHKETIASKPVSNGLIAKL

SEQ ID NO: 812 - protein, 189 aa, Helianthus annuus
MFIVFVCTRLICARIHYISSRRSFRMSSRSDLNAMERGMRGAETFVAASFPTKKYSDPFFSCSKDAQCIVCLSEYHADDTLRILPSCGHFFHSSCIDIWLQQHCTCPVCRVSLREVFDKRCLMQPMFSSAVRFPSSADDSRRMDPTTNGQPRSTGNVQEAGLHNSNVSENVPAGSKSPGNKQFESPSDV

SEQ ID NO: 813 - protein, 644 aa, Triticum aestivum
MSRNLKNPVQTQMAVSALSSSLIGDYPSKTRSEGKAVGWKRVFVQTDTGFVLPVQLDRGDSVHTVKRKLQVALNVPTEESSLTLGDHVLKNDLSSIRNDSPLLLTKTFMHRSSSSPCLSPTSKDLQQQRDRGGPIEVLVCPTRCIQAKQLVKDVARAIRNGVDPKLVNSGLGGAYYFKNSKGENAAIVKPNDEEPFAPNNPKGFTGRALGQPGLKRSVRVGETGFREVAAYLLDYDNFANVPPTVLVKISHPVFNVNEGVGSTNKKASVGDPRTVSKIASFQQFAPHDFDASDLGTSSFPVAAIHRIGILDIRIFNTDRHAGNLLVRKVTGADQFGNQTELIPIDHGLCLPECLEDPYFEWIHWPQASIPFSEDELEYIGKLDPVKDAEMLRMELPMIREACLRVLVLSTIFLKEGTLFGLCLAEIGEMMSREFNGMDDQPSQLEVVCMEARRLATEREECSTEHDSADEDVTQFELDCEDHEMPKTPPAYHFEFKGGSSRNPLSKLEEAIEEEEDDIQEEEESNAEKLACPKPVNKWLPNISKLSTSLSSVSLMDKSQRQVPAIPKGADSVKTSENSQVGNWRTANEQLPTSASFVKLADMGVDTWGLFLEKFQELLPGAFRAHKLGATGQRGRLRMGTSCQF

SEQ ID NO: 814 - protein, 1135 aa, Sorghum bicolor
MDPKPLSRWWKHELAAGQARLLAGAKGGEAAAAGVRGSALRKGTKRKGSRSNSTGERARKRRRVLQFRSFLSNKERTAKPQSTFRLHEQKLHMAMLRKHKSSTVHTSTVLEPRKKLEEACDRMPTHENSVKKRHRERTDPSSEMNSDLYGIKEVTSSVNKQVIEVNGSTNKPTNTGHEMVKTSTGPKDDIFGDLPLLELESSKVMFRTGVHELPTVIEESFITNQTEADSIPEVVPLELIDASDITAQTPSPLEDLVKSEDSEPACISHNDVAGSHPSTVGIDGLPNHKNINMVKPGLGDMQLKFTDVSALGSHSVLRSKSGSGYPLQGCFDVNKNCSQEIKKHGTNSTSSPPAMRTRTEETKYKDAPVKGKKSTDITSAAVALPVPANQLSYQASALPSAVSHSVFSTRVDSNDMSSFRSMPAKECIPTTRPGNLRTNVCHGSRKHVDPCVALSTDNQGSSHSKLHPICSPANIGMTFMKLPGLERMEISNCNVKIGENRFSNAESMNAVRYQKQPWLSGMTYVMQGQKQIGLSSSQVGKPALDGYGGEGDHHLQQPTVRLMGKTVSVCSHSKDHNVSTMDQVSPDNVAIEASRLSTISCQLPQKRSFPCQDSVTPRVHLNNSSDFLARIPNNSMQGQNTAFSGLHNQRPQPINSAPTVKDCTWNFGNQFVRQAELNKAAIVSTNSQTRHLELHQPPQLISIPQNQQSHLWTPAAQMSRKDQCFVGPAVNQSSLVPKSLLTASMKEKYQKSTLLSYDDPSSMPICQPYQIPGANSSSASVTSFFEYGADNSLSRSSSPGLSLSLATGLANESVSTGRVACAGSLTNADGRKAASFAEPISNSSAYADNVSQQPAKPISNRTAYATDNVSQQPAKRQLVTDTQDLMSMGPNIVNHSPGWSLSDAVGPQVLDFSKRIARDAVQTSRNESNNPRASSGPVPPIETWSRPGLVAGANTMLKPVRISKRGDQETLEQSGRQQIMGVLGTLARNLDALVGPGIMLLYPLYASMRAIESPSSLDDQQWLTYWVLYSLITLFELSCWKVLQWFPLWPYMKLLFCCWLVLPIFNGAAYIYEAHVRRYFKIGNYVSPIYNERQRRVLQMMSLDARKSVERFIETHGPDALDKIIRAAEEEAKRT

SEQ ID NO: 815 - protein, 809 aa, Zea mays
MKGAMPPRQFMVPGPGGPMLPPQQQFGLVETRPPLAAVLRPRFNIPGLHPSAAAAAAASGAGKIASTYDLVEPMRFLYVHVVKARDLPAVSATGAIDPFVEVKLGNFKGTTPVRAASHNPSWQQVFAFSATHLQSHLLEVALKAKDLAGDDLVGRVAFDIAEVPVRVPPDSPLAPQWYRLETKRGEKLPHGEIMLSVWLGTQADEAFPDAWHSDAHAAAGPAAVASTRAKVYFSPKLVYLRVAAIAAQDLIPHDTSRPMSACVKLQLAGQLRRTRPGAPPGTPNPIWNEEFMFVASEPFDEPLVVTVEDRVAPGRDEMLGRIFLPLAAAMPRHDHFGKPVEPRWYSLMRPSDDPDKKEVKFASKIQIRMSLDFGYHVLDESTYYSSDLQPSSKPARKPSIGMLELGVLGARNLVPMKPKDGRTTDAYCVAKYGPKWVRTRTILDTLNPQWNEQYTWEVFDPCTVITVVVFDNGQIGSKNGGGPDQRIGKVRIRLSTLETDRVYTHFYPLLVLNPSGLKKTGELHLAVRFTCTAWVNMMALYGRPLLPKMHYTQPIAVMQLDYLRHQAMQIVAARLSRAEPPLRREVVEYMLDVDSHMFSLRRSKANFHRITSLFFGFLAMLKWYDGIRSWWNSITTVLVHMLFLILICYPELILPTIFLYMFMIGLWNYRFRPRHPSHMDTKLSHAELTHPDELDEEFDTFPSSRPAEIVRMRYDRLRSIGGRVQTVVGDLATQGERAHALLSWRDPRATAIFVFLSLVVAVVLYVTPFQVLMVIGMLYLLRHPRFRSRMPSVPFNFYRRLPARSDMLL

SEQ ID NO: 816 - protein, 498 aa, Zea mays
MAPPISADALVEAASAVAAYPAIAPNRMLCKDAPAPAISVVSKQTVRPAGASAAVGSGDLRLSVSDMPMLSCHYIQKGLFFPPPPPGVLAASLVSSLVAALSRALGVFPALAGRLVTLHDDSIVIRCGGDDAAVEFYHAVAPSLSLGDFLVPGADVPTRLTNGLFPMDRTVSYGGHGRPLTAFQLTVLGDGAVFVGFVANHAVVDGTSFWHFFNTWAGLCRGAPVREPDFRRNFFGDSTAVLRFPGGASPAVTFDADAPLRERILHFSAAAISELKATANRSKRAGQEAEANGKLAHDDSRLEGRSGEISSFQSLCAHIWRAVTRARRLLAADKTTTFRMAVNCRHRLRPAISPLYFGNAIQSVATTATVAELASNDLGWAAARLNATVASHKDGAIRRAAAEWEAAPRCFPLGNPDGAALTMGSSPRFPMYDGNDFGWGRALAVRSGRANKFDGKMSSFPGQAGDGSIDVEVCLAPDTMAHLLLDKEFLQYVSSPAP

SEQ ID NO: 817 - protein, 627 aa, Hordeum vulgare
MASSSAKPYCCSSLNPAHSTPVAGRTALSTLPAAKPRRFSHGLAAVAANPRASRTAVLRSVHACLAAPRRPEYVPDRIDDPNYVRIFDTTLRDGEQSPGATMTSAEKLVVARQLARLGVDIIEAGFPVSSPDDLDAVRSIAIEVGNTPVGEDGHVPVICGLSRCNKRDIDAAWEAVRHARKPRIHTFIATSEIHMQHKLRKTPDQVVAIAREMVAYARSLGCPDVEFSPEDAGRSNREFLYHILEEVIKAGATTLNIPDTVGYTLPHEFGKLIADIKANTPGIENAIISTHCQNDLGLASANTLAGAYAGARQLEVTINGIGERAGNASLEEVVMAIKCRRELLDGLYTGINSQHITMTSKMVQEHSGLHVQPHKAIVGANAFAHESGIHQDGMLKFKGTYEIISPDDIGLTRANEFGIVLGKLSGRHAVRTKLVELGYEINDREFEDFFKRYKEVAEKKKRVTDEDIEALLSDEIFQPKVIWSLGDVQATCGTLGLSTATVKLITLDGEEKIGCSVGTGPVDAAYKAVDQIIQIPTILREYSMTSVTEGIDAIATTRVVITGDVSANKYALTGHSNRSFSGSGAAMDVVVSSVRAYLSALNKMSSFVGAIKASSAAPETLSAQTTE

SEQ ID NO: 818 - protein, 513 aa, Hordeum vulgare
MGLSSAADIDGAQLCIFDLRRGQQEGQELDKILFFHPADCPILLQLSVIGLCEGIITFTRIFSPEDDCEVIESDKHSHVFYQAEPDIWMVLVVQKIKDNESTLRFGALQGILKESHSLFAMFHGPIRTLLDRQPSAEFARGHLHTFVTDYLSDFSVGKKLQLPTYRDSLTERGTVQMLTVSREVALEVQSLTTVLGSCLRNVICQSIVLFEDLLVSTTLPLDDTLNLYTYAILRLTPSALSSNGNSWSYLRKGGYVNADTTLSSANGAAAAERYHSRSRDTSPGGQNQMHHNFRPLQREKLSKGKDGFVAADFATTEIRGAVPLNPILWFHQAEERMYLCVYQHKNLTILLVIPASSLINGEEGIAHVKRHLLENASQNIVSVEQKLSRGWGGENAYHVGGYRYILSDPNRKVSRASPPGKVITLSKDSLLALNRLRGEVDLEKSRAKRSDPTHDKDYEVCIRAKNNAWIIAKISRGKELYMAIEKGGETLLYASTAVEKFSNRYCEGAFSTD

SEQ ID NO: 819 - protein, 151 aa, Hordeum vulgare
MSIVRRSNVFDPFADLWADPFDTFRSIVPAISGSNSETAAFANARMDWKETPEAHVFKADLPGVRKEEVKVEVEDGNVLVVSGERTKEKEDKNDKWHHVERSSGKFVRRFRLPEDAKVEEVKAGLENGVLTVTVPKTEVKKPEVKAIEISG

SEQ ID NO: 820 - protein, 180 aa, Hordeum vulgare
MEEGKQGFQPHLMGGGGRMRGAAGAMGLQKQNSWSPDIERDEAWERRRRGILGRGRRSPLQRAQSVTDDQLDELRGSLDLGFRFDPPSQRCAACDAGRSRLVETLPALDLLYAVNANANAKAKAGCAASQCSCGASSEASEPSPIGSPLSILSPDDPPETVKMRLKQWAQVVALSMRSRS

SEQ ID NO: 821 - protein, 299 aa, Phaseolus vulgaris
MFRSGMELFHRAKVVRLRSHHDKYLLADEDEESVTQDRNGSSRNAKWTVELIPEFDNLLRLKSCYGKYLTASNQPLLLGVTGRKVVQSVPRQLDSSVEWEPVRDGAQVKLKTRYGNFLRANGGLPPWRNSVTHDIPHRTATQDWILWDVDVLEIHVESPAPPPIPHSDSLDFDSYTPSAVSIKSTAFSRQESTDSNVGSPPKLEGRTIYYHVAEDNGDVDDENVQGYSLTFKGNGVEQLTLKFVEETGLEGVIVCTRSPLNGKLYPLRLQLPPNNVTMQVVLVLPSSKVARDFEEQGLL

SEQ ID NO: 822 - protein, 77 aa, Phaseolus vulgaris
MGLWTLLEGFLLLANALAILNEGRFLAPRGWGFTDFSGGRTKSFKGQLIGLIYATQYLRVPLILLNSICIILKFVSG

SEQ ID NO: 823 - protein, 857 aa, Phaseolus vulgaris
MATLADIGVSATINILSAFAFLLAFALLRIQPVNDRVYFPKWYLSGGRSSPRSSGNFVGKFVNLNFRTYLTFLNWMPQALRMSESEIISHAGLDSAAFLRIYTLGLKIFVPITVVALLILIPVNVSSGTLFFLKRELVVSDIDKLSISNVPPESIRFFVHIALEYMFTLWICFLLYKEYDNIASMRLHFIASQRRRVEQFTVLVRNIPRMPDHTVSDSVNGFFQTNHPDHYIGHQAVYNANKFAKLSKRRDRLQNWLDYYQLKFERHPDKRSTVKTGFLGLWGGKVDAIEYYKHAIKELDNLMTLERQRVIKDPKAILPVAFLSFNSRWGASVCAQTQQSKNPTLWLTDWAPEPRDVYWRNLAIPFVSLSIRKLVITLSVFALVFFYMIPIAFVQSLANLEGLEKVAPFLRPVIELNFIKSFLQGFLPGLALKIFLYILPSVLMIMSKIEGYTALSTLERKTAAKYYYFMLVNVFLGSIVTGTAFQQLHAFLHQSPTQIPRTIGVSIPMKATFFMTYIMVDGWAGIASEILRLKPLVIYHLKNMFIVKTERDKGKAMDPGSVDFPETIPSLQLYFLLGIVYAVVTPILLPFILVFFAFAYLVYRHQIINVYNQQYESAAAFWPLVHSRIIASMLISQFLLLGLLSTKKAAKSTPLLVILPVLTFAFHKYCQRRFEPAFRKYPIEEAMSKDLLEKSTEPDLNIKAYLADAYLHPIFRSFEVEEELIEIEVDKQQTAAPSSPSTEPSSPSPPHHLDQSFPSHHLHIPSPPHHLPELSALHHLPQLSAPHHLPQLSPPHHLPQLSPPHHLPQLSPPHHLPQLSPPHHIIEPALPPQYNEYPPGYYYQYHPPSPPHYVYQY

SEQ ID NO: 824 - protein, 407 aa, Gossypium hirsutum
MKSVFSAPGDYIYFKSQVPLHRIPIGTKQWRYYDFGPKVVTPLICLPGTAGTADVYYKQIMCLSMKGYRVISVDIPCVWNHQEWIQSFEKFLDAIDVHHIHLYGTSLGGFLAQLFAQHRPRRVKSLILSNTFLETRSFAAAMPWAPFVSWTPSFLLKRYVLTGIRDGPHEPFIADSVDFVVSQVETLSRDELASRLTLTVDSASVKPLLLSDSFITIMDTNDYSAIPQQLKDQLSERYPGARRAYLKTGGDFPFLSRPDEVNLHLQLHLRRVGLEAQPELVQSIPKDGTGGGPSKENDKEDRDDEQKDNGGNPESNSEESQPSPSAPESSESHGLDEQLLSNAEIHYINQKDSIILKPSAMSLNQHSAAAGILLQSTWEFFIFSLLPLYVDSLYIYSNNAWKLRQLV

SEQ ID NO: 825 - protein, 612 aa, Gossypium hirsutum
MEGSVEEMAKAVSDLALDSSAAGEAQSKNARKKELKNKQREEERRRKEEEKAAKQAAAKAGTQSQKHAAAEDEDMDPTQFHENRLKFLAAQKAEGKNPYPHKFFTSMSIVEYIEKYGSLGNGEHIEDATVSLAGRIMSKRASSSKLFFYDLHGGGAKVQVMADASKSGLDEAEFAKFHSTVKRGDIVGVTGFPGKTKRGELSIFPMSFLVLSHCLHMMPRQKAGPDASVKKTDVWIPGSTRNPETYILKDQETRYRQRYLDLMLNLEVRQIFKTRSKIISYVRSFLDNLDFLEVETPMMNMIAGGAAARPFVTHHNELNMKLYMRIAPELYLKELVVGGLDRVYEIGKQFRNEGIDLTHNPEFTTCEFYMAFADYNDLMELTEKMLSGMVKELTGSYKIKYHANGLDSAPIEIDFTPPFRRLDMVEELEKMANLNIPKPFSSDETNKYLADACEKLEIKCPPPQTTARLLDKLVGNFLEETCVNPTFIINHPEIMSPLAKWHRSKPGLTERFELFINKHELCNAYTELNDPVVQRQRFAEQLKDRQSGDDEAMALDETFCTALEYGLPPTGGWGLGIDRLAMLLTDSQNIKEVLLFPAMKPQDEPSTKAPAT

SEQ ID NO: 826 - protein, 187 aa, Gossypium hirsutum
MRIPNLTKAFILLMAITLMSTQASGLIPYGRSLWDVMLAEDPFKILEQTPVTVPKGSEPVALARADWKETPRYHAITLDIPGMKKEDLKIEVEENRVLRISGERKEEAEIEGEKWHRAERTNGKFWRQFRLPANVDMDRIKAHMEDGVLRISVPKIVDENKKQAKVIDIVQSGGTGEDIKATSQGHQ

SEQ ID NO: 827 - protein, 554 aa, Gossypium hirsutum
MASQVSQMPSSSPLSSNKDEIRPKADFQPSIWGDFFLNCPDKNIDAGTEKRHQQLKEEVRKMIVAPMANSTQKLAFIDSLQRLGVSYHFTKEIEDELENIYHNNNDAENDLYTTSLRFRLLREHGYNVSCDVFNKFKDEQGNFKSSVTSDVRGLLELYQASYLRVHGEDILDEAISFTTNHLSLAVASLDHPLSEEVSHALKQSIRRGLSRVEARHYLSVYQDIESHNKALLEFAKIDFNMLQFLHRKELSEICRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMEQLVPEHGRQYRVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVSAQEAYDVFNKHVESAWKDVNQEFLKPTEMPTEVLNRSLNLARVMDVLYREGDGYTYVGKAAKGGITSLLIEPIAL

SEQ ID NO: 828 - protein, 355 aa, Gossypium hirsutum
MEGLMQVPYDVTVRFMLTFLERNLLPDAIIRRLTRLLLASRLRSGYKPSTELQLSDLLQFAHSLKEMPIAIKTDKPKTQHYELPTSFFKLVLGKNFKYSCCYFSDESKTLEDAEEAMLELYCERSQLKDGQTVLDVGCGWGSLSLYIARKYPNCRVTGICNSTTQKAFIEEQYQDRQLQNVEIIVADISTFEMEASYDRIYSIEMFEHMKNYHDLLKKISKWMKEDSLLFVHYFCHKAFAYHFEDINEDDWITRYFFTGGTMPSANLLLYFQDDVSVVNHWLVNGKHYAKTSEEWLKRMDRSLASIKPIMESTYGKDQAVKWTVYWRTFFIAVAELFGYNNGEEWMVAVFLFKKK

SEQ ID NO: 829 - protein, 421 aa, Gossypium hirsutum
MLNKLALPESSTFPGKPMPPTAECWFDDACILDMDYFVKTISGIKAKGVRPDLVGSIIAHYASKWLPDLSGNDTEKGPMSLQESSPESVTVSWMKKRFFVETLVGILPPERDSIPCNFLLRLLRTANMVGVEPSYRAELEKRISWQLDQASLKELMIPSFSHTCGTLLDVELVIRLVKRFASLDEGTRSGIAVVKVAKLVDSYLAEAALDTNLSLEDFIALGAALPSHARAMDDGLYRAIDTYLKAHPGVSKQDRKVLCRLIDSRKLSPEASLHAAQNERLPVRAVIQVLFCEQSKLNRHVDWSGSFNGTRSPNPAGLEAPVRCMSKREMNAQQMEIKKLKEELLRVQNQCVAIQMQMEKLVDKKKGFFRWKKLGIMPSLKSSVSVFEKIEEEREANFGRQTPIDIKQKPVRPPKWRKSMS

SEQ ID NO: 830 - protein, 233 aa, Gossypium hirsutum
MGNSIGGRNKAKVMKIDGETIKLKTPIRVWDVLKDYPTGHVLLDSQTVKHYGIRAKPLEPQESLKPKKIYFLVELPKLADDEVHKAPRRVRSGGIHMSAKDRLECLMLSRRTVSDLSMVRPSSTSMVPDGVRLGGGGGTSGGGMMTVKMRLPKSQMAKLMEESKDGVEVAEKILDLYTGNGGSGGDEAGNRIHREAPWKPGLGTVGENFKPKREKRVSFIPQEEGEIHLANHL

SEQ ID NO: 831 - protein, 483 aa, Setaria italica
MASAGGPSGVVGISVRPDSSAACLFQKVGARSNSLPGAAPVQVRRCHNKARNGQAIRCAMATGKEQGAVTTTSSDQHKGGLRGKLNKVVLAYSGGLDTSVIVPWLRENYGCEVVCFTADVGQGAIELEGLEKKAKASGACQLVVKDLREEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVAPENAPSEPEYLEIGIIAGVPVSINGRDLSPASLLAELNEIGGKHGIGRIDMVENRLVGMKSRGVYETPGGTIMAAAVRELDALTLDRETMQWKDMVALKYAELVYAGRWFDPLRQSFDAFMENITATTTGSVTLKLYKGSVNVASRKSPYSLYREDISSFENGEIYNQADAEGFIRLYGLPTRVRAMLEKGI

SEQ ID NO: 832 - protein, 530 aa, Setaria italica
MSAAQQAEPTTSPASPTPAGAGSTTVIKNARHRPSALKLCYHVAISNLPYLLLAPFAAALFVRLSRHSPADLAAALTSNPPLTAALAALAAVLVTIYLARRPRAVYLLDFACYKPGPEHVVTRETFMRQSTAAGVFTGDNLAFQRKILERSGLGQETYFPRAVLNAPPNPCMAEARAEAEAVMFGAIDQVLAKTGVRARDIGVVVVNCSLFNPTPSLSAMIVNHYKLRGNVASYNLGGMGCSAGLISIDLAKQLLQVHRNTYALVVSMENITLNWYWGNNRSMLMSNCLFRMGGAAVLLTNRGGADRRRAKYQLMHTVRTHHGADDRAYRCVFQEEDETGRVGVALSKDLMAVAGEALKTNITTLGPLVLPMSEQILFLASLVGRKVFGLRSLKPYIPDFKMAFEHFCIHAGGRAVLDTIEKNLELSAWHMEPSRMTLYRWGNTSSSSLWYELAYTEAQGRVRRGHRAWQIAFGSGFKCNSAVWRALRTIDPAKEKVGNPWVEEIHRFPVEVPKVESVVVAPAAAAAAES

SEQ ID NO: 833 - protein, 546 aa, Setaria italica
MAAALQPRRARLLLFLGLLLHALARGAVEAAAPFRARDVLPLLPRRLAWQLMGATAHSAVDLLPSFVGAVAPGGAPAAWRGACFAENEAVLSLTPGAGAGAAGRNGTGGALHGNTSSGLGGAVLHLKTASPESWTCMDLYVFATPYRIAWDYYMRSNENHTFEIKTWEEAAELEYVKQHGIAVFLMPSGMLGTLLSLIDVVPLFSNTGWGQDANLAFLQKHMGTSFQKRSQPWSANIRKEDVHSGDFLALSKIRGRWGGFQTLEKWVTGAFAGHTAVFLKDENGTLWVAESGYENKKGDEIISMTPWDEWWGMALKDDSNPQIALLPLHPDVRARFNESAAWDFARSMYGKPYGYHNMIFSWIDTMSDNYPPPLDANLVMAIMSMWTRLQPHYASNMWNEALNKRLGTEKLDLHGIITETERRGLSFNQLLTIPERDDWEYSDGKSTTCVAFILSMYKAAGVFAPFTESIQVTEFTIRDAYMLKVFEDNQTRLPGWCNAAADRLPFCQILGEYKMDLPEYNTIEPYANMNENCPSAPPTYSRPARC

SEQ ID NO: 834 - protein, 514 aa, Gossypium raimondii
MAGGEQKKGGGEQKKAGGGGKKKEVKKETGLGLSFTKDENFGEWYSEVVVNGEMIEYYDISGCYILRPWAMSIWENMQTFFDAEIKKMKVKNCYFPLFVSPGVLQKEKDHIEGFAPEVAWVTKSGESDLEVPIAIRPTSETVMYPYYSKWIRGHRDLPLKLNQWCNVVRWEFSNPTPFIRSREFLWQEGHTAFATKEEADTEVLQILELYRRIYEEFLAIPVTKGRKSELEKFAGGLYTTSVEAFIPNTGRGIQGATSHCLGQNFAKMFEINFENEKGEKSMVWQNSWAYSTRTIGVMVMVHGDNKGLVLPPKVAALQVIVIPVPYKDADTQGIFDACAATVAILSDAGIRAEADLRENYSPGWKYSNWEMKGVPLRIEIGPRDLANNQVRAVRRDNGEKTDISRVFLVEQVKGMLEKIQQNLFDVAKQKRDACIEVVKTWDEFIKALGQKKLILAPWCNEEEVEKDVKARTKGEMGAAKSLCTPFEQPELPEGTKCFASGKPATKWTYWGRSY

SEQ ID NO: 835 - protein, 458 aa, Gossypium raimondii
MVGLGDNNNPSCQNNISSKAKDKKKNKKKKRGGSKRKMTAEQTSAFKSVTEWVYLDRHHHPNSSSTAGLSSWVVDDFGVQKSLGRGTEKMVFELHSHSKHSDGFLSPSKLVERAHGNGVKVLALTDHDTMSGITEAVEAARRFGIKIIPGVEISTIFSPRNPEMEEPVHILAYYSSCGPTRYEELDKLLANIREGRYVRAKDMVLKLNKLKLPLKWEHVTKIAGKGVAPGRLHVARAMVEAGYVENLKQAFARYLYDGGPAYSTGSEPLAEEAVQLICETGGLAVLAHPWALKNPIPIIRRLKDAGLHGMEVYRSDGRLAAYNDLADTYNLLKLGGSDYHGRGGHGESELGSVNLPVVVLHDFLKVARPIWCSAIKDILEGYAKEPSDTNFAKIARFTRMGSFKGSTPLSCGKDLIDRCLASWLTAEEQQNDEFEAIRLKLSHATINLSGVQVPIETK

SEQ ID NO: 836 - protein, 808 aa, Gossypium raimondii
MDGWLKGSNSFVDRVGLNDSTVLALSGRDFDNRFKNENCVDIPSSEPVMIPGNSGNMVSSFGTCSDRVGLNDGTVLALSGRDFDSRFKNENYVDVLPLEHVMVPGNLVPSFGTCSDTVGLNVDSQPVPIPGNSVPSSSVNEGDLHEDFDFSDEVLKYISQMLMEEDMEDKTCMFKESSAALQAAEKAFYEVLGERYPPSPEYDADQNQESSDESHGQNCWRCSSASISSGSVVDPGHNHDFGEQRALNFPSQASSSHSSGNSIGSMVDGYADSPVSTVRLPEIFNNSESAIQFRKGFEEASKFLPNGGSLFVHGENDGLFLKELKEETKDVAVDKVEKDEISQDGSRGKKNPYPEDLSLECGRSSKQSLVYTESAVSPEMFDMVLLNCQSVTELQKVLQDETSKNVQQNGQLKGSNGGKARGKKHGGKKNMVDLRTLLTLCAQAVAADDWRSANELIKQIRQHSSPMGDGMQRIAHYFIDGLEARLAGSGTQIYTALITKPTSAADVLKAHHLFLAACPFKKLSNFFSNKTIMNLAENAARLHIIDFGILYGFQWPCLIRRLSSRPGGPPKLRITGIDLPQPGFRPAERVEETGRRLANYAETFKVPFEFHAIAQKWDTIQIEDLGIDRDEVLVVNCMYRLRNLLDETVIVESPRNKVLNLIRKMNPDVFILGIVNGAYSAPFFITRFREALFHFSTLFDMLETNVPREIPERMLIEREIFGWEAMNVIACEGAERIERPETYKQWQMRNMRAGLRQLPLNKEIMKIAKERVDTGYHKDFVIDEDNRWLLQGWKGRIVYALSTWVPAP

SEQ ID NO: 837 - protein, 255 aa, Gossypium raimondii
MVSHLVTTIRNVVGITGNVISLFLFLSPVPTFIRIWKKGSVEQFSPAPYLATLINCMVWVVYGLPMVHPNSTLVVTINGTGTAIEIVYLTLFLIYCHDKKKRVKVMLIVLVEMIFIAGVTALVLIIAHTTQRRSMVVGIIAILFNIMMYAAPLSVMKLVITTKSVEYMPFFLSLASFANGVAWTAYAFLPFDPFIAVPNGLGTLFSLAQLLLYATYYKSTKRIIAARQEAKMEMHLSEVVVNGDNNDPKKNSTAP

SEQ ID NO: 838 - protein, 415 aa, Zea mays
MAASNGEGHGRFDVIVVGAGIMGSCAAYAASSRGARVLLLERFDLLHHRGSSHGESRTIRATYPQAHYPPMVRLSRRLWDEAQADAGYTVLTPTPHLDLGPRDDSALVASMRNGGATEVVAGDESSSWPWAGVFRVPDGWTAARSELGGVMKATKAVAMFQALAVKRGAVLKDRTEVVDITSSKRGEGEGSIISVRTSSGEEFHGTKCIVTVGAWTSKLIKSVTGLELPVQPVHTLICYWKVRPGREQELTPEAGFPTFASYGDPYIYSTPSMEFPGLIKIAMHGGPPCDPDGRDWSTGAGDLVEPVARWIDAVMPGHVDTAGGPVVRQCCMYSVTPDDDYVVDFLGGEFGKDVVIGAGFSGHGFKMGPAVGRILAEMALDGEASTAAEAGVDLRPLTIGRFAGNPKGNLSASQG

SEQ ID NO: 839 - protein, 404 aa, Zea mays
MPAADPPVTDAVPDEDAAPRPSPPPPPPRPRPLSLASALPFWFYFAAAVSLLALLLPHLLPPSSPAPLPPLLRGHLAAGRFLKLDPAPGLFAVTSRPTAAAGDSPAHRVLVLPGLAAGSLSFRRVLSSLSSRGVHAAALDLPGQGLSPASPAATAPARTSALREIMNRGVFHAFEHLVQTGEVPYQEEEPAASAARSPHAPDEAAAAVARAAEALGVGPVHLVLHDSALAAGAAFASANPGAVRSVTLVDATASLPAFPAAVFDVPVLGRLVLRVPALFRGLVRLCCVRGVGAEEAEAYRAAMRGEGKAEAVVEAWKSMNHSFQLGEWRVSSEEVRRLPMLVLWSGSWSDMWIDEGKKVAAALPDAKFIYHSGGRWPQVDAFEEISGVITEFVTSAEEAGSSRW

SEQ ID NO: 840 - protein, 131 aa, Zea mays
MASIAGSSALSFARPVKAINTNSLAFSPLRKGNTFLRLQPMPMRSVSCAAKKDTTDKVCEIVKKQLALPDHTEVCGESKFSELGADSLDTVEIVMSLEEHFDISVEESSAQTIATVEDAADLIDKLVAGKA

SEQ ID NO: 841 - protein, 873 aa, Zea mays
MVTEMAARGGEAAAFGAETDRGDFEVFRSGSAPPTVEGALGAAGADGGLLVDDDLRADPAYQSYYYSSAHLNPRLPPPLLSKEDWRSSHHRLRSAGFGGIGDGRRQQQQASAAEGTVGLPGIDLGRQRSFSTIFQEDSYQRDMDRHTASHNSNDLLGSSGIQYGLNRGSGTIGGLHSSNSLRSLDEIQNNDLPSNTFASILGSSLSRSASPDPELVRRAPSPSLPPIGVKVGNTDKKINGGSTSFRRSSSAIGESDDLVAALSGMNLSSRAMSGQTMDQSQLYQDVDNVQKFLFDRQGDQTTGNQQHYMRRPEQGQSKLPDGYSANLANSSTMRNQINAGSFTSFDSLSLGSGFASPRIGSRSPGGTVSSRQNLAGMSNMLNYNGIGSPTASPSLQTSIDPAYIQYLAQLAATCDDPLMDRGHLGNSYMDLLGTHKANIGPLLQSQKQYGYYGNLGFNLGYPGSPLASPVLPSSPIAPGSPLRHGERNMRFPSGMRNFGNSFGSWNSGMGGKMDANLMPSLLEEFKSNKSKSYELSEIAGHVVEFSADQYGSRFIQQKLETASTEEKDMVFSEIMPQALTLMTDVFGNYVVQKFFEHGSTAQIKELAGQLIGRVLALSLQMYGCRVIQKAIEVVDLELQTKMVAELEGHVMRCVRDQNGNHVIQKCIECIPQHAIEFIISTFYGQVVMLSTHPYGCRVIQRVLEHCDDPKTQQIMMDEILQSVCLLAQDQYGNYVVQHVLEHGKPHERSAIIEKLIGQIVQMSQQKFASNVIEKCLVFGNPVERQVLIGEMLGSTSESEPLEVMMKDQFGNYVVQKVLETCDDQQREMILTRIKTHLNTLKKYTYGKHIVARVEKLVAAGEKRLGLQPACTAA

SEQ ID NO: 842 - protein, 374 aa, Zea mays
MARLVSSGIIGKGHNIFDDGGFGEVHADPIKVERPHKRPPQKQNAENGTTTKVDEPKELPKHVCFKGDNGLYLSARMVEGYPYLQFASDDIGDPSVRFTTYNYMIDGKRVIRVKSDHFGKFWRRSPNWIWCDTDDTSTDNRDTLFEVVRVGDDADAVYGLRNLGNNHICHRLTYEGKESCLNASIPSVRKEAQLKIEEAVLLRKIYGVDYHLKDAKILNNKVRTLVTREAVNAGSMPSKNTLTLKYVVSNGKIWDASRSLRLGIKSSFQAGVPEVVTGSITLESEFDTSYIWGENTVNTEEFSTDYEVIVPPHTVITVRILATQGTCQVPFSYTQEDILTTGEKKVTKYEDGIFRGVNSFGFKSEVTERKINGE

SEQ ID NO: 843 - protein, 747 aa, Medicago truncatula
MAVEEGTGGGGTTIIDEIYEFCAPRFFDFLKGESDDDVRRAELWFHTALSYAPSPFMPKIKAGRSITVDTLCDFSEADNMPKVEDSVLESNTRPQSITSKVKEDDRAKEEKLTIVPHMNCTTKKEDAPCCEAEENSSTSLEDGVGKKMSKGEILNTATSTRGSSVEVGKDACTPKPALRKSVNAPSTISKKQQNSKKVSTNTKTRLQSGATKSAAGTPHFTQENQAIKRQKLEGGKTRQILNLKPQTLPHDKSKLGYSSSTSKTQKEDRKVYVRDTPKTPAAPFKSMAEMMKKFESSTRDLPLPNTLSHSKPKLTLTKPKSPEFETNQRVRPARVKSAAELEEEMMAKMPKFKARTLNKKILQTSTLPPMPRSTPQPPEFKEFHLETLARAHQNTDSASKASSEVSHKENSSKPHLTEPKPPLLQTSLRARPPTVKSSLEIEQEELEKIPKFKARPLNKKIFESKGDIGIFCHMKKHVTEPQEFHFATSERFPPSTAVADLFDKLSLKSEPARNTIPRTTTPNPFHLHTEERGAEKEKKLYMELLQKELEEEATRVPKANPYPYTTDYPVIPPKPEPKQCTKPEPFQLESLVRHEEEMQREQEERLRMEREEAQMRKFKAQPVLKEDPIPVPEKVRKPLTQVQEFDLHLNHRAVDRAQFDQKIKEKEVVYKRYREESEAARMIEEEKALKQMRRTMVPHARPVPNFNNPFCPQKTSKTTKPKSPNLRVLQRRRFNGSTTSSPATSMR

SEQ ID NO: 844 - protein, 451 aa, Solanum tuberosum
MSQSLNPNPTYDVIILGASGFTGKYVIREALKFLNVPSSPLKNLAIAGRNTSKLSQALQWASRPNPPPEIPILTANTTDPSSLRDLASQTKIILNCVGPFRLYGEPVVEACADSGCDYLDISGEPEFMERMEVKYHDKAVENGSLVVSACGFDSIPAELGLMFNSRQWLPPAVPNSVEAYLSLESDKRIVGNLGTYESAVLGVANVDKLQELRRSRPKRPRPVIPGPPPPKGPLMDHLKEVGVWAVKLPSADAIVVRRTLSCLAENPHGLPGVNESTEQVERRETFWSSIKPAHFGVKIASKSPLGIVRFIIVGLFIGLFGKTGLWRWLLLKFPSLFSLGWFRKKGPTEDEVASATFKMWFVGHGFSDGSLASQGNMKPDTEIITRVMGPEIGYLTTPIILVQCALILLKERNNLPKGGVFPPGVVFGPTDLQNRLQHNGISFDVISKKTI

SEQ ID NO: 845 - protein, 367 aa, Solanum tuberosum
MVLKVSVLLLFSFLFTASAVRPAPPLEGLLPNGNFEELPKPKDLKKKTVLQGKYALPKWEINGLVEYISGGPQPGGMYFAVSHGVHAVRLGNEASISQTIPVKKGSLYALTFGASRTCAQEEVLRVSVPPQTGDLPLQTLYSSNGGDTYAWGFYATSNVVKVTFHNPGVQEDPACGPLLDAVAIKELFPPRPTRVNLVKNAGFEEGPHLLINSSHGVLLPPKQEDLTSPLPGWIIESLKAVKFLDSAHFNVPFGQAAVELLAGRESALAQIIRTVPKKVYAFTFSVGDAKNGCHGDMMVEAFAAKETFKVPFKSQGKGSFKTVSFKFTAIADRTRITFYSSFYHTKINDYGALCGPVVDEVKVTPVA

SEQ ID NO: 846 - protein, 792 aa, Oryza sativa
MATDANPEAAAPPPQLLVDEGYEFCAPKFFDFVCDETEEEIRAAERWFEASASHAPSPFAPRIKESRAEVKIESLCDFTDAEPIPKEVAVEEAAGSAANPSQNSDGNVQQNKDGSIKLVHEANPSENCVTDGDHKHQESDAMLESPPAEEDEKESPKSFEFVPSNAKSADVASSTPKIQRPPPVKAVTTVPTCPKLTVKTEAFTPKVQATNSSRGLAPLTGSRAHPSALKQSMSVKRSVIKCPRELLAGKAATAANEIAQENQAVKRQKLDDGRTRQILNVKTRTLPHKGRGGGLAGSTEMSLSAMRKHRDDSHSLKEVTHYISAAEMVKKFESGTRELAIPHNRSLSHEDAATALQRRTKLMLTRPKEPEFQTSHRVRAVRVKSSAELEEEMLAKIPKFRARPFNKKIAEAPSFPPLPRKAPQLPEFNEFHLKTMERATRHADTCSEASSVGTIRSQSSKPLTLTAPKPPQLETALRARPPRVKSSQELELEELEKAPKFKAKPLNKKILESKGDIGVFPHLKAQPTAPKEFHFSTDDRLGPPAVVDLFDKLSLCSESSYHSKKDVPRLTIPNPFNLHTDERGHEKERQLAAQLLQKQLQEEKARIPKANPYPYTTDYPVIPPKPEPKPCTRPEGFQLESLVRHEMEQQRIMEERERMEREEAQRRVVKAHPIMKEDPIPLPEKERKPLTEVQPLKLHVDERAVQRSEFDNMVKEKEITYKRLREENEFAQKIEEEKALKQLRRTLVPQARPLPKFDRPFRPQRSTKQVTRPKSPQLQVDQRGARRHAFIR

SEQ ID NO: 847 - protein, 562 aa, Oryza sativa
MSVALYARGGGCGAKAAAARRSGRGGGGRRRAAVVLLLALAYVAGLLVFVLAGGGGVGVGGRVEVGREVGVMTVASLRRRRAAAAAAPQPGSVYRSHLVFERLWPDIRDDASSASAAASSLSSTSWRRSMLMTSHYQNPGELWMPCVNRKLIRPELPPSNGYLMIEANGGLNQQRLSICDAVAVASLLNATLVIPAFHFNSVWRDHSKFGDIFDEDHFIETLKEHVRVVKELPVDVLTRFDHNISSIPNMRTKAYSSPNHYMQKVLPKLLELGAVRIAPFSNRLAQSVPSNLQALRCFVNYQALRFAEPIRVLAEDMVERMVKRSTLTGGKFVSVHLRFEEDMVAFSCCTYDGGLKEKTEMENARERSWRGKFHRHGRVINPEANRRDGKCPLTPLEVGMMLRGMGFDNTTSLYVASGKIYNAEKYMAPLRQMFPLLATKDTLALPEELAEFEGHSSRLAALDYSVCLPSEVFVTTQGGNFPHFLMGHRRYLFGGNARTIKPDKRKLVLSFDDPNIRWNRFKRHMQDILHHSDMRGTALRKPNDSIYTFPMPECMCQQDGMM

SEQ ID NO: 848 - protein, 810 aa, Oryza sativa
MATLPDLGVSAFINILGAFVFLLIFAALRLQPINDRVYFPKLYLTGQRRHHPHPHGFVNLDLCSYLRFLAWVPGALRMSQPDLIHHAGLDSAVYLRIYTLGLKIFLPIMTVALLVLIPVNVSGGTLLNLRKEIVFSDIDKLSISNVNPGSNRFFIHLLMAYVFTFWTCFMLYKEYSNVAFMRLHFLASQKRCADQFTVIVRNIPHVSSHSTSETVDEFFRRNHPDHYLGQQAVYNANRYAKLVKKKERLQNWLDYYQLKFERHPGKRPIGRTGCLGFCGREVDQIDYYRARISELDKKLASERQRVLNDPKAVMPVAFVTFDSRWGAAVCAQTQQSKNPTQWLTDWAPEPRDVYWQNLAIPFFSLSIRKFLISIAVFALVFFYMIPIAFVQSLANLEGIEKVAPFLRPVIDTPVVKSFLQGFLPGLALKIFLYILPTVLMIMSKVEGYVSLSSLERRAASKYYYFMLVNVFLGSIIAGTAFEQLNAFFHQPPSQIPRTIGVAIPMKATFFMTYIMVDGWAGIANEILRVKPLVIYHLKNMFIVKTERDRERAMDPGSIGLAENLPSLQLYFLLGLVYAVVTPILLPFIIIFFAFAFLVYRHQIINVYNQEYESAAAFWPQVHSRIIASLLISHVTLFGLMSTMKAAYSTPLLIFLPLLTIWFHKYCKSRFEPAFRKYPLEEAMEKDNLERTSEPNLNLKSYLQNAYLHPIFHMFEQQQQQEQEQQREEKVEVRIDKAQQHHHRQVEEEEEESKSSQATTHYYHHHHEQTTTTTHHHYHQHEHMSHYHMGPSDTADSPSPPHFVYHYGVDP

SEQ ID NO: 849 - protein, 621 aa, Sorghum bicolor
MEPKGELAQKPIEEAIDGLKIDASTKASNVNLPAKKDASSSDAVSCISSGDAASTVKETEMNQETYFGDQGMYYYGYYYPGSYGGLDENGNFVGYNGLEVHPAVVQADNGSYLCHLPGYENGYASYSPVVPGGIASVDGQYVSKEQYYSTAIPLQDLSTPGIFAQPIAYGTELVPAYSWDPSFVLLDGVQGHPVGVHQTNYAARPKYSSNKHAIPSSKAARSAKPAADTVKGSSSGLETVANAANSSPSSKGANKASGASITKGYLPSSKFVMHSNNQGKISVYQSKGINVKESGRSWNNGEKLKMRSKLNGHGDSESNENNHTDNSKHSLSPQSDVGLPSSGGANASIPSHVAISKNAYNLSDFVTKYEQALFFVIKSYSEDDIHKSIKYNVWASTPNGNKRLDSAYRLAQERMAEKGTKCPVFLFFSVNASGQFCGVAEMVGPVDFNRNMNFWQQDKWNGFFSVKWHIIKDVPNPQFRHIILENNENKPVTNSRDTQEVKFSQGTEMLNIFKNFACKTSILDDFDFYENRQKVMQDRRGKPLTTLFDHPLPKAEKTAEIKRQTHATEFGRAKSNEGQGNNVGVVHDTTKKNEEQSNNVSEVVDAACSNKEQPNKVATQC

SEQ ID NO: 850 - protein, 394 aa, Sorghum bicolor
MLLLPGRPVLPSPALPYCPSPSPSRFRPLPCTSNAPTSASTAASADATASSSFSVEEYLVNRCNLYPNVAARVAPELSAIRSPSKPDAVLAFLADALELSPPLIAVAVARDPTILTCSVPRTLAPRADELRALGFTTYQMGLIVVRCGAAAFRSRALVSSVQFWLPYLRGRVDKLVAALKGNPGLLTADLRTVKSTIALLQEEGTLTDGDVGWFALSYCSKLLVASPDEVDTVLARADEFGVPRKTRAFKDAIIAAFSATPERLAWKAAFFRDELGWTEAQVKTAAAKMPTLMTVSAERIRRNWEFLTTEVGMDAERVASFPALLRYDLEGRLVPRFQVMRVLQARRLWRGRDFNNIAAITEEDFVAKFIRPFLVQVPDLAKIYEAAVVEKEEQ

SEQ ID NO: 851 - protein, 311 aa, Sorghum bicolor
MACSTASLAATLLALALMFQASLAGRRLTALVQEPAITMKYHKGALLTGPIAVNFIWYGDFSAPQRAVITDFVSSLSAPPAAVRPEPSVATWFKTARKYYASSKVRFPALRLGSHVVDQNCSLGKRLTERDLLRLAAKGGPSRAINLVLTAADVAVDGFCMSRCGTHGASPRSRSGRFAYVWVGNPASQCPGQCAWPFHQPVYGPQAAPLTPPNGDVGVDGMVISLASMIVGTVTNPFGNGFYQEGSADAPLEAATACAGVYGKGAYPGYAGSLLVDQASGASFNANGAHGRKYLVPALVDPDTSSCATLG

SEQ ID NO: 852 - protein, 82 aa, Sorghum bicolor
MALSSRRMAAAPFLVLVLLLVATELGTTPVAEARHCLSQSHRFKGLCMSSTNCANVCQTENFPGGECKAEGATRKCFCKKIC

SEQ ID NO: 853 - protein, 657 aa, Sorghum bicolor
MMATYYSSQGSERDSQNMYSREPSNASYPMSSALGNLLYLNNPASGPYTEFSGILQSQQNCMEMPEPGHPSVMSQDSSARESDMLGSHQGQRSFGLVKDMKNEMLMHMMDGSQSSTADLIHDDAQNGIQLDFGVLNNHGSSNIPSVQGQGLSLSLNTQILAPSLPYWSVKSDMLSPHSYHDSLRVDDIRMKSMQSESSRAIRNSRYLKAAQELLDEVVNVWKNIKQKAQKEQVEAGKTDGKETEGGPKSEGVSSNPQESGANAAPELSTAEKQELQNKMAKLMAMLDEVDRKYKHYYHQMQSVVSSFDMVAGPGAAKPYTAVALQTISRHFRCLKDAINDQINVIRKKLGEEESSSGKEGKLTRLRYIDQQLRQQRAFQQYGMIPQNAWRPQRGLPENSVTILRAWLFEHFLHPYPKDSEKLMLARQTGLTRSQISNWFINARVRLWKPMIEDMYKEEIGDIEQDSNSSSDNTPRSKGKMVSSEDKEDPRSCTPRVCESSQLSESRGSMRTMNAVGGGAAMGFQNEPNPDDTFMNLMLKDQRSNGEEDGGLLLHNAVAQHQDENARFMAYHLAELGRYGNGNVSLTLGLQHSSSSSLSVPNAQQSFPGVGVGVGDDDIYNAAAPLGVSVASSDYETMNQMDQRQRFEQSPLLHDFVA

SEQ ID NO: 854 - protein, 556 aa, Sorghum bicolor
MVAAAALDAMAGTRWGRWLGLVTAVWVQCISGNNYTFSNYSHALKTLMGLTQLQLNGLSVAKDVGKAFGLLAGLASDRVPTWLLLAIGSLEGLLGYGAQWMVVSRTVAPLPYWQMCVFLCLGGNSTTWMNTAVLVTCIRNFRRSRGPVSGLLKGYVGLSTAIFTDTCSALFADDPASFLVMLAVVPAAICALAMVFLREGPAAAAAAGADEEDDGRCFAAINSLAVAIALYLLAADLTGLGGDGGVVSAVFVAVLLVLLASPATVPALLAWKSWVKTRKAANADLEEADSLAAATAPLLLAAKAAGRTEEEQEARVPGERPRLGEEHTIAQALTSLDFWLMFASFLMGVGTGLAVMNNLGQMGVAMGYVDVSLFVSMTSIWGFFGRIASGTISEHFIKTRAIPRPLWNAASQVLMAVGYIVMALAMPGSLFIGSVVVGICYGVRLAVTVPTASELFGLKYYGLIYNILILNLPLGSFLFSGLLAGLLYDAEATAVPGGGNTCVGAHCYRLVFLIMALACVVGFGLDVLLCVRTKRVYAKIHESKRLSRSAVAQRVG

SEQ ID NO: 855 - protein, 1345 aa, Sorghum bicolor
MEAASASDETLAAVFAQLKPHTVALLDLLRSRRPASSSASSLREMAAFLRAAPAPALQLCFDYTVFPLLLLLDAAVQCRKQSNAPGQGSGGIDISDAVAEVGLTCLEVLLTKCRLTSVNQMVAMLKKLTSGAMLSPSEASEEFRGAIIRCFKALVLQLQPCLDNFCSCKQGTLLPTTPTSTGLEVVSVSRSNYSAQPEECLLAFLQSQNASAAVGHWLSLLLLASELEASRGHRGSADVRKESLHTLRILIGKVGSADALAFFLPGIVSRLGKVLYTAKAMISGAAGNSLSTEQAILGLTEALMIVLNDKENLSALGKHMNENHSHSPGGSGSTEHVLQMLRQLPTKSLSDEIGHDETTDDSISNVNNSFADRKALHVKRNKKWLEETTSNVDKLLCATFPHLALHSSEKVRKSVVSGVKGLLSSCSSTLKRTKMLLLECLCVLACDDAAAVSEAAQDALDYLFNQGHNLVTENEISDTFTRLVERLPQVVLGSEETTALSHARMLLALTFYAGPQFLINHLHCSPVIAARFFDCLGLCIGHSSQFSGSMDKLIVSKPLSIGYLYSVAELKSGAYAKDTTNKSLHAMSTSAASKISVIHDNALPNALLGTVEYELPHVPPWFSHAGSQKLYGVLAGIIRLVGLSTVSGKGTAASLSLFVDILLDQFRRLSTELREKSIYKDGLQRWYMKSEAGQTLRQASSAVCMLNELMYGLSGRSLGMFLQLFNNRSAQMSRTVCQKNQLLACVEHNGVTNEREVWGFNEQKGTKDNILHCIGSILHEYVSPEVWDLPTEKDTELRLIELNLPLHFYRDTTALHTVVLEGIGVLGVLLGQDFALSGFMHSSLYLLLRELISSSAQIRTASDAVLRALATAGGYCSVGQFVVANADYIIDSLCRQLRHLDLNPHVPDVLASMLCYIGASRDILPFLEEPMQAVSSELEVLGRHDHPHLTVPFLKAVSEISKACRHESTCLPDEAQSFYVKVSSEGQEVKNTIEKRMESSAISERMNVDARPYFMSLEYWEDLLCKLNEMRRYRRIVGSLAGSCLSAAIPLLSSIKEAACLVALDIVENTTISIAKVEEAYKCECQSKGVIEEAIQFLSFDELLDGTDATEDVDENRLLPAMNKLWPYLVICLRNKISVPVVRKCTEVLSRAIIISGGDFYVRRFHKDGSIVWRLLALSPFRRTSKMDEKAIILPYRDTSLTSEEPMAEISSQKIQIAVLDMIAAISSNKRSAVALESVLKKVCGLVVGIAYSSLTSLQEAAIRALAGLACMDADLVWLLLADVYYSLNQREPLLPNQDLALVSDLLPPPMSSREYLFVQYGGEGVRYDVDPSSVHEVFRRMQDV

SEQ ID NO: 856 - protein, 295 aa, Sorghum bicolor
MGKNGTQYAVLDAFTAEPFRGNPAAVCLLQDAAKAADERWMQSVAAEFNLSETAFLLRDSSASGAAPRFQLRWFTPAAEVELCGHATLASAHFLFTSVLAEHETLIEFSTKSGILTAKRVPAPESTGVSGEGKLFIELDFPMIDLVDCHPSELPSIPKTLNGASIVSVYKSTTAGDLIVELSSGKEVADIIPNIHEIKICSGRGIIVTGPAPAGSGYDFFSRFFCPKFGIPEDPVCGSAHCVLAPYWGGKLGKHKLTAFQASPRSGILYLELEAAGRRVRIQGEAVTVMTGTLLA

SEQ ID NO: 857 - protein, 324 aa, Sorghum bicolor
MRSLRAAQTLVSRSLLSARHLNGAASPATAAAAAGARWCATPAPVPPPRSPLPSSRVMPAGVAGAVSFSLTFATVAVAEAKAKERPQPDLLPQNVVLYQYQACPFCNKVRAFLDYHDIPYKVVEVNPLSKKEIKWSDYKKVPILTVDGEELVDSSDIINILQRRINPDEPTNDEEAKWRRWVDEHLVHVLSPNIYRTTSEALESFDYIAKHGNFSFTERFAVKYAGAVAMYMVSKKLKKKYNITDERASLYDAANTWIEALNGRDFLGGSKPNLADLAVFGVLRPIRYLRAGKDMVENTEIGDWYQRMEVAVGEPSRIQDAEGN

SEQ ID NO: 858 - protein, 1091 aa, Sorghum bicolor
MAGGQAPEASPGRYQRRRDEIDDDDCADVLGIDVRGPDADPFDIPAKRAPVERLRRWRQAALVLNANRRFRYTLDLKKEEEKEQIRRKIRAHAQVIRAALLFKEAGEKQNPDTELPEILPRGFGIGEQQLTVMTRDHNYSALQEYGGVKGLANLLKTNLEKGIHGDEADLSCRANAFGPNRYPRKKGRSFWVFLWEACQDMTLVILIIAAVISLVLGIATEGIKEGWYDGTSIAFAVFLVIVVTAVSDYKQSLQFQHLNEEKQNIQVEVIRGGRRIQVSIFDIVVGDIVALKIGDQVPADGVVISGRSLAIDESSMTGESKIVTKDQKSPFLMAGCKVADGYGTMLVTAVGLNTEWGLLMASISEDNNEETPLQVRLNGVATFIGILGLSVAAVVLVVLFARYFTGHTTNSDGSVQFVKRHTSVKSAIFGSIKILTVAVTIVVVAVPEGLPLAVTLTLAYSMRKMMADKALVRRLSACETMGSATTICSDKTGTLTLNQMTVVQSIVGEVKLQPPANVDKLSPTVVSLLLEGIAQNTSGSVFEAQDGSIEVTGSPTEKAILSWGLDLRMKFAEERSRSSIIHVSPFNSEKKRAGVAVVARDSDVHVHWKGAAEIVLALCTSWLDVDGSAHVMTPDKADQLKKLIEDMAEQSLRCIAFAYRNLDLKVVPSEEQIINWQLPDNELILIGIIGMKDPCRPEVRDAVELCKKAGVKVRMVTGDNLKTARAIALECGILDDSEASAQAIIEGRVFRAYDDAERENVADKISVMARSSPNDKLLLVKALKKKGHVVAVTGDGTNDAPALHEADIGLSMGIQGTEVAKESSDIIILDDNFSSVVKVVRWGRSVYANIQKFIQFQLTVNVAALVINVVAAVSSGNVPLNAVQLLWVNLIMDTLGALALATEPPTDQLMRQPPVGRREPLVTNIMWRNLFIQAVFQVAVLLTLNFRGRDLLHLTHDTLDHSSKVKNTLIFNTFVLCQVFNEVNSRKPEELNIFAGVSRNHLFLGVVSITVVMQVIIIEFLGKFTSTVRLNWKLWLVSVVIAFLSWPLAFVGKFIPVPRTQLKDIILRCWPKSGESAEQQDQDDRTAHPPV

SEQ ID NO: 859 - protein, 1934 aa, Sorghum bicolor
MASGGAGPSGPVRSTSQTRQRTMGRIPTRAYTMRPDGLSGEDGPGFEEEELVPSSLAPIVPILRAANEIEEENPRVAYLCRFTGFEKAHLMDPISGGRGVRQFKTYLLHRLEKDEHETNRRLATTDAKEIQRFYEQYCKKYLEEGHDKRKPEEMARHYQIASVLYDVLKTVTPGKNEYDKYAKGVEKEKASFSQYNILPLNISTPRQPIMEIPEIKAAVALLRQMDDLPMPRIELTQSSDGKTVPDEMDKPLVQDLLDWLWQTFGFQKGNVENQKEHLILLLANIDMRQQGTSHHSGRHVHVIHSSTVIYLMDKIFQNYNSWCRYLHLDSNIIIASDASTQRPELLYIGLYLLIWGEASNVRFMPECLCYIFHHMARDLHDIISDRREGPFEPPFQREGSDDAFLQLVIQPIYSVMQKEAARGKHGTVSHSMWRNYDDLNEYFWSKKCFKKLGWPMNPTADFFADTRAKNETEQHDHVISRRRQHDHVISRRRASKTNFVEVRTFLHLFRSFDRMWAFFILAFQAMVIIAWSSSGALSSIFEPEVFRNVLTIFITAAFLNFLQATLEIILNWKAWKSLECSQRIRYILKFAVAVAWLIILPTTYSSSIQNPTGLVKFVSNWINLQNESIYNYAVALYMLPNIFSALFFMFLPIRRVLERSNSRIIRFLLWWTQPKLYVARGMYEDTCSLLKYTTFWILLLICKLAFSYYVEIAPLVEPTRIIMSLERPPYEWHEFFPNLRHNLGVVVTVWAPIVMVYFMDTQIWYAIFSTICGGVYGAFSRLGEIRTLGMLRSRFEAIPRAFGKKLVPNHGSRLKRDEEDKNPPFDKFADIWNAFINSLREEDLLSNREKNLLVVPSSGGETSVFQWPPFLLASKIPIALDMAKSVKKKDEELMKRIKQDPYTEYAVIECYETLLDILYSIIVEQSDKKVVDRICESIKDSIHRRSLVKEFRLDELPQLSVKFDKLLDLLKKYDENDPVNNNTQIANLLQDIMEIITQDIMKNGQGILKDEGQKQLFANLNLDSLKDVAWKEKCIRLQLLLTTKESAIYVPTNLEARRRITFFANSLFMKMPRAPPVRSMMSFSVLTPYFKEEVLFSPEDLRKKNEDGISILFYLRKIYPDEFRNFLERIDFKPKDEEELKDRMDEICPWASYRGQTLTRTVRGMMYYRKALEIQCLQDTKDPAKFDQDGLIESYQELQSSIEMAQAIADIKFTYVVSCQVYGMQKTSKDSKDKSRYQNILNLMIINPSLRVAFIDEVEAPTRNGATEKTYYSVLVKGGEKYDEEIYRIKLPGKPTDIGEGKPENQNHAIIFTRGEALQAIDMNQDNYIEEAFKMRNVLEEFESRKYGKSEPTILGLREHIFTGSVSSLAWFMSNQETSFVTIGQRVLANPLKVRFHYGHPDIFDRLFHITRGGISKASKTINLSEDIFSGFNSTMRGGNVTHHEYMQVGKGRDVGMNQISSFEAKVANGNGEQTLSRDIYRLGRRFDFYRMLSFYFTTVGFYFSSMVTVLTVYVFLYGRLYLVMSGLERSIMLDARNQQNVKALENALASQSIFQLGLLLVLPMVMEVGLEKGFRTALGEFVIMQLQLASVFFTFQLGTKTHYYGRTILHGGAKYRPTGRGFVVYHAKFAENYRMYSRSHFVKGLELLILLVVYLVYGRSYRSSSLYLFVTCSMWFLVASWLFAPFIFNPSCFEWQKTVDDWTDWRKWMGNRGGIGMSVEQSWEAWWLSEQDHLRKTSIRALLLEIILSLRFLIYQYGIVYHLNIADHHKSIMVYGVSWVVMLLVLVVLKMVSIGRQKFGTDLQLMFRILKGLLFLGFVSVMAVLFVVLHLTISDVFASILGYLPTGWCLLLIGQACSPLIRRTMLWDSIMELGRSYENIMGLILFLPIGFLSWFPFVSEFQTRLLFNQAFSRGLQISRILAGQKGIGEFEFE

SEQ ID NO: 860 - protein, 305 aa, Glycine max
MATPIPPPPAAAAAATKVDYLNLPCPIPFEELHREAMMSLKPDLFEGMRFDFTKMLNQKFSLNHSVLMGPTEVPSQSTETIKIPTAHYEFGSTFIDHPRLLLWGRILTDGRLNARVKCDLSENLTFKANAQLTNEPHMSHAMINFDYKGKDYRTQFQLGNGALLGASYIQSVTQHLSLGGEVFWAGQHRKSGIGYAARYNTDKSVATGQVASTGMVLLSYVQKVSEKVSLASEFMCNYLSRDVTASFGYDYILRQCRLRGKIDSNGCVAAFLEERLNMGLNFILSAELDHRKKDYKFGFGLTVGE

SEQ ID NO: 861 - protein, 871 aa, Glycine max
MANPTQPNVGFTPEREISNPEKSPIPPPPSFVASSPGFPPPKLHLQQDQASSRSVKTPNVLSPANGVTTGSPVPHLSTPPGPPVFTSPVRPAAVPFRTSPALPQPLAFSPGSSLPTSSSPLQFSNGTFESQHQVSDSIEDHVPLGESSFVLFSAHKVLKQKKQANVPSLGFGALVSPGREVSVGPQVIQRDPHRCQSCGAYANIYCNILLGSGQWQCVICRKLNGSEGEYIAHSKEDLHRFPELSSPMFDYVQTGNKRPGFVPVSDSRMSAPIVLVIDECLDEPHLHHLQSSLHAFVDSLPPTTRLGIILYGRTVSVYDLSEEAMASADVLPGDKSPSQESLKALIYGTGIYLSPMHASLAVAHSIFSSLRAYKLNVPEASRDRCLGTAVEVALAIIQGPSADLSRGLVKRSGGNSRIIVCAGGPNTYGPGSVPHSFSHPNYPYMEKTGIKWMENLGHEAHRHNTIIDILCAGTCPVRVPILHPLAKTSGGVLVLHDDFGEAFGVNLQRASARSAGSHGLLELRTSDDILITQVVGPGEGSRVDTHETFKNDTALYIQMLSVEETQSFSLSMETEGDIKSDFVFFQFAIQYSNVYQADVSRVITVRLATVDSISAYLESVQDEVAAVLIAKRTLLRAKNHSDAIDMRATVDERIKDIALKFGSQLPKSKLHSFPKELSLLPELLFHLRRGPLLGSIIGHEDERSVLRNLFLNASFDLSLRMVAPRCLMHREGGTFEELPAYDLAMQSDAAVVLDHGTDVFIWLGAELAADEGRSAAALAACRTLAEELTEYRFPAPRILAFKEGSSQARYFVSRLIPAHKDPPYEQEARFPQLRSLTSEQRTKLKASFVHFDDPSFCEWMRSLKVVPPQPS

SEQ ID NO: 862 - protein, 419 aa, Helianthus annuus
MKDSPKPWKPHCCSSESKVSFSFSRCRPSRSEFSKNVAPCPSFRRLSFSDLSRSSSMRINEDIAQAFGPDLIDFKLSELRAMTQNFSSGFLLGEGGFGKVHKGYVDECMRTGLKAQPVAVKLLDIEGLQGHREWLAEVIFLGQLKHPNLVKLIGYCCEEEDRLLVYEFMARGSLENHLFKRISVCLPWGIRIKIAIGAAKGLAFLHGAETPVIYRDFKTSNILLDSEFNAKLSDFGLATMGPEGSNTHVTTRVMGTYGYAAPEYVNTGHLTTKSDIYSFGVVLLELLTGRRAMDKNRPKREQNLVDWAKPYLTSSRRIRAVIDPRLGGQYSVRGAKEMALLALYCVSPNPKDRPKMPSIIEVLESVKHFKDMAITCGQWPPASQKTSRNAVYSPKDAKEINGGRIYWKQTPVKTVRSRG

SEQ ID NO: 863 - protein, 170 aa, Helianthus annuus
MQTLQQKASEWSGVKQEDAFAIDQVNLFDKLGLQPFINLSTDFYTRVYDDQEEWFRSIFADSKKEDAIQNQYEFFVQRMGGPPLYSQRKGHPALIGRHRPFPVTHKAAERWLHHMQQALDNATDIDQESKTRMLNFFRHTAYFLVAGNDLKNESQGPPPCKHGNNEPAAD

SEQ ID NO: 864 - protein, 260 aa, Helianthus annuus
MANIRAFFILALLLLSSSFFLQVARSQSDPDAEADAELVAETVEEGSHVGDDVEDIGIGNYNPAPGVETVSVFPKNFAKLVVAGQETELLIGLKNEGEQNVKVFAVHASVHLPFDHRMLVQNLSTVAFNDASVPASVQATFPYTFAVSKFLQPGTFDLVGTIVYEIDQLPYQNVFYNGTIEVTEAGGLVSVETVFLVSLGLALLVLFGLWVRTQLQSLSKKTKKITKVEVGTRTVDASMDEWLQGTAYTQSQSNKLKKKK

SEQ ID NO: 865 - protein, 161 aa, Helianthus annuus
MSLVTKAIRESASEIYHGDAICQEKSKELLTEMGLPNGLLPLEDIVECGYVKDTGFVWLIQKKEKKHKFEKIGKLTTYGTEVTAYIEKFKIKKLTGVKSKELLMWITLSEITLDNPPTGKINFKATSGLYRSFPVSAFQLDDVKKDVGGASVAKDAQVKEV

SEQ ID NO: 866 - protein, 563 aa, Helianthus annuus
MAEETLNTTAAAAESTAVTAEVAVAPEAEKVEEAAVVVCEKDGSPETEKISESTSFKEESNVAGELPDPEKKALDELRLMVQEALNKHEFSAPPAAAAEEKPVKEEVPAKEEKATAVVEEEAKACAEAAGKDESTPSQATAVTPEVVPVTEVPEPEKTVSETETEVTEPEKNVTEPEKEVLEPEKEVPEPEKETTEPEKKVTEPETKEKTTEPASEPEPEEVSIWGIPLLADERSDVILLKFLRARDFKVKEAFTMLKNVVAWRKQFGIESLLSEDLGTEQEKVVYMHGVDKEGHPVCYNAYGEYQNKELYNETFSTEEKRTRFLRWRIQFLEKSIRKLDFSPNGVCTIVQVIDFKNSPGPFKWELRQATNQALQLFQDNYPEFVAKQVFINVPFLYLAFYKIINPFFTQRTKSKFVFAGPSKTAETLFKYIAPELVPVQYGGLSREGEFVSTDSVTEEIIKPSTKHTIEIPAPESCTLVWEARVVGNEMTYGAEFVPVSADSYTVIVQKSRKLAAATNEPVISGQFKCDEPGKVVLTFDNQTSKKKKVLYRSKTKVTESIKC

SEQ ID NO: 867 - protein, 592 aa, Helianthus annuus
MGRIKDIFVTFFNNRWLVFVAAMWVQSCAGIGYLFGSISPVIKSSLNYNQKQVARLGVAKDLGDSVGFLAGSMSEFLPMWALLLIGAVQNFVGYGWVWLVVTGKAPMLPLWVMCLLIFIGTNGETYFNTVALVSCVQNFPKSRGPIVGILKGFAGLSGAILTQIYALINSPDKASLIFMVAVGPTMVGISLMFIVRPVGGHRQLRISDRSSFSLIYCVCLVLAAYLMGVMLVEDLVDLNQTIVQILTSILFVLLVLPIGIPLWLTFSSDPRPSEEEPLISESQNKDQPESSHDPNEIIFSEVEDEKPADVDSLPANERQKRILQLQSRLAQAAAEGAVRIKRRKGPHRGEDFDLTQALIKADFWLLFWTLLLGSGSGLTVIDNLGQMSESLGYDNTHIFVSMISIWNFLGRVGGGYVSEIVVRDYAYPRPVALAVAQGLMSIGHLFFAMGWPGAMYIGTLLIGLGYGAHWAIIPATASELFGVKKFGALYNFLTLANPGGSLVFSGLIASYIYDSEAEKQAKERGEIIIKSTSSMLTKLFETDDALKCTGSICFFLTYMLMSGLCIIALILSLILVRRTKTVYQNLYGKTRT

SEQ ID NO: 868 - protein, 406 aa, Helianthus annuus
MPTATAISLSILFLLSLTTTIHAHNITRILAKHPEFSTFNHYLTITHLANEINRRQTITVCAVDNAAMSDLLSKGLSIQTIKNVLSLHVFADYFGSKKLHQVTKGSTSTATMYQATGEAPGTAGYVHITDVKGGKVRFTPEDNLSQTDSVYVKSILEMPYNISVIQISSILQSPEAEAPTAAPDLNLTSLLDRDGCQSFHNLLTTSGAIGTFLSSVEAGVTVFCPDDDAITAFAPKYKNLTAAEKTSLLLYHGIPVYNSMGMLRSSNGLMNTLATEGAKKKYDFTVQNDGNDVKLKTKVVTATVTGTVVDDEPIAIYTLDKVLQPRELFKGAVEEADEPAPAPKGAKKKKKAAKKGDEAEEDAEAPGPGSDEDYSDDDAADQTASSGERVVAMVSVVVMAVLLSLF

SEQ ID NO: 869 - protein, 453 aa, Helianthus annuus
MPIDQADLNSDQVLRRDIPWETYMTSKLITGTALQLLRRYDKKSEHDRAPLLENDGPSYVRVFISILRDIQKEDTVEYVLALIDEMLTEKPNRAKLFHDKSLADEDIYEPFLRLLWKGSWFTQEKSSKILTLVVSARPNKNGLTANGKATDSKKKITTSDDVLKGLVEWLCIQLKKPSHPNRSIPVSINCLAALLKEPVVRSSFVQADGVKLLVPLISPASTQQSIQLLYETCLCVWLLSYYEPAIEYLATSRALPRLSEVVKGSTKEKVVRLIVLTFKNLLSKGSFGAQMVDIGLPQIVQSLKAQAWSDEDLLDALNQMEEGLKDNIKKLSSFDKYKQEVLLGHLDWSPMHKDPNFWRDNITNFEENDFQTLRVLLTILETSSDPRALAVACFDLSQFIQYHPAGRVIVTDLKAKERVMKLMNHENAEVTKNALLCIQRLFLGAKYASFLQA

SEQ ID NO: 870 - protein, 415 aa, Helianthus annuus
MVIASARISTCGSMELAPASFSTRHVGRDCVHLKSTSSQWLKKPPRWFGFSHVKISKFNHSACSVSMVSNNYVGRSTYRIKKDNDDKIYRRLDSCLVIPPPKGKKPKAVIKFLGGAFIGAVPEVTYSYLLGLLANQGYLIISVPYNVTFDHSQAAREVYERFHSCLNSILTSGLPDDGLLAAELVDLPLYSVGHSNGALLQVLTGSYFSDKLPKANAIISYNNRPATEAVPYFEQLGPLVSQLMPVVEASPVSSMAKGAADAWKALLDTAEAMTPDYDPEARVSLDKFVDQLPSVFNQVAQGISEFKPTPTENRECCKNSYNVKKTLLVKFNTDAIDETDLLEETLRPRVEAIGGTLEKVSLSGNHITPCIQEPKLQVGDVYTPADAIAQGLKNLSLNETKVAARTIADWLSSIS

SEQ ID NO: 871 - protein, 571 aa, Helianthus annuus
MSSYIRSSENARDSTPMLYLREPLQQSYSSEPPILAGNEIMYMNYSSSSAGEFSGSLAGNSQQLNSCIDIPNIGVHDSNVVSHQELLSSIGEPWRDGRNHGMMLMDQMGSRNSQGQGLSLSLGSHIQPAGIQFHSGDYRNPNMGFSSFLSADSDSIKTDVSNSPYGMGNGSRGITDSKYLKAAQQLLDEIVNVGKALKQHNARKEAMDYSKEIDSEAKNVASSSQQEANELSAAEKQDLQNKMMKLISMLEEVDRRYKQYYHQMQIVVSAFDVIAGCGAAKPYTALALQTISRHFRCLRDAINGQIKATHRSLGETDSTANEKGVGISRLRFVDQQLRQQRALQQLGMMQQHTWRPQRGLPETSVSILRAWLFEHFLHPYPKDSDKTMLARQTGLTRSQVSNWFINARVRLWKPMVEEMYKEEAGDAEIESNSSSEFAPKTTKGDRKTSVDQEDLNQSTAASGFDSNQAPNVELIGTSNDSDFQHMMVQSNRGEHERLMAAAYQMPPQLVSLTLGLKHSEDGGLPPMASHGRGDGDSGSSVGPEAVDFDGVSSDNQQQRYGSSHLLHDFVA

SEQ ID NO: 872 - protein, 469 aa, Helianthus annuus
MSSSLNYDALNFKLIFFTILLINATALTNQNQNPKSNSTQTQINSNSVLVALLDSHYTELSELVEKALLLQTLEQAVSQHNITIFAPNNEALERHMDPEFKRFLLEPGNLKSLQKLLLFHIIPTRVGSEQWPGQDTGSVAVAHHKTLCVEESENRLPLTRGNSGEKIVGGLAKVTRPDDVTRPDGLIHGIERLLVPRSVQEEFNRRRSLTSISAVLPEGAPVVDPRTHRLKKPAPVPAGAPPVLPIYDAMAPGPSLAPAPAPGPGGPRHHFDGESQVKDFIQTLLHYGGYNELADILVNLTSLATEMGRLVSEGYVLTVLAPNDEAMAKLTTDQLSDPGAPEQIMYYHLIPEYQTEESMYNSVRRFGKVQYDTLRLPHKVVAEEADGSVKFGSGEGSAYLFDPDIYTDGRISVQGIDGVLFPVEETKEKPASKVSPATATKVVANQRRGKLLEVACSMAGVFGHFTSCN

SEQ ID NO: 873 - protein, 306 aa, Solanum lycopersicum
MEFWGVEVKAGQTLKVKPELFKLIHISQAAIGEVKDVKEAKYVPLRLTVGDNKYVIGTLSAEDRPQLMFDLVFEKEFELSHGWKNGSVHFMGYSADDPSSEEIDSGDDVFSDEENVMEALNGKLEADVKDVKPDAKKSAPAKDEKNAKVAESKKETESDEDDDDSEDDSDDEDDSEDDSDDVPLGMDGPEGMDLSDDSEDDDDSEEDDDSEEETPKKVEQKKRPAPSPKVAPGSGKKAKQATPDNKSGGKKGPATPSAKQNGKPAFNGNNKPKTQSPKSGGQFSGNKSNNKNFSGQKNFKGKQGRK

SEQ ID NO: 874 - protein, 739 aa, Solanum lycopersicum
MEESLLPGESSSNSWGRIRNRRRVGSMFDPRDAIAHGSAYQKAAALVDLAEDGVGLPEEILEGTSFEKAAQLYFMFTRFDFLWSLNYLALVLINFFEKPLWCSRHLAESCNNRDYYYLGQLPFLTGAESLIYEGVTLLLLVIHILFPISYEGFHLYWRSLLNRLKVVLLLILVADIVVYILFLADFYYLPFRIASYLRVVFFILNIRELRDSFFILAGMFRTYLNVVALTALFLLFSSWLAYVFFEDTQQGKTMFTSYGTTLYQMFVLFTTSNNPDVWIPAYKESRWYCLFFVLYVLLGVYFVTNLVLAVVYDSFKSELVKQVAEKDRRKLRTLKKAFSLIDDSNTGVLDKKQCILLFEELNKYRTLPKISGDDFESIFNELDDTGDFKINLEEFADLCTAIGLRFQKEDSLPIFEACPNFYHSAASEKLRDFVRGDTFEYIIVSVLLVNLVAVIIETTLDIQNNSGQTFWQKVEFTFGWLYVIEMALKVYTYGFENYWRDGQNQFDFIVTWVIVIGETATFVAPDDLTFLSNGEWIRYLLIARMLRLMRLLLHVERYRAFVATFLTLIPSLMPYLGTIFCILCFYCSLGLQIFGGIVNAGNPNLAQTELSDNDYLLFNFNDYPSGMVTVFNILVMGNWQVWMQSYKELTGTAWTYVYFVSFYLISVLWLLNLIVAFVLEAFQAEMDLEAAANCADGDDKESRSERRRNVGTKTRSQRVDFLLHHMLSSELTECSHDDP

SEQ ID NO: 875 - protein, 675 aa, Triticum aestivum
MIATVTPFSHSSTASSAEFERRKRAIPLLSAMSRNLKNPVQTQMAVSALSSSLIGDYPSKTRSEGRAVGWKRVFVQTDTGFVLPVQLDRGDSVHTVKRKLQVALNVPTEESSLTLGDHVLKNDLSSIRNDSPLLLTKTFMHRSSSSPCLSPTSKDLQQQRDRGGPIEVLVCPTRCIQAKQLVKDVARAIRNGVDPKLVNSGLGGAYYFKNSKGENAAIVKPNDEEPFAPNNPKGFTGRALGQPGLKRSVRVGETGFREVAAYLLDYDNFANVPPTVLVKISHPVFNVNEGVGSTNKKASVGDPRTVSKIASFQQFAPHDFDASDLGTSSFPVAAIHRIGILDIRIFNTDRHAGNLLVRKVTGADQFGNQTELIPIDHGLCLPECLEDPYFEWIHWPQASIPFSEDELEYIGKLDPVKDAEMLRMELPMIREACLRVLVLSTIFLKEGTLFGLCLAEIGEMMSREFNGMDDQPSQLEVVCMEARRLATEREECSTEHDSADEDVTQFELDCEDHEMPKTPPAYHFEFKGGSSRNPLSKLEEAIEEEEDDIQEEEESNAEKLACPKPVNKWLPNISKLSTSLSSVSLMDKSQRQVPAIPKGADSVKTSENSQVGNWRTANEQLPTSASFVKLADMGVDTWGLFLEKFQELLPGAFRAHKLGATGQRGRLRMGTSCQF

SEQ ID NO: 876 - protein, 765 aa, Triticum aestivum
MDTPDRPRAGAAAGFEDSPVFNFINNLSPIPPPKPQDSSHNVHLFKSSDLAPVSSIFASPHVNPPKESKLLIRDDSVQLSQDSNSPNSVRTRLGSAIRLIKCKNIVSENCSFTCHLNQGPMDSSANRSNSTSKLPQTIQFVGDSSECGKNQNADSKKDLARDQESIELEGVLLDHTGPDKIDSSQPGRTVHENQQCEQQKDGFTAYDGDYLITHESSMDMLRLAPPCEADTQLVNETLNADNVFSGNSLLTDGPSGSYINNAAHDPNLYWDGTVEGPTTDYTPQLLPGACQSQSVSNDQICNAVEEPSDHIPIDQSALSQNMRGMRRRCLFNEKAGAVNKAAKKTSDRHSANTTTPRCKTNSGDKPVRTPPCALPGIGLHLNALAPISTDKIVPQAAQSSINQASNFPCAVSSSTSESNIANEDSSQAIVVANADESGQGSPKKKRHKFDDGDGTSCKRCSCKKSKCLKLYCECFHAGVFCSEPCSCQGCLNKPSNMEIVLSTREQIESRNPLAFAPKVIRTSEPGQELGEYSNKTPASARHKRGCNCKKSSCLKKYCECYQGGVGCSISCRCEGCKNAFGRREGLGPLSIEEAKQGNEENSACVKEEKKEDDNNQLVICPAANPVPAENVLTTPSAMDVRPLASRPPSSSKRPRSTTKVLGHPSRLCNSQAPLKTDTLLSPFENYAEIMFGVGTSDSLKGGLSPQTSVKVVSPNKKRVSPPRIGTGLSPICKSGRKLILKSIPSFPSLGGDVNNADTKTTLPAP

SEQ ID NO: 877 - protein, 411 aa, Triticum aestivum
MAAARARWRLLALPLALLLAIGSSRGVDAAPKPPVPKAISDLREAIVKGLGLQSEELKVSGFDVRDALVGHAVAYEFDMEVGRKAVPVRLLEDVNRWDFVDLPIFRSQADADDTALAEIGRGSFDPTLPPFQLAGPMELWIQDGDDVRLALPHDVEAGTLKKVVLADGAVVTVKGARAVSLRLPLELPLPLNRTTYKGRLSSLLSIARALRGAARSNQKPLMSLRIEGPTSLSSTPSMSPNDKLKLKRLAPGQVELSSRAIPAVTDDEDESPSPGLWPFLSLNASDGSLQGLEELLAKVLGKKAGEKGTFKLVNARASAQTYVKMGFTVEKRIADGEVNWSNLPEWRTKPKKLRAHYEVLARVERGQAIPERIAQVQPFQVDEAMSESMLTGNVSRSKMEVVNPPPVYFTL

SEQ ID NO: 878 - protein, 251 aa, Triticum aestivum
MASVHLCGPKVASAAMAKPALADGLRVPPSSSARPVPTGRRFRGLVVRAATVVSPKYTSVKPLGDRVLVKTKTTEDKTAGGILLPTTAQSRPQAGEVVAVGEGRSLGSNIVEISVPVGAKVIYSKYAGTELEFNDTTHLIMKEDDIIGILDTDDVKDLKPLSDRILIKVAESEEETAGGLLLTQASKEKPSVGTVVAVGPGGLGDDGSRTPLSITPGSSVLYSKYAGSEFKGSEGEYIVLRSSDVIAVLSS

SEQ ID NO: 879 - protein, 287 aa, Hordeum vulgare
  Sequence also found in Organisms: Secale cereale, Triticum aestivum
MATPDLLFNLRNLFYLGAYQSAINNSDVPGLDADAAAERDVIVFRSYIALGSYQLVISEIDSSAATSLQAVKLLALYLTGDKEGAISSLKEWLSDSAIGSNPVLRLIAGIIFMHEQDYNEALKHTHTGGTLDLHALNVQIFLKMHRSDYADKQLKIMQQTDEDHTLTQLANAWLDIAVGGSKIREAYLIFQDFAEKYPMTGMVLNGKAVCCMHMGSFEEAETLLLEALNKDAKDPETLANLIVCNLHLGKPSSRYFSQLKLSHPDHVLVKTTTSAEDNFERALQAVA

SEQ ID NO: 880 - protein, 423 aa, Triticum aestivum
MSPTTAASPAPAPATDAPPKPSPGAKRSLMGSLIDATALLRAASFKEDSYVAAALPASDLRALADLRALLATHPDQISIWGVPLNPPSDAPADERTDVVLLKFLRARDFRVRDAHAMLLRCAAWRAEFRADAVLDEDPGFKDLEGIVAYMHGWDREGHPVCYNAYGVFKDRDMYNRVFGDGDRLSRFLRWRVQIMERGVRALQLRPGGVNAIIQVTDLKDMPKRELRAASNQILSLFQDNYPEMVARKVFVNVPWYFSVLFSMISPFLTERTKSKFVIAREGNVAETLFKFIRPELVPVQYGGLSRASELENGPPKPASEFTIKGGEKVFLEIDGIEAGATITWDLVVGGWELEYGAEYVPAAEGGYTLCVERTRKVPAAAAEPVHNAFTAKEPGKMVLSIDNSGSRKRKVAAYRYFVRKPSA

SEQ ID NO: 881 - protein, 505 aa, Triticum aestivum
MAARKDNAVLIACQAPNGRVTRAQAANCGRFGVPHPAPVLVRTERKPATKGKAKRGASDENTCASALTSAPPPKRRAALKDVTNISCANSFRNCTAVTKLQSRPTQKVGRNPSKNKQCAKKAPKPPLPTLSGTSFVVNDSHNVEETQKAELLPPKEEPTALLENKGSLSLWNFARNRESGVHEPFFQGRNTRDKSETADSNTGDYVGLNVIDIDKDNGNPQMCASYAAEIYRNLMAAELIRRPKSNYMETLQRDITKGMRGILIDWLVEVSEEYKLVPDTLYLTVYLIDQFLSRKYIERQKLQLLGITSMLIASKYEEICAPRVEEFCFITDNTYTKNQVLKMECEVLNDLGFHLSVPTIKTFLRRFLRAAHASQKAPCATLGYLGNYLAELTLTDYSFLKFHPSVVAASAVFLAKWTLDQSDLPWNSTLEHYTSYKSSDIQGCVRDLWELQQGNTSGSPPLNAIREKYRQEKFECVANMLSPAMPGSLFHRQANGTSPLLINNS

SEQ ID NO: 882 - protein, 515 aa, Triticum aestivum
MELPQLASFLGVVLATVLFLKAVLRRRRQYNLPPGPKPWPIIGNLNLIGTLPHRSIHALSKKYGPLMQLQFGSFPVVVGSSVEMAKFFLKTHDVVFTDRPKTAAGRYTTYNYSDITWSPYGAYWRQARKMCLTELFSAKRLESYEYIRREEVLALLGDLYRGGAGAGRVVVLKDYLSTVSLNVITRMVMGKKYLEKEVRDEAGAVITTPEEFKWMIDELFLLNGVLNIGDSIPWLDWMDLQGYIKRMKKLSKMFDRFLEHVVDEHSERRGHEGESFVVKDMVDVLLQFASDPGLEVKLNREGVKAFTQDLIAGGTESSAVTVEWALSELLKKPEVLAKATEELDRVVGRGRWVTEKDMPSLPYVDAIVKETMRLHPVAPMLVPRLSREDTSINGYDIPAGTRVLVMVWSIGRDPELWEAPEEFMPERFLGSRLDVKGQDYELLPFGSGRRMCPGYSLGLKVIQVSLANLLHGFTWRLPDGVELSMEEIFGLSTPRKFPLEAVMEPKLPAHLYVEA

SEQ ID NO: 883 - protein, 169 aa, Triticum aestivum
MRPQSASALAATTLVFLSLICNIQLLVSVTGLSSFAMDNSPSKPELGAAAGAAGNPEVVLPDAANVEVNSVPAVDDQHPDPADVLAWALRQGQIHADPLMQRLETVGALLDIEMQIVPPVPHQVILVALDQLAMLPMPAADPAPPEASQEIDVDTEGVEGDVPPPPASP

SEQ ID NO: 884 - protein, 612 aa, Zea mays
MAAPPATTATTHHRALLPPTRTHAAATHSALRLPLRAHPHAHAQRARLTAAAAPAPAASTASLESSAAGKPTVLVAEKLGAAGLALLREFANVDCSYGLSPEDLRAKISLCDALIVRSGTKVGRDVFEASGGRLRVVGRAGVGIDNVDLAAATEHGCLVVNAPTANTVAAAEHGIALLTAMARNIAQADASLKAGKWQRNKYVGVSLVGKTLSILGFGKVGSEVARRAKGLGMHVIAHDPYASADRARAIGVELVSMEEAMTTADFISLHMPLTPATNKMLNDEAFAKMKYGVRIINVARGGVIDEDALVRALDSGIVAQAALDVFTKEPPAPDNKLVLHENVTVTPHLGASTVEAQEGVAIEIAEAVIGALKGELAASAVNAPMVPAEVLSELAPFVVLAEKLGHLAVQLVAGGGGIKSVKVTYASARAPDDLDTRLLRAMITKGLIEPISSVFVNLVNADFTAKQRGVRITEERIILDGSPETPIDYIQVQIANVKSKFPSAISETGEITVEGRVKDGVPHLTKVGAFQVDVSLEGSLILCRQVDQPGMIGSVGSVLGEENINVSFMSVGRIAPRKHAVMAIGVDEEPSKVTLRKIGEIPAIEEFVFLKL

SEQ ID NO: 885 - protein, 1027 aa, Sorghum bicolor
MARRGYAMRMRAVDAAECYPFVGGGCSEGEGEPPPPPRFPPMDPKPLSRWWKHELAAGQARLLAGAKGGEAAAAGVRGSALRKGTKRKGSRSNSTGERARKRRRVLQFRSFLSNKERTAKPQSTFRLHEQKLHMAMLRKHKSSTVHTSTVLEPRKKLEEACDRMPTHENSVKKRHRERTDPSSEMNSDLYGIKEVTSSVNKQVIEVNGSTNKPTNTGHEMVKTSTGPKDDIFGDLPLLELESSKVMFRTGVHELPTVIEESFITNQTEADSIPEVVPLELIDASDITAQTPSPLEDLVKSEDSEPACISHNDVAGSHPSTVGIDGLPNHKNINMVKPGLGDMQLKFTDVSALGSHSVLRSKSGSGYPLQGCFDVNKNCSQEIKKHGTNSTSSPPAMRTRAEETKYKDAPVKGKKSTDITSAAVALPVPANQLSYQASALPSAVSHSVFSTRVDSNDMSSFRSMPAKECIPTTRPGNLRTNVCHGSRKHVDPCVALSTDNQGSSHSKLHPICSPANIGMTFMKLPGLERMEISNCNVKIGENRFSNAESMNAVRYQKQPWLSGMTYVMQGQKQIGLSSSQVGKPALDGYGGEGDHHLQQPTVRLMGKTVSVCSHSKDHNVSTMDQVSPDNVAIEASRLSTISCQLPQKRSFPCQDSVTPRVHLNNSSDFLARIPNNSMQGQNTAFSGLHNQRPQPINSAPTVKDCTWNFGNQFVRQAELNKAAIVSTNSQTRHLELHQPPQLISIPQNQQSHLWTPAAQMSRKDQCFVGPAVNQSSLVPKSLLTASMKEKYQKSTLLSYDDPSSMSICQPYQIPGANSSSASVTSFFEYGADNSLSRSSSPGLSLSLATGLANESVSTGRVACAGSLTNADGRKAASFAEPISNSSAYADNVSQQPAKPISNRTAYATDNVSQQPAKRQLVTDTQDLMSMGPNIVNHSPGWSLSDAVGPQVLDFSKRIARDAVQTSRNESNNPRASSGPVPPIETWSRPGLVAGANTMLKPGQNLNDHSKLLYSTKFSVDRGINSVVL

SEQ ID NO: 886 - protein, 372 aa, Zea mays
MGGAAGEAMWAAVVAATVVFLAVEVSGAASALPRFAEAPEYRNGEGCPAAAAGVCDPGLVHIAMTLDAHYLRGSMAAVYSLLKHASCPESIFFHFLAAEAGAVDGADPEPELLRRAVAASFPSLRFEIYPFRAEAVAGLISASVRAALEAPLNYARNHLADLLPRCVPRAIYLDSDVLAADDVRRLWETRLPAAAVVAAPEYCHANFSRYFTPAFWSDPVLGARVFAGRRRPPCYFNTGVMVIDLRRWRAGNYRQRIERWMEIQKQKRIYELGSLPPFLLVFAGEVEAVDHRWNQHGLGGNNVHGSCRPLHAGPVSLMHWSGKGKPWDRLDAGRPCPLDHTWKSYDLYIPGDSGGAASPASGPALSASVFSW

SEQ ID NO: 887 - protein, 499 aa, Zea mays
MMAPPISADALVEAASAVAAYPAIAPNRMLCKDAPAPAISVVSKQTVRPAGASAAVGSGDLRLSVSDMPMLSCHYIQKGLFFPPPPPGVLAASLVSSLVAALSRALGVFPALAGRLVTLHDDSIVIRCGGDDAAVEFYHAVAPSLSLGDFLVPGADVPTRLTNGLFPMDRTVSYGGHGRPLTTFQLTVLGDGAVFVGFVANHAVVDGTSFWHFFNTWAGLCRGAPVREPDFRRNFFGDSTAVLRFPGGASPAVTFDADAPLRERILHFSAAAISELKATANRSKRAGQEAEANGKLAHDDSRLEGRSGEISSFQSLCAHIWRAVTRARRLLAADKTTTFRMAVNCRHRLRPAISPLYFGNAIQSVATTATVAELASNDLGWAAARLNATVASHKDGAIRRAAAEWEAAPRCFPLGNPDGAALTMGSSPRFPMYDGNDFGWGRALAVRSGRANKFDGKMSSFPGQAGDGSIDVEVCLAPDTMAHLLLDKEFLQYVSSPAP

SEQ ID NO: 888 - protein, 320 aa, Zea mays
MAATATAMAIATISPAAPIPSAPFPSLLLPLGLRLRSQPLLFAASRRRFLHVPKAASWDESVPEDGGDAEESVAAGDDEDEDEKPRPEPVSSSEFQFAAPPEGYVEPAAFDELPPESPEDVAAAYESLYGPAFSGETLLGNNVFEVKVVDPIDMDREQRPNDDFTERVVQVNRVTKVVKGGRQLSYRAIVVVGDMKGHVGVGVGKAKEVTEAITKAAMNGRRNLVTVPLTKYSTFPHRADADYGAAKVMLRPACPGSGVIAGGAVRVVLEMAGVENALGKQLRSKNPLNNARATIKATQMMKQFKDVAEERGIPMEELWK

SEQ ID NO: 889 - protein, 106 aa, Zea mays
MAKNPKDAAPEEEMPAAAEEQAAPAATVKVLFFARARDLTGVADSAVEVPPGSTAGECLARVLARFPKLEEIRGSVVLALNEEYAADSAAVADGDELAVIPPISGG

SEQ ID NO: 890 - protein, 369 aa, Zea mays
MVMGGASVGTLLVVLAVLAPAVMAQSCDDELPAQLAGNFSGLACAPVWNNFVLRYAQDKDNVLRVVLSTMYSTGWLGMGFSKNGLMVDSSAMVGWIGKTGLPHIKPFSLRGKTPSQVVADQGFLVSSDNHKPTVLVQQAKIYLAFQLSFTEPLRRQNVLLAVGSAIPVNDRLAEHQDKTSIVFDFTTGSSSGSSSFPEGLKRTHGALNLFAWGVLLPIGAIVARYCRRWDPLWFYLHAGIQFVGFILGLAGVVAGVSLYSKIQADVPAHRGLGIFVLVLAILQILAIFLRPNKDSKYRKFWNWYHHWVGRLALFFAAINIVLGIKVGGAGNSWKIGYGFNLAVLLITIVTLEVLLWTRWKNSTGSTGAY

SEQ ID NO: 891 - protein, 226 aa, Zea mays
MATSAALSTAANPTQLYRSRALLGKPVKGLGLSMGRERAQRSIVCQAASSISADRVPDMEKRKLMNLLLLGAISLPTVGMVVPYGAFFVPAGSGNAGGGTYAKDKLGNDITVEAWLNTHGPNDRTLAQGLKGDPTYLVVEQDKTLATYGINAVCTHLGCVVPWNGAENKFICPCHGSQYNNQGKVVRGPAPLSLALVHADVDDGKVLFVPWVETDFRTGEDPWWKA

SEQ ID NO: 892 - protein, 355 aa, Hordeum vulgare
MASAPSRALPFLSPPSTAPRAPSGRLRCAAAAGQAGFFTRLGRLIKEKAKSDVDKLFSGFSKTRENLSVVDELLTYWNLADTDRVLDDLEEALLVSDFGPKISFRIVDTLRDEIRDGKLKSGTEIKASLKRCILELLTTKGSKTELQLGFRKPAVIMIVGVNGGGKTTSLGKLAHRFKNEGAKVLMAAGDTFRAAARDQLEIWAERTGSEIVIDNDKKAQAPSVLSQAVKRGKREGFDIVLCDTSGRLHTNYGLMEELVSCKKVIAKALPGAPNEILLVLDGTTGLNMLQQAKEFNDVVGITGFILTKLDGTARGGCVVSVVDELGIPVKFVGVGEGVEDLQPFDAEAFVEAIFP

SEQ ID NO: 893 - protein, 416 aa, Hordeum vulgare
MGKVVVTEATARQVASFLLGAAAALTVVMLVHYRAPAAGLSRARTPGHFSGLRSSSSDDQHHHHRNGTTARAVVHQAPPVAASAGDDHRRPANATTITKPNSTSTAAALPLRHLPSTNHHGQKGANEESPEFRGLAAAVARAATDDRTVIITCVNQAWAAPGSLLDLFLESFRIGDGTARLLPHVLVVAMDPGAHARCLAVHRHCYHYTIPGLNIDFAAHKYFLSKDYLELVWSKLKLQRRILELGYGFLFTDVDILWLRDPFKHVTAYADMTVSSDVYFGDPDNLGNFPNTGFFHVKPNARTIAMTKLWHGAKGKYPGANEQPVFNMMKKRMVAELGLRVQYMNPAYVGGFCSYGKDLRKIVTMHANCCVGIENKIKDLKNVLGDWRNYTRMPPWERHRAKWTVPGACIRAEKQV

SEQ ID NO: 894 - protein, 530 aa, Zea mays
MATGSPRRRPLPLLLLFLLLFAANGRANAARPGGPSPIKNVVVLALENRSFDHMLGWMRRLLGLPVDGLNGTECNPNSNSTSSICVSADADLVVPDDPGHSFEDVLEQVFGNVSAAAAQPQPSMSGFVRSALSVNAVLSSAVMRAFRPSLLPAFSALAPQFAVFDRWFSSIPGPTQPNRLFLYSATSRGAVAHDKLDLLLGYPQRTIFESLAADGHDFAVYFKTIPTVLFYRRLRALRYAARAFHRYDATFKEHARRGVLPALSVIEPRYFDLTGTPADDDHPAHDVANGQRLVKDVYEALRSSPQWNQTLLIVTYDEHGGFYDHVATPTAGVPSPDGIRGPPPFFFKFDRLGVRVPTIMVSPWIKKGTVVGRAIGPTDSSEFEHSSIPATIKKIFNLSSDFLTKRDAWAGTFDHIFTELDQPRTDCPETLPEVSFERPTPPKEHGWLSDFQRELVELASFLNGDYMLTSLAQENRKKKMTVKQADAYVRRAITSFLQASKQAVRLGANESAIVTMRSSLTSKSTRSSSP

SEQ ID NO: 895 - protein, 496 aa, Sorghum bicolor
MTTRDAHLGVGVGVEGDAKDKNAAADALTDGGGGHEGAGSGGGRKLSLVPLIFLIFFEVAGGPYGAEPAVQAAGPLYALLGFLIFPFIWAIPEALVTAELSTAIPGNGGYVLWADRAFGALPGSLMGTWKYVSAAINGAAFPALCADYLARVAPAVSGGPARAATIVAFNVLLTAVNCAGLTVVGWSAVGLGVASLSPFLVMSGAALPKIRPRRWRVVARERDWKLFFNTLFWNLNYWDSVSTMAGEVDRPGKTLPKALVSAVSMTSLGYLLPLLAATGALDVAPDSWGNGFFADAAGMIAGNWLKYWIEVGAVLSSIGLYSATLSSAAFQLLGMADLGLLPGFFASRAPVFRTPWVSIVATAAITLAMSFLSFNSIVAAANFLYSLGMLLEFAAFVWLRVKQPALARPYRVPARLPGAVLLCLVPSVFLVFVMAIAGWKVYAISAAFTAAGVAVYYLMRLCKARGCLRFSDGAGAGDQGSTAAVYQQGSSNGGDV

SEQ ID NO: 896 - protein, 368 aa, Zea mays
MELDEETTFLDELMSLRREAAAAASAQWQAAAAYTGGGGQGMMMGDLLFYGGTTEAAATATSGGGMDQLSPFHQQEPLQVQAPPHPHSHEEFNFDCLSEVCNPYRGGGVAVITGAEAAAVPGRALAALHDAMVEDETSGHLQGQQYGAGGSPTFVFGGAAGESSEQMPVVVRGAGGGPHHRSKVHGGGAPSKNLMAERRRRKRLNDRLSMLRSIVPKISKMDRTSILGDTIDYVKELTERIKVLEEEIGASAEDLDLLNTLKASSSSGSNEMMVRNSTKFDVERRGNGSTRIEICCATNPEVLLSTVSALEVLGLEIEQCVVSCFSDFGMQASCSQEEEDGNNKRQVLSTDEIKQALFRSAGYGGRCL

SEQ ID NO: 897 - protein, 1402 aa, Setaria italica
MAAAAAAAASPSAAPPSAAAAVFAVNGERVELRGGEVDPGATLLEFLRTRTRFTGPKLGCGEGGCGACVVLLSTYDAASGAVSHAAASSCLTLVHGLHHRAVTTTEGLGGRGRGLHAVHERLAGFHASQCGFCTPGVCMSLAAALAAADAKKGDGRPAPPEGSARLTAAEAERAVAGNLCRCTGYRPIADACKSFAADVDLEDLGLNSFWRKGGAHASKLPRYEEGSIGVFPEFLKAEIRASAGIEGCTPPALLGSGSTWHWPRSVEEYYKLVGSELFGKSGTKVVVGNTAAGVYREAEVYDRYIDLRCILELNSVSKEANGVEIGAAVSISKAIEALREDGGCNDVIFCKIADHMEKVASPFVRNTASLGGNLIMAQRDQFASDIATILLAAGSSLCIQVSSERLTITLEEFLQMPPCDYKTLLLSIYIPRWTPIGDLSGDGTMDRTVSTRGNSVLFETYRAAPRPLGNAVAYLNAAFLAHVASDGTSGSIILRELCLAFGAYGTQHAIRASNVEKLLVGKPITASVLLEACTLLKKTIVPKEGTRHAAYRSSLAVAFLFSFLCPVTKETLKPLKAVHLNGSVPSGTNGNPNCGPDARVDASLKKINNVKPGSYGNDCILEYSKQKIEINKDYLPVGIPAKKVGAALQASGEAVFVDDIPSPKDCLYGAFIYSTKPLAHVRSIELNPSLKKLNTLGIVTVKDIPEGGSNVGANTIFGPEPLFGDPVTQCAGEPLGIVIAETQRFANIAAKQAVIDYNTENLGAPILSIEDAVRRCSYFETPPFLLPQKIGDFSQGMAEADQKIYSAEVKLNSQYYFYMETQTALAVPDEDDCMVVYSSSQCPETTQNVIAKCLGLPCHNVRIITRRVGGGFGGKAVRSLPVATACALAAFKLHRPVRMYLDRKTDMIVSGGRHPMKICYSVGFKSDGKITALHLDLFINAGMTTDVSLIIPHNFIEALKKYNWGAFSYEAKVCKTNTATKSAMRGPGEVQGSYVAEAIVEHVASALSTDANLVRQRNLHTIESLALFHSECTEDDMGYTLPSICGQLTASENFQHRLEVVKSFNKNNRWKKRGLSFVPIVHKVLSRPTPGKVSILNDGSIAVEVGGIELGQGLWTKVKQMAAFGLGQLWADRSQELLERIRVIQADTLSNVQGGWTTGSTTSESSCEAVRLACNILVDRLKLVKEQFQEKQSNLSWDELISKAKMAGLDLSAREYYIPGPSGSYLNYGAAASEVEIDLLTGATTIVRSDLIYDCGQSLNPAVDLGQVEGAFVQGIGYFMTEEYVTNSDGLVISDGTWTYKIPTVDTIPKQFNVKLLNSGFHKKRVLSSKASGEPPLLLATSVHCATREAIRAARRESHCSASGPSSPSHFDLEVPAIMPVVKELCGLDNVERYLESLLSSK

SEQ ID NO: 898 - DNA, 1227 bp, Arabidopsis lyrata
agacgtcaaagagtttgaaggaagacaaaaatggtgaaatcaaagaaagaagatctaaatcaatttctaattcctcgtcttaacaccatctacgatactctacagttgttcgatcgaacagcttctcctacagtggagaaagttaattggaacgatgttctccagatgtctgatcacctctctaaacaagccaccatagtgggaatgctatggactggagaatctcctaaagctgaatcacttaaagagacaatggagtcttacttcaatgctcttcaagggtttttgctctgttgccatggaagcacagttggtgctggacctacactttcctcaatcatacatgtttctgttaagcaaatcgttgattccagctttagattgttgcagggttctgtctccttatacgagggatcatatgagaaggataagaagccttctattccgcagctttcgggagtggtttgggaggcatgttccagtttcaagaaggttcctgcaacaaacattgttgcgattggtagggctattacacaggttgcggtttccatgaaggatgttcttagggagatgaaagaggtgaagccagcttgtcattcagctgaatgtgaggcatctggtgataatatgtcgggtgatgatgatgacgatttaggtgatgatttgtctcctgaagaaatggaagttgctaggatggttgctgagattgtgtctgagacaatcatggtgataaaagaactcattcgagttatcactgggatgattaagatggagaacccaaatgataatagcgggtttgtggagtcacttgagaagctactgaagctgtgtcaaggaaccggtgtacaaatcgatgagcttggagcttgcgtctatccaccgcaagagatgaacaagatgaaacaaacggtaaagataatacaggggaatctcaacgaatttgaaactgaagttgagcgtttgaagagttcttcagacggctgttcgggagcttgcgaaaagctgcgaaactcgttgaaacacatggaaactgaattggataaaagatgtgaagcagagctagtagttgaaatgcagaatgttactcttggcaattagaaagagtttggattttgcaattgagattttttttggtttgtttctgtcggtaagtggcttgtgcctttagcattcatgtaatgttcaatgtgttgcatacgttatagatatggtacttagattttgttt

SEQ ID NO: 899 - DNA, 1357 bp, Eutrema parvulum
agagagtcaagagttgaaggaagacgaaaatggggaaatcaaagaaagatctaaatcaatttcttattgctcatcttaacaccatctacgatactctccagttgttcgatcgaacagcatctcctacagaggagaaagttaactggaacgatgttcttcagatgtctgaccacctctctaaacaagccaccatagtgggaatgctatggactggagaagctccaaaagctgaatcacttaaggagactatggagtcttacttcaacgctcttcaaggctttttgctttgttgccatggaagcacagttggtgctgggccaacactttcttcgatcatacacgtatctgtcaagcaaatcgttgattccagcttcagattgttgcagggttctgtctccttatacgagggatcatatgagaaggacaagaagccgtctattccgcagctttcaggagtagtttgggaagcatgctcgggttttaagaaggttccagcaacaaacatcactgcgattggcaggggtattacgcaggttgcggtttctatgaaggatgttcttagagagatgaaagaagtgaaaccagcttgtccatcacctgagggtgaggcgtctggtgataataactcagatgatgatgatgaggacgatttaggcgatgatttgtctcctgaagaaatggaagttgctcaaattgttgctgagattgtgtctgagacgatcatggtgataaaagaactcatccgagtcatcaccgggatgatcaagctggagaatccgaaggataacagcgggtttgtggactcgcttgagaagctattgaagctgtgtcaaggaactggagtacaaatcgatgagcttggagcttgcgtttatcctccacaggagatggacaagatgaagcaaacgttgaagataatacaaggaaatctcgatgaagttgagactgaagttgagggtttgaagaattcttcagacgccttttcaggagcttgcagaaagctgcggaactcagtgaaatacatggaagctgaattggacaaaagatgtgaagctgaagtagttgttggaatgcagaatgttactcttggcagttagaaagtttggattttgcaaggtttctttgaagttacattttttgttttgtcagaaagtcttttttgctcttgtcggaaagtggcatgtatcttttaacattcatgtagtatgtattgtccaatgtgttgcattgcatttcctaaatttcatagattttgctttcgtatctacccaacttagattttgctttcgtatctacccaactttaaaataataagaatttcattttggtaattagatatcgtgaatagatttcgaac

SEQ ID NO: 900 - DNA, 1391 bp, Eutrema halophilum
aaagcttcgtgcaaaacccctagcttaacaccactagagaggcgacaagagttgaaggaagacgaaatatggggaaatcaaagagagaagatctgaatcagtttctgattgctcatctcaacaccatctacgatactctccagttgttcgatcgaacagcgtctcctacagaggagaaagttaactggaacgatgttcttcagatgtctgatcacctctctaaacaagccaccatagtgggaatgctatggactggagaagcaccaaaagctgaatcactcaaggagactatggagtcttacttcaacgctcttcaaggctttttgctttgttgccatggaagcacagttggagctgggcctacactttcttcaatcatacatgtctctgtcaagcaaatcgttgattccagcttcagattgttgcagggttctgtttccttatacgagggatcatatgaaaaggacaagaagccttctattccacagctttcaggagcagtttgggaagcatgctcgggtttcaagaaggttcctgcaacaaacatcatcgcaattgggagagctattacgcaggttgcggtttccatgaaggatgttcttagggagatgaaagaagtgaagccagcttgtccttcacctgagcttgaggcatctggtgataataacacagatgatgatgacgacgacgatttaggcgatgatttgtctcctgaagaaatggaagttgctcaaatggttgctgagattgtttctgagatgctcatggtgatgaaagaactcatccgagttatcactgggatgatcaagctggagaatccaaaggataatagcgggtttgtggactcgcttgagaagatactaaagctgtgtcaaggaacaggagtacaaatcgatgagcttggagcttgcgtttatccaccgcaggagataaacaagatgcagcaaacggtgaagataatacaagaaaatctcgatgaagttgaggctgaagttggaggtttgaagagttcttcagacgccttttccggagcttgcataaagcttcgaaactcgatgaagaacatggaaactgaattggacaaaagatgtgaagctgaagtagttgttgagatgcagaatgttactcttggcagttagagaaagtttggattttgtaaggtttctttgagtttcatctttgtctttcaggttctgtcggaaagtggcatgtgtcttttaacattcatgatatgtattgttcagtgtcttgcatacaattcccaaattttatagatatgtaacttagatattgtttttcgtatctaccccacttgcaaaaaataagcatttcattttggaaattggatattgagaatatagatttcggacattctatagagtatagagtat

SEQ ID NO: 901 - DNA, 1262 bp, Brassica napus
tcaggtttagttagtaggtcgcaagagagctgaaggaagaagaagaaaaaatggggaaaacaaagaaagaagatctgaatcaatttctaattgctcatctcaacaccatctacgatactctccagttgttcgaacgaacagcgtctccgacagaggagaaagtgaactggaacgatgttcttcagatgtctgatcacctctctagacaagccaccatagtgggaatgctatggagtggagaagctccaaaagctgagtcacttaaggagactatggagtcttacttcaacgctcttcaaggcttcttactttgttgccatggaagcactgttggtgctggccctactctttcttcactcattcatctctccgtcaagaagatcgtcgattccagcttcagactgttgcagggttccgtctccttatacgagggatcgtatgagaaggacaagaagccgtctattccgcagctctcaggagcagtgtgggaagcatgctcgagtttcaagaaggttcctgcaacaaacatcactgccatcggcagggctattactcaggttgctgtttctatgaaggatgttctcagggagatgaaagaagtgaaaccagcttcacctgaggatgaggcatctggtgataacaacaactcagatgatgacgaagatgatgatgatttagggaatgatctgtctcctgaagaaatggaagttgctcaaatggtagctgagattgtgtctgagaccatcattgtgataaaagaactcatccgagttatcaccgggatgatcaagctggagaatccgaaagataacagcgggtttgtggactcgcttgagaagctactgaagctgtgtaaaggaactggtgatcagatcgatgagatcggagcttgcgtttatcctccacaggagattgtcaagatgaagcaagcgctgaagataatacagggaaatctagacgaagtcgaggctgaggttgagggtttgaagagtgcttcagaggcatttacaggagcttgcgggaagctaagaagctcgatgaaacatatggaaggtgagttagacaagagatgtgaggatgaagtagttgctggaatgcagaatgttactcttggcagttagaatgtttgggattttgcaaggtttcttctaagttacatttttgtgtgtttttattacagtaaagtcgtgtacttttatgttcctgtcggaaagtagcatgtgtgtttttaacattcatgtaatatgcattgttcaatgcgt

SEQ ID NO: 902 - DNA, 1346 bp, Brassica juncea
cgcaagcgagctgaaggaagaagaagaaaaaatggggaaaacaaagaaagaagatctgaatcaatttctgattgctcatctcaacaccatctacgataccctccagttgttcgaacgaacagcgtctccgacagaggagaaagtgaactggaacgatgttcttcagatgtctgatcacctctctaagcaagccaccatagtgggaatgctgtggaatggaggagaagctccaaaagctgaatcagttaaagagactatggagtcttacttcaacgctcttcaaggcttcttactctgctgccacggaagcaccgttggtgctgggtcaacactctcttcactcatacatgtctccgtcaagaagatcgttgattccagcttcagattgttgcagggttctgtctccttatacgagggatcatatgagaaggacaagaagccgtctattcctcagctatcaggagcagtttgggaagcatgctcgagtttcaagaaggttcctgcaacaaacatcactgccattggcagggctattacacaggttgctgtttctatgaaggatgttctcagggagatgaaagaagtcaaaccagctccacctgaggatgaggcatctggtgataacaacaactcagatgaagatgacgatgatttagggaatgatctgtctcctgaagaaatggaagttgctcaaatggtagctgagatcgtgtctgagacgatcacggtgataaaagaactcatccgagttatcacggggatgatcaagctggagaatccgaaagatagcaagagcgggtttgtagactcgcttgagaagctgctgaagctgtgtaaaggaaccggagatcagatcgatgagattggagcttgcgtttatcctccgcaggagattgccaagatgaagcaagcgctgaagattatacagggaaatctaggtgaagtcgaggctgaagttgagggtttgaagaattcttcagaggcattgacgggagcttgcagggagctaagaagctcgatggaacacatggaagctgagttagagaagagatgcgaggatgaagtagttgctgtaatgcagaatgttactctcggcagttagaaagtttgggattttgcaaggttccttcgaagttactttactttcctgtcggaaagtagcatgtgtctgtttaacattcatgtaatatgcattgttcaatgtgttgcgttatatttcataaactttttagatatgttgctttcgtatcttacaaaagttgggacaatgagaacttcattttggaaattagatattgtgactagatttggaacattaattctatggatcatgtggtatcacgtcg

SEQ ID NO: 903 - DNA, 1346 bp, Brassica rapa
agccactagagagagagagagagaggcgcaagcgagctgaaggaagaagaagaaaaaatggggaaaacaaagaaagaagatctgaatcaatttctgattgctcatctcaacaccatctacgatactctccataaactcttcttgcagttgtttgaacgaacagcgtctccgacagaggagaaagtgaactggaacgatgttcttcagatgtctgatcacctctctagacaagccaccatagtgggaatgctgtggagtggagaagctccaaaagctgagtcacttaaggagactatggagtcttacttcaacgctcttcaaggcttcttactttgttgccatggaagcactgttggtgctggccctactctttcttcactcattcatctctccgtcaagaagatcgtcgattccagcttcagactgttgcagggttccgtctccttatacgagggatcgtatgagaaggacaagaagccgtctataccgcagctctcaggagcagtgtgggaagcatgctcgagtttcaagaaggttcctgcgacaaacatcactgccatcggcagggctattactcaggttgctgtttctatgaaggatgttctcagggagatgaaagaagtgaaaccagcttcacctgaggatgatgacgatgacgaagatgatgatgatttagggaatgatctgtctcctgaagaaatggaagttgctcaaatggtagctgagattgtgtctgagaccatcattgtgataaaagaactcatccgagttatcaccgggatgatcaagctggagaatccgaaagataacagcgggtttgtggactcgcttgagaagctactgaagctgtgtaaaggaactggtgatcagatcgatgagatcggagcttgcgtttatcctccacaggagattgttaagatgaagcaagcgctgaagataatacagggaaacttcgatgaagtcgagtccgaagttgagggtttgaagagtgcttcagaggcatttacaggagcttgcgggaagctaagaaacacgatgaaacacatggaaggtgagttagataagagatgtgaggatgaagtagttgctgaaatgcagaatgttacccttggcagttagggttcgggattctgcaaggtttcttctaagttacatttttgtgtgtttttattacagtaaagtcgtgtacttttatgttcctgtcggaaagtagcatgtgtgtttttaacattcatgtaatatgcattgttcaatgcgttgcgttacacttcctataactttaggatgtagcttagattttgctttcgtatcttaccaaacttggaacaatgaaaacttcattttgg

SEQ ID NO: 904 - DNA, 1271 bp, Brassica napus
gaagaaagaagacgaaaaaaatgaggaaaacaaagaaagaagatctgaatcaatttctgattgctcacctcaacaccatctacgatactctcgataatctccagttgttcgaacgaacagcgtttgcgacagaggagaaagtgaactggaacgatgttcttcagatgtctggtcacctctctagacaagccaccatagtgggaatgctgtggagtggagaagctccaaaagctgaatcacttaaggagactatggagtcttacttcaacgctcttcaaggcttcatactttgttgccatggaagcactgttggtgctggccctactctttcttcactcattcatgtctccgtcaagaagatcgtcgattccagcctcagattgttgcagggttctgtctccttatacgagggatcatatgagaaggacaagaagccgtctattccacagctctcaggagcagtttgggaagcatgctctggtttcaagaaggttcctacaacaaacatcactgccattggcagagctattactcaggttgctgtttccatgaaggatgtccttagggagatgaaagaagtgaaaccagctccacctgaggatgaggcatctggtgataacaacaactcagatgatgacgatgatttagggaatgatttgtctcctgaagaaatggaagttgctcaaatggtagctgagattgtgtctgagaccatcatggtgataaaagaactcatccgagttatcaccgggatgatcaagctggagaatccaaaggataacagcgggtttgtggactcgcttgagaagatgctgaagctgtgtaaaggaactggtgatcagatcgatgagattggagcttgtgtttatcctccgcaggagattgtcaagatgaagcaagcgctgaagataatacagggaaacctcgatgaagtcgagtccgaagttgagggtttgaagagtgcttcagaggcatttacaggagcttgcaggaagctgagtagctcgatgaaacacatggaagctgagttagacaagagatgtgaggatgaagtagttactgaaatgcagaatgttactcttggcagctagaaagtttgggattttgcaaggtttcttctaagttacatttctgtgtgtgttctattacagtaaagtcgtgtacttttatgttcctgtcggaaagtagcatgtgtctttttaacactcatgattcatgtaatatgcattgttcaatgtgtgtgcgttacacttcctacaaaacaaaaaaaa

SEQ ID NO: 905 - DNA, 1239 bp, Brassica oleracea
caaccagagagagagagaggcgcaatagagctgaagaaagaagacgaaaaaaatggggaaaacaaagaaagaagatctgaatcaatttctgattcctcacctcaacaccatctacgatactctcgataatctccagttgttcgaacgaacagcgtttgcgacagaggagaaagtgaactggaacgatgctcttcagatgtctggtcatctctctagacaagccaccatagtgggaatgctgtggagtggagaagctccaaaagctgaatcacttaaggggactatggagtcttacttcaacgctcttcaaggcttcatactttgttgccatgtaagcactgttggtgctggccctactctttcttcgctcattcatgtctccgtcaagaagatcgtcgattccagcctcagattgttgcagggttctgtctccttatacgagggatcatatgagaaggacaagaagccgtctattccacggctctcaggagcagtttgggaagcatgctctggtttcaagaaggttcctacaacaaacatcattgccattggcagagctattactcaggttgctgtttccatgaaggatgtcctcagggagatgaaagaagtgaaaccagctccacctgaggatgacgcatctggtgataacaacaactcagatgatgatgatgatttagggaatgatctgtctcccgaagaaatggaaattgctcaaatggtagctgagattgtgtctgagaccatcatggtgacaaaagaactcatccgagttatcaccgggatgatcaagctggagaatccaaaggataacagcgggtttgtggactcgcttgagaagatgctgaagctgtgtaaaggaactggtgatcagatcgatgagattggagcttgtgtttatcctccgcaggagattgtcaagatgaagcaagcgctgaagataatacagggaaacctcgatgaagtcgagtccgaagttgagggtttgaagagtgcttcagaggcatttacaggagcttgcaggaagctgagtagctcgatgaaacacatggaagctgagttagacaagagatgcgaggatgaagtagttactgaaatgcagaatgttactcttggcagctagaaagtttaggattttgcaaggtttcttctaagttacatttttgtgtgtgttttattacagtaaagtcgtgtacttttatgttcctgtcggaaagtagcatgtgtcttttaacactc

SEQ ID NO: 906 - DNA, 1285 bp, Brassica oleracea
gagagagagagaggcgcaatagagctgaagaaagaagacgaaaaaaatggggaaaacaaagaaagaagatctgaatcaatttctgattcctcacctcaacaccatctacgatactctcgataatctccagttgttcgaacgaacagcgtttgcgacagaggagaaagtgaactggaacgatgctcttcagatgtctggtcatctctctagacaagccaccatagtgggaatgctgtggagtggagaagctccaaaagctgaatcacttaaggggactatggagtcttacttcaacgctcttcaaggcttcatactttgttgccatgtaagcactgttggtactggccctactctttcttcgctcattcatgtctccgtcaagaagatcgtcgattccagcctcagattgttgcagggttctgtctccttatacgagggatcatatgagaaggacaagaagccgtctattccacggctctcaggagcagtttgggaagcatgctctggtttcaagaaggttcctacaacaaacatcattgccattggcagagctattactcaggttgctgtttccatgaaggatgtcctcagggagatgaaagaagtgaaaccagctccacctgaggatgacgcatctggtgataacaacaactcagatgatgatgatgatttagggaatgatctgtctcccgaagaaatggaaattgctcaaatggtagctgagattgtgtctgagaccatcatggtgacaaaagaactcatccgagttatcaccgggatgatcaagctggagaatccaaaggataacagcgggtttgtggactcgcttgagaagatgctgaagctgtgtaaaggaactggtgatcagatcgatgagattggagcttgtgtttatcctccgcaggagattgtcaagatgaagcaagcgctgaagataatacagggaaacctcgatgaagtcgagtccgaagttgagggtttgaagagtgcttcagaggcatttacaggagcttgcaggaagctgagtagctcgatgaaacacatggaagctgagttagacaagagatgtgaggatgaagtagttactgaaatgcagaatgttactcttggcagctagaaagtttgggattttgcaaggtttcttctaagttacatttttgtgtgtgttttattacagtaaagtcgtgtacttttatgttcctgtcggaaagtagcatgtgtctttttaacactcatgattcatgtaatatgcattgttcaatgtgtgtgcgttacacttcctaaa

SEQ ID NO: 907 - DNA, 1999 bp, Arabidopsis lyrata
ctgatctgaagcaattgcaatctcctcggttgtgtgagaatcaatcatcatgtatcgtcttgtcaccaacgttgcttccaaagctaggattgccagaaactgtacaagccagattggaagcaggctcaattctactaggaattatgctgcaaaagacataaggtttggtgttgaagctcgggctttaatgcttaagggtgtcgaggatcttgctgatgcagttaaagtcactatgggacctaagggccgtaatgtcatcatcgaacaaagctggggtgcaccaaaggtgacaaaagatggtgtgactgttgccaagagcattgagttcaaggacagaattaagaacgttggtgccagtcttgtcaaacaggttgctaacgccacaaatgacgtagctggtgatggaacaacatgtgctacagtcctaactcgagctatcttcacggaaggttgtaaatcagttgccgctggaatgaatgcaatggacctaagacgtggtatcaaattggcagttgatactgttgtgacgaacttgcagagccgagcacgcatgattagcacttctgaagaaattgcccaagttggaacaatatcagctaatggagatagagaaattggtgaactgattgcaaaggctatggaaactgttggcaaagagggagtgatcacaattcaagatggcaagaccttgtttaatgagctggaagttgttgagggtatgaagattgacagaggatacatctccccatacttcattactaacccgaaaacccaaaaatgtgaactagaagatcctctcattcttatccacgagaagaaaatttcgaatataaacgctatggtgaaagttttagaactggccctcaagaagcaaaggccgctgctgatcgttgctgaggatgtggagagtgatgctcttgccaccctcattctgaacaaacttcgtgctggaatcaaggtctgtgctgtgaaggcccctggttttggagagaaccgaaaggccaatttacacgatctagctgccctcaccggagcccaggtaataacagaagagttaggtatgaatctcgacaacattgacctcagtatgttcggaaactgcaagaagataactgtatccaaagacgatactgttgttctcgatggggctggtgacaagcaagcaattggggaacgatgtgaacagatacgatccatggttgaagcgagcacgtctgattatgacaaggagaagttgcaagaaaggttggctaagctttcgggtggtgttgctgtactgaagattggaggagcgagtgagacagaagttagcgaaaagaaagatagagtaactgatgctctaaatgccactaaagcagccgtagaagagggtattgttccaggtggtggtgttgctcttttgtatgcttcgaaagaacttgataagctttccacagctaactttgatcagaaaattggtgttcaaatcattcaaaacgctctcaagacacctgtttacacgattgcttccaatgctggagtcgagggtgcagtcatcgtaggcaagcttttggagcaagataatcctgaccttggttatgatgctgctaaaggagaatatgtggacatggtaaaagccggtattattgatcctttgaaagtgatcagaaccgcattggttgatgctgcaagtgtctcgtctttgttgacaacgactgaagcagttgtgactgagattccaacgaaagaggttgtgtctccgggtatgggtggcggcatgggtggcatgggcggtatgggaggaatgggtttctgagaagaatcataaacgctgactaggtttctttggaatctgtttgtgagatgctacggttgcttcgttgacaagggactaatggattctttactcatgattgaaagagagagagagagacctttagattttccatgatttttaattcacaaacgatttataaactattttgaaaaatatccttttcgggttcatgcaaatttcttc

SEQ ID NO: 908 - DNA, 1939 bp, Brassica napus
gggttgacttagaattttaccaccatgtatcgccttatctccagcattgcttcaaaagctagagttgccagaaactgtacatcccagattggaagcagactcagttccactaggaattatgcagccaaagacataaggttcggtgttgagggtcgtgctttgatgcttagaggtgtcgaggagcttgctgatgctgttaaagtcactatgggaccaaagggtcgtaatgtcatcatcgaacaaagctggggtgcacctaaggtgacaaaggatggtgtaactgttgccaagagcattgagttcaaggacagagtcaagaacgttggtgccagtcttgtcaaacaggttgctaacgccaccaatgacgttgctggtgatggaacaacgtgtgctacggttcttactagagctatcttcacggaaggctgtaaatcagtcgctgctggaatgaatgcaatggacttaagacgtggtatcaaactggctgttgacaccgttgtgacgaacttgaagagccgagcacgcatgattagcacttctgaggaaattgctcaagttggaaccatatcagctaatggagatagagaaattggcgaactgattgcaaaggctatggagagtgttggcaaagagggagtgatcacaatccaagatggcaagaccttgtttaacgagcttgaagttgttgagggtatgaagattgacaggggatacatctccccatacttcattacaaaccagaagaaccaaaaatgtgaactagaagatcctctcattctaatccacgagaagaaaatctccaatttaaattctatggtgaaagtcttagaacttgccctcaagagtcaaaggtcgctgttgatcgttgcggaggatttggagagtgatgctcttgccgtgctaattctaaacaagctccgtgctggaattaaggtctgtgctgtgaaggctcctggttttggagaaaaccgtaaggcaaacatgcacgatctagctaccctcaccggagcccaggtaataacagaagagttgggtatgaatcttgagaaaattgacctcagtatgcttggaaactgcaaaaagataactgtatccaaagacgacactgttttccttgatggggctggtgacaagaaagcaattggggagcgatgtgaacagatacgatccatggttgaagcgagcgagtctgactatgacaaggagaagctacaagaaaggttggctaagctttctggtggtgttgctgtactaaagattggaggtgcgagcgagtcagaagttggagaaaagaaagatcgagtgaccgatgctctaaatgccaccaaagcagctgttgaagagggtattgttccaggtggtggtgttgctcttttgtacgcgtcaaaagaacttgagaagctttcaacagctaactttgatcagaaaatcggtgtccaaatcatccagaacgctctcaagacacctgtttacacaattgcttccaacgctggagtcgagggtgcagtcattgtaggcaagcttttggaatcagataatcctgacctcggttatgatgctgctaaaggagaatacgttgatatggtgaagtctggtattatcgaccctgtgaaagtgatcagaaccgcattggttgatgctgcaagtgtctcgtctttgttgacaacaacggaagcagttgtgactgagattccaactaaagaggatgcgtctccagctatgggcggtggtggcggcggaatgggtggtatgggcggtatgggaggaatgggtttctgatgagaaccatgccatgctagcttaaggttactttggagattgttttgagatgataaagttgtttcatgctcaaggaactaacggattcttttttctgtcatgattgaaagggagagaccttaagatttttccatgatttctggatgtccttcacaatcga

SEQ ID NO: 909 - DNA, 2131 bp, Eutrema halophilum
cttggagaaaacgtaaaaccctaaaccctaggtgcttctagaatcatcgctctgcttcatttctcttcttctctgcgaattgtcaagttcgcttatttagttcgatctgttctgaagcaattgtaatcttctcttgttgagtgagaatctatcaccatgtatcgccttgtctccaacattgcttcaaaagccaggattgccagaaattgtacaagccaggttggaagcaggctcaattctactaggaattatgcagcaaaagacataaggttcggtgttgaggctagggcttcaatgcttagaggtgtcgaggagcttgctgatgcagttaaagtcactatgggacccaagggtcgtaatgttatcatcgaacaaagctggggtgcaccaaaggtgacaaaggatggtgttactgttgccaagagcattgagttcaaggacagagtcaagaacgttggtgccagtcttgtcaaacaggttgctaacgccacaaatgatgtagctggtgatggaacaacgtgtgctacagtcctcacgcgagctatcttcacggaaggttgtaaatcagttgctgccggaatgaatgcaatggacctaagacgtggtatcaagttggcagttgatactgttgtgacgaacttgaagagccgagcacgcatgattagcacttctgaagaaattgcccaagttggaacaatatcagctaatggagacagagaaattggtgaattgattgcaaaggccatggaaagcgtcggcaaagagggagtaatcacaattcaagatggcaagaccttgtataatgagctagaagttgttgagggtatgaagatcgataggggatacatctccccatacttcataactaaccagaaaaaccaaaaatgtgaactagatgatcctctcattctaatccacgagaagaaaatttccaatttaaatgctatggtgaaagtcttagaactggccctcaagaagcaaaggccgctgctgatcgttgcggaggatttggagagcgatgctcttgccgtgctaattctgaacaaacttcgtgctggaatcaaggtctgtgctgtgaaggcccctggctttggagaaaaccgaaaagccaatttacatgatctagctatcctcaccggagcccaggtaataacagaagagttgggtttgaatcttgagaaagtcgacctcagtatgtttggaaactgcaaaaagataactgtatccaaagacgacactgtttttcttgatggggctggtgacaagaaatcaattggggaacgatgtgaacagatacgatccatggttgaagcaagcgagtctgactatgacaaggagaagttacaagaaagattggcgaaactttctggtggtgttgctgtactaaagattggaggatcaagtgaggctgaagttggcgaaaagaaagacagagtaaccgatgctctaaatgctaccaaagcagctgtagaagagggtattgttccaggtggtggtgttgctcttttgtatgcgtcaaaagaacttgagaagctttccactgctaactttgatcagaaaattggtgtccaaatcatccaaaacgccctcaagacacctgttcacacgattgcttccaacgctggagtcgagggtgcagttatcgtaggcaagcttttggagcaagataatcctgacctcggttatgatgctgctaaaggagaatacgtcgatatggtaaaggctggtatcatcgaccctctgaaagtgatcagaaccgcattggttgatgctgcaagtgtctcgtctttgttgacaacgacggaagcagttgtgactgagattccagcgaaagaggaagcatctccggctatgggcggtggcatggacggcggcatgggcggtatgggaggaatgggtttctaatgagaatcataaaccctagctaggttactttggaaactgttgtgctatgttatggttaattcatccacaaggcactaattgatgcttttttttttcttttttctatatcattattggaagaagagagactcagatttttccatgatctcgggattttcaatcctcaattgatttaataaataaaaatttaggaaacaaaactcggggaattttttccatacaagtc

SEQ ID NO: 910 - DNA, 1956 bp, Brassica oleracea
gatctgtttctgaagcaaactgtgatcatcgtctcgggttgacttagaattttaccaccatgtatcgtcttatctccagcattgcttcaaaagctagagttgccagaaactgtacatcccagattggaagcagactcagttccactaggaattatgcagccaaagacataaggttcggtgttgagggtcgtgctttgatgcttagaggtgtcgaggagcttgctgatgctgttaaagtcaccatgggaccaaagggtcgtaatgtcatcatcgaacaaagctggggtgcacctaaggtgacaaaggatggtgtaactgttgccaagagcattgagttcaaggacagagtcaagaacgttggtgccagtcttgtcaaacaggttgctaacgccaccaatgacgttgctggtgatggaacaacgtgtgctacggttcttactagagctatcttcacggaaggctgtaaatcagtcgctgctggaatgaatgcaatggacttaagacgtggtatcaaactggctgttgacaccgttgtgaccaacttgaagagccgagcacgcatgattagcacttctgaggaaattgctcaagttggaaccatatcagctaatggagatagagaaattggtgaactgattgcaaaggctatggagagtgttggcaaagagggagtcatcacaatccaagatggcaagaccttgtttaacgagcttgaagttgttgagggtatgaagattgacaggggatacatctccccatacttcattacaaaccagaagaaccaaaaatgtgaactagaagatcctctcattctaatccacgagaagaaaatctccaatttaaattctatggtgaaagtcttagaacttgccctcaagagtcaaaggtcgctgttgatcgttgcggaggatttggagagtgatgctcttgccgtgctaattctaaacaagctccgtgctggaattaaggtctgtgctgtgaaggctcctggttttggagaaaaccgtaaggcaaacatgcacgatctagctaccctcaccggagcccaggtaataacagaagagttgggtatgaatcttgagaaaattgacctcagtatgcttggaaactgcaaaaagataactgtatccaaagacgacactgttttccttgatggggctggtgacaagaaagcaattggggagcgatgtgaacagatacgatccatggttgaagcgagcgagtctgactatgacaaggagaagctacaagaaaggttggctaagctttctggtggtgttgctgtactaaagattggaggtgcgagcgagtcagaagttggagaaaagaaagatcgagtgaccgatgctctaaatgccaccaaagcagctgttgaagagggtattgttccaggtggtggtgttgctcttttgtacgcgtcaaaagaacttgacaagctttcaacagctaactttgatcagaaaatcggtgtccaaatcatccagaacgctctcaagacacctgtttacacaattgcttccaacgctggagtcgagggtgcagtcattgtaggcaagcttttggaatcagataatcctgacctcggttatgatgctgctaaaggagaatacgttgatatggtgaagtctggtattatcgaccctgtgaaagtgatcagaaccgcattggttgatgctgcaagtgtctcgtctttgttgacaacaacggaagcagttgtgactgagattccaactaaagaggatgcgtctccagctatgggcggtggtggcggcggaatgggtggtatgggcggtatgggaggaatgggtttctgatgagaaccatgccatgctagcttaaggttactttggagattgttttgagatgataaagttgtttcatgctcaaggaactaacggattcttttttctgtcatgattgaaagggagagaccttaagatttttccatgatttctg

SEQ ID NO: 911 - DNA, 1761 bp, Eutrema halophilum
atgtatcgccttctcaccaacattgcctcaaaagccaggattgccagaaactgcacaagccaggttggaagcaggctcaattctactaggaattatgcagcaaaagacataaggttcggtgttgaggctagggcttcaatgcttagaggtgtcgaggagcttgctgatgcagttaaagtcactatgggacccaagggtcgtaatgtcatcatcgaacaaagctggggtgcaccaaaggtgacaaaggatggtgttactgttgccaagagcattgagttcaaggacagagtcaagaacgttggtgccagtcttgtcaaacaggttgctaacgccacaaatgatgtagctggtgatggaacaacgtgtgctacagtccttactcgagctatcttcacggaaggttgtaaatcagttgctgccggaatgaatgcaatggacctacgacgtggtatcaagttggcagttgatactgttgtgacgaacttgaagagccgagcacgcatgattagcacttctgaagaaattgcccaagttggaacaatatcagctaatggagatagagaaattggtgaactgattgcaaaggccatggagagtgtcggcaaagagggagtgatcacaattcaagatggcaagaccttgtttaatgagctggaaattgttgagggtatgaagattgataggggatatatctccccatacttcataacaaaccagaaaaatcaaaaatgtgaactagaagatcctctcattctaatccacgagaagaaaatttccaatttaaattctatggtcaaagtcttagaattggccctcaagacgcaaaggcctcttcttatcgttgcagaggatttggagagcgatgcgcttgccgtgcttgttctgaacaaacttcgtgctggaatcaaggtctgtgctgtgaaggcccctggctttggagaaaaccgaaaggccaatttacacgatctagctgtcctcaccggaggccaggtaataacagaagagttaggtatgaatcttgagaaagtcgacctcagtatgtttggaaactgcaaaaagataactgtatccaaagacgacactgtttttcttgatggggctggtgacaagaaatcaattggggaacgatgtgaacagatacgatccatggttgaagcgagcgagtctgactatgacaaggagaagttacaagaaaggttagcaaagctttctggtggtgttgctgtactaaagattggaggagcaagtgagtcagaagttggcgaaaagaaagatagagtaaccgacgctctaaatgctaccaaagcagctgtagaagagggtattgttccaggtggtggtgttgctctcttgtacgcgtcaaaagaacttgagaagctttccacagctaactttgatcagaaaatcggtgtccaaatcatccaaaacgctctcaagacacctgttcacacgattgcttccaatgccggagtcgagggtgcagttatcgtaggcaagctattggagcaagataatcccgacctcggttatgatgctgctaaaggagaatacgtcgatatggtaaagtctggtattatcgaccctgtgaaagtgatcagaaccgcattggttgatgctgcaagtgtctcgtctttgttgacaacgacggaagcagttgtgactgagattccaacgaaagaagaagcgtctccggctatgggcggtggtggcatgggaggcatgggcggtggaatgggaggcatgggtttctgaggacaacca

SEQ ID NO: 912 - DNA, 2111 bp, Brassica rapa
ggctgtacttttatttctcctcttggttcgttcagttgagcttctctttagttcgatctgtttctgaagcaaactgtgatcatcgtctcgggttgacttagaattttaccaccatgtatcgtcttatctccagcattgcttcaaaagctagagttgccagaaactgtacatcccagattggaagcagactcagttccactaggaattatgcagccaaagacataaggttcggtgttgagggtcgtgctttgatgcttagaggtgtcgaggagcttgctgatgctgttaaagtcaccatgggaccaaagggtcgtaatgtcatcatcgaacaaagctggggtgcacctaaggtgacaaaggatggtgtaactgttgccaagagcattgagttcaaggacagagtcaagaacgttggtgccagtcttgtcaaacaggttgctaacgccaccaatgacgttgctggtgatggaacaacgtgtgctacggttcttactagagctatcttcacggaaggctgtaaatcagtcgctgctggaatgaatgcaatggacttaagacgtggtatcaaactggctgttgacaccgttgtgacgaacttgaagagccgagcacgcatgattagcacttctgaggaaattgctcaagttggaaccatatcagctaatggcgatagagaaattggtgaactgattgcaaaggctatggagagtgttggcaaagagggagtcatcacaatccaagatggcaagaccttgtttaacgagcttgaagttgttgagggtatgaagattgacaggggatacatctccccatacttcattacaaaccagaagaaccaaaaatgtgaactagaagatcctctcattctaatccacgagaagaaaatctccaatttaaattctatggtgaaagtcttagaacttgccctcaagagtcaaaggtcgctgttgatcgttgcggaggatttggagagtgatgctcttgccgtgctaattctaaacaagctccgtgctggaattaaggtctgtgctgtgaaggctcctggttttggagaaaaccgtaaggcaaacatgcacgatctagctaccctcaccggagcccaggtaataacagaagagttgggtatgaatcttgagaaaattgacctcagtatgcttggaaactgcaaaaagataactgtatccaaagacgacactgttttccttgatggggctggtgacaagaaagcaattggggagcgatgtgaacagatacgatccatggttgaagcgagcgagtctgacgatgacaaggagaagctacaagaaaggctggctaagcttgctggtggcgttgctgtactaaagattggaggtgcgagcgagtcagaagttggagaaaagaaagatcgagtgaccgatgctctaaatgccaccaaagcagctgttgaagagggtattgttccaggtggtggtgttgctcttttgtacgcgtcaaaagaacttgacaagctttcaacagctaactttgatcagaaaatcggtgtccaaatcatccagaacgctctcaagacacctgtttacaccattgcttccaacgctggagtcgagggtgcagtcattgtaggcaagcttttggaatcagataatcctgacctcggttatgatgctgctaaaggagaatacgttgatatggtgaagtctggtattatcgaccctgtgaaagtgatcagaaccgcattggttgatgctgcaagtgtctcgtctttgttgacaacaacggaagcagttgtgactgagattccaactaaagaggatgcgtctccagctatgggcggtggtggcggcggcatgggtggtatgggcggtatgggaggaatgggtttctgataagaaccatgccatgctagctaaggttactttggagattgttttgagatgataaagttgtttcatgctcaaggaactaacggattcttttttctgtcatgattgaaagggagagaccttaagatttttccatgatttctggatgtccttcacaatcgatttattaaaaggaaatttgggaaaagaaaacaactaaactaggctattgtctctttagtacaaaatcaaattttgtcatttttg

SEQ ID NO: 913 - DNA, 2115 bp, Raphanus sativus
ggaatttctcctctttctgcgagttgcgaattgtcaacttagcttctttcccgatctgttctgaagcaattgtaatcccctccccctgatcgactacctaccaccatgtatcgtcttatcaccagcattgcttcaaaagctagagttgccagaaactgtacaactcagattggaagcaggctcagttccactaggaattatgcagcgaaagacataaggttcggtgttgaaggccgggctttgatgcttagaggtgttgaggagctcgctgatgctgttaaagtcactatgggaccaaagggtcgtaatgtcatcatcgaacaaagctggggcgcaccaaaggtgacaaaggatggtgttactgtagccaagagcattgagttcaaggacagagtcaagaacgttggtgccagtcttgtcaaacaggttgctaacgccaccaatgatgttgctggtgatggaacaacgtgtgctacagttcttactagagctatcttcacagaaggctgcaaatcagtcgctgctggaatgaatgccatggacctaagacgcggtatcaaactggccgttgacaccgttgtgacgaacttgaagagccgagcacgcatgattagcacttctgaggaaattgctcaagttggaaccatatcagctaatggagatagagaaattggtgaactgattgcaaaggctatggaaagtgttggcaaagagggagtgatcacaatccaagatggcaagaccttgtttaacgagcttgaagttgttgagggtatgaagattgacaggggatacatctccccatacttcattacaaaccagaacaaccaaaaatgtgaactagaagatcctctcattctcatccacgagaagaaaatctccaatttgaattctatggtgaaagtcttagaactggccctcaagagtcaaaggtcgctgttgatcgttgcggaggatttggagagtgatgctcttgccgtcctaattctgaacaagcttcgtgctggaatcaaggtctgtgctgtgaaggcccctggttttggagaaaaccgtaaggccaacatgcacgatctagctaccctcaccggagctcaggtgataactgaagagttgggtatgaatctcgagaaaatcgacctcagcatgcttggaaactgcaaaaagataactgtatccaaggacgacactgttttccttgacggagctggtgacaagaaatcaattggggagcgatgtgaacagatacgatccatggttgaagcgagcgagtctgactatgacaaggagaagctacaagaaaggttggctaagctttctggtggtgttgctgtactaaagattggaggagcgagtgagtcagaagtaggagacaagaaagatagagtcaccgatgctctcaatgccaccaaagcagctgttgaagagggtatcgttcccggtggtggtgttgctcttttgtacgcgtcaaaagaactcgagaagctttccacagctaactttgatcagaaaatcggtgtccaaatcatccaaaacgctctcaagacacctgtttacacaattgcttccaacgctggagtcgagggtgcagtcattgtaggcaagcttttggaatcagataatcctgacctcggttacgatgctgctaaaggagaatacgttgatatggtcaagtctggtatcatcgaccctgtgaaagtgatcagaaccgcattggttgatgctgcaagtgtctcgtctttgttgacaacaacggaagcagttgtgactgagattccaacgaaagaggatgcgtctccagctatgggcggtggtggcggcggcatgggtggtatgggcggtatgggaggaatgggtttctgatgagagaacaagttttactttggagatcgttgtgagatgatgataaggttgcttcatccactatacactaatggatcctcctttttttctgtcatgattggaatagagatagaccataagatttttcctttctggatttcattcacaatcaatctataaaatatctaaattctttggtcatacaagtctttttgtgttatcttggaaaattatatagaatactacagttcaggaaatattcagtgaggtttcgca

SEQ ID NO: 914 - DNA, 2047 bp, Brassica napus
cttaatttctcctcctttctgcgagttgcgaattgtcaatttagctcctttccgatctgttctgaagccactgtaatcctctctgattgattgacaatctatcaccatgtataggctcgtctccagcgttgcttcgaaagctagagtcgccagaaactgtacaactcagattggaagcagactcagtgccactaggaactatgcagcaaaagacataaagttcggtgttgaaggtcgtgctttgatgcttagaggtgtcgaggagcttgctgatgctgttcaagtcactatgggacccaagggtcgtaatgtcatcatcgaacaaagctggggtgcgccaaaggtgaccaaggatggtgttactgtcgccaagagcattgagttcaaggacagagtcaagaacgttggtgctagtcttgtcaaacaggttgctaacgccacaaatgatgtagctggtgatggaacaacctgtgctacggttcttactcgagctatcttcacggaaggttgtaaatcggttgctgctggaatgaatgcaatggacctaaggcgtggaatcaaattggctgttgatactgtcgtcacgaacttgaagagccgagcacgcatgattagcacttctgaggaaatcgctcaagttgggacaatatcagctaatggagatagagaaattggtgaactgattgcaaaggctatggaaagtgttggcaaagagggagtgatcacaattcaggatggaaagaccttgtttaacgagcttgaggttgttgagggtatgaagatcgacagggggtacatttccccgtacttcattacaaaccagaagaaccaaaaatgtgaacttgaagatcctctcattctcatccacgagaagaaaatctctaatttaaattctattgtgaaggtcttagaactggctctcaagaagcaaaggccattgctgattgttgcggaggatttggatagcgaggctcttgccgtgctaattctaaacaaacttcgtgctggaatcaaggtctgtgctgtgaaggcccctggttttggagaaaaccgaaaggccaacttacaggatctagctatcctcaccggagcccaggtaattacagaagagctaggtatgaatctcgagaaagtggacctcagcatgtttggaaactgcaaaaagataactgtatccaaagacgacactgttttccttgatggtgctggtgacaagaaatcaattagcgaacgatgtgaacagatacgatccatggttgaagcgagcgaatctgactatgacaaggagaagttacaagaaaggttggctaagctttctggtggtgttgctgtactaaagattggaggagcgagtgagtcagaagttggcgaaaagaaagatagagtaactgatgctctaaatgccaccaaagcagctgtagaagagggtattgttccaggtggtggtgttgctcttttgtacgcgtcaaaagagcttgagaagctttccacagctaactttgatcagaagattggtgttcaaatcatccaaaacgctctcaagacacctgtttacacgattgcatccaacgctggagtagagggtgcagtcgtcgtaggcaagcttttggaatcagatgatcctgacctcggttacgatgctgctaaaggagagtacgttgatatggtaaagtctggtattatcgaccctgtgaaagtgatcagaaccgcattggttgatgctgcaagtgtcgcatctttgttgacaacgacggaagcagttgtgactgatattccaaccaaagaggatgcgtctccagctatgggcggtggcggcggcatgggtggtatgggaggtatgggcggtatgggaggaatgggtttctgatgagaaccatacatgctagctttaggttacttttggaaaatgttgtgagattatatgtttgcttcatccacgagccgatagtggatccttttttctatcatgattggaagagagagagaccctaagattcttacatgatttcttgattcccgattaacaatcaatttataaaataaaata

SEQ ID NO: 915 - DNA, 2035 bp, Brassica oleracea
cttcgctctacttaatttctcctcctttctgcgagttgcgaattgctaattgtcaacttagcttctcttcgatctgttctgaagccactgtaatcctctcggattgattgacaatctatcaccatgtatcgactcgtctccagcgttgcttcgaaagctagagtcgccagaaactgtacaactcagattggaagcagactcagtgccaccaggaactatgcagcaaaagacataaagttcggtgtcgaaggtcgggctttgatgcttagaggtgtcgaggagcttgctgatgctgttcaagtcactatgggacccaagggtcgtaacgtcatcatcgaacaaagctggggtgcgccaaaggtgaccaaggatggtgttactgtcgccaagagcattgagttcaaggacagagtcaagaacgttggtgccagtcttgtcaaacaggttgctaacgccacaaatgatgtagctggtgatggaacaacctgtgctacggttcttactagagctatcttcacggaaggttgtaaatcggttgctgctggaatgaatgcaatggacctaaggcgtggaatcaagttggctgttgataccgttgtcacgaacttgaagagccgagcacgcatgattagcacttctgaggaaatcgctcaagttgggacaatatcagctaatggagatagggaaattggtgaactgattgcaaaggccatggaaagtgttggcaaagagggagtgatcacaattcaggatggcaagaccttgtttaacgagcttgaggttgttgagggtatgaagattgacaggggatacatctccccgtacttcattacaaaccagaagaaccaaaaatgtgaacttgaagatcctctcattctcatccacgagaagaaaatctctaatttaaattctattgtgaaggtcttagaactggctctcaagaagcaaaggccattgctgattgttgcggaggatttggatagcgaggctctcgctgtgctaattctaaacaaacttcgtgctggaatcaaggtctgtgctgtgaaggcccctggttttggagaaaaccgaaaggccaacttacaggacctagctatcctcaccggagcccaggtaattacagaagagctaggtatgaatctcgagaaagtggacctcagcatgtttggaaactgcaaaaagataactgtatccaaagacgacactgttttccttgatggtgctggtgacaagaaatcaattagcgaacgatgtgaacagatacgatccatggttgaagcgagcgaatctgactatgacaaggagaagttacaagaaaggttggctaagctttctggtggtgttgctgtactaaagattggaggagcgagtgagtcagaagttggcgaaaagaaggatagagtaactgatgctctaaatgccaccaaagcagctgtagaagagggtattgttccaggtggtggtgttgctcttttgtacgcgtcaaaagagctcgagaagctttcaacagctaactttgatcagaagattggtgttcaaatcatccaaaacgctctcaagacacctgtttacacgattgcatccaacgctggagtagagggtgcagtcgtcgtaggcaagcttttggaatcagatgatcctgacctcggttacgatgctgctaaaggagagtacgttgatatggtaaaatctggtattatcgaccctgtgaaagtgatcagaaccgcattggttgatgctgcaagtgtcgcatctttgttgacaacgacggaagcagttgtgactgatattccaactaaagaggatgcgtctccagctatgggcggtggtggcggtatgggaggtatgggcggtatgggaggaatgggtttctgatgagaaccatacatgctagctttaggttacttttggaaaatgttgtgagattatatgtttgcttcatccacgagccaatagtggatccttttttctatcatgattggaagagagagagagaccctaagattcttacatgatttcttgattcccgattaac

SEQ ID NO: 916 - DNA, 2119 bp, Brassica rapa
cttggagaaaacgcaaaacccacctaaaccctagtctacttctagaatcttcgttctacttaatttctcctcctttctgcgagttgcgaattgtcaatttagcttctttccgatctgttctgaagccactgtaatcctctctgtttgattgacaatctatcaccatgtataggctcgtctccagcattgcttcaaaagctagagttgccagaaacggtacgacacagattggaagcagactcagttccactaggaactatgcagcaaaagacataaagttcggtgttgaaggtcgcgctttgatgcttagaggtgtcgaggagcttgctgatgctgttcaagtcactatgggacccaagggtcgtaacgtcatcatcgaacaaagctggggtgcgccaaaggttaccaaggatggtgttactgtcgccaagagcattgagttcaaggatagagtcaagaacgttggtgccagtcttgtcaaacaggttgctaacgccactaacgatgttgctggtgatggaacaacctgtgctacggttcttactcgagcgatcttcacggagggttgtaaatcagttgctgctggaatgaacgcaatggacctaaggcgtggaatcaagttggctgttgatactgttgtcacgaacttgaagagccgagcacgcatgattagcacttctgaagaaattgctcaggttggaacaatatcagctaatggggatagagaaattggtgaactgattgcaaaggctatggaaagtgttggcaaagagggagtgatcacaattcaagacggcaagaccttgtttaatgagcttgaggttgttgagggtatgaagattgacagggggtacatctccccgtacttcattacaaaccagaagaaccaaaaatgtgaactagaagatcctctcattctcatccacgagaagaaaatctctaatttaaattctattgtgaaggtcttagaactggctctcaagaagcaaaggccattgctgatcgttgcggaggatttggatagcgaggctctcgctgtgctaattctaaacaaacttcgtgctggaatcaaggtctgtgctgtgaaggcccctggttttggagaaaaccgaaaggccaacttgcaggacctagctatcctcactggagcccaggtaattacagaagagctaggtatgaatctcgagaaagtggacctcagcatgtttggaaactgcaaaaagataactgtatccaaagacgacactgttttccttgatggtgctggtgacaagaaatcaattagcgaacgatgtgaacagatacgatccatggttgaagcgagcgaatctgactatgacaaggagaagttacaagaaaggttggctaagctttctggtggtgttgctgtactaaagattggaggagcgagtgagtcagaagttggcgaaaagaaagatagagtaactgatgctctaaatgccaccaaagcagctgtagaagagggtattgttccaggtggtggtgttgctcttttgtacgcgtcaaaagagcttgagaagctttccacagctaactttgatcagaagattggtgttcaaatcatccaaaacgctctcaagacacctgtttacacgattgcatccaacgctggagtagagggtgcagtcgtcgtaggcaagcttttggaatcagatgatcctgacctcggttacgatgctgctaaaggagagtacgttgatatggtaaagtctggtattatcgaccctgtgaaagtgatcagaaccgcattggttgatgctgcaagtgtcgcatctttgttgacaacgacggaagcagttgtgactgatattccaaccaaagaggatgcgtctccagctatgggcggtggtggcggcatgggtggtatgggaggtatgggcggtatgggaggaatgggtttctgatgaggaccatacatgctagctttaggttacttttggaaaatgttgtgagattatatgtttgcttcatccacgagccgatagtggatccttttttctatcatgattggaagagagagagaccctaagattattacatgatttcttgattcccgattaacaatcaatttataaaataaaataaaattttaaattaa

SEQ ID NO: 917 - DNA, 1908 bp, Brassica napus
tctatcaccatgtatcgactcgtctccagcgttgcttcgaaagctagagtcgccagaaactgtacaactcagattggaagcagactcagtgccaccaggaactatgcagcaaaagacataaagttcggtgtcgaaggtcgggctttgatgcttagaggtgtcgaggagcttgctgatgctgttcaagtcactatgggacccaagggtcgtaacgtcatcatcgagcaaagctggggtgcgccaaaggtgaccaaggatggtgttactgtcgccaagagcattgagttcaaggacagagtcaagaacgttggtgccagtcttgtcaaacaggttgctaacgccacaaatgatgtagctggtgatggaacaacctgtgctacggttcttactagagctatcttcacggaaggttgtaaatcggttgctgctggaatgaatgcaatggacctaaggcgtggaatcaagttggctgttgataccgttgtcacgaacttgaagagccgagcacgcatgattagcacttctgaggaaatcgctcaagttgggacaatatcagctaatggagatagggaaattggtgaactgattgcaaaggccatggaaagtgttggcaaagagggagtgatcacaattcaggatggcaagacctgtttaacgagcttgaggttgttgagggtatgaaaattgacaggggatacatctccccgtactttattacaaaccagaagaaccaaaaatgtgaacttgaagatcctcttattctcatccacgagaagaaaatctctaatttaaattctattgtgaaggtcttagaactggctctcaagaagcaaaggccattgctgattgttgcggaggatttggatagcgaggctcttgccgtgctaattctaaacaaacttcgtgctggaatcaaggtctgtgctgtgaaggcccctggttttggagaaaaccgaaaggccaacttacaggacctagctatcctcaccggagcccaggtaattacagaagagctaggtatgaatctcgagaaagtggacctcagcatgtttggaaactgcaaaaagataactgtatccaaagacgacactgttttccttgatggtgctggtgacaagaaatcaattagcgaacgatgtgaacagatacgatccatggttgaagcgagcgaatctgactatgacaaggagaagttacaagaaaggttggctaagctttctggtggtgttgctgtactaaagattggaggagcgagtgagtcagaagttggcgaaaagaaagatagagtaactgatgctctaaatgccaccaaagcagcggtagaagagggtattgttccaggtggtggtgttgctcttttgtacgcgtcaaaagagctcgagaagctttccacagctaactttgatcagaagattggtgttcaaatcatccaaaacgctctcaagacacctgtttacacgattgcatccaacgctggagtagagggtgcagtcgtcgtaggcaagcttttggaatcagatgatcctgacctcggttacgatgctgctaaaggagagtacgttgatatggtgaagtctggtattatcgaccctgtgaaagtgatcagaaccgcattggttgatgctgcaagtgtcgcatctttgttgacaacgacggaagcagttgtgactgatattccaactaaagaggatgcgtctccagctatgggcggtggtggcggcatgggcggtatgggaggtatgggcggtatgggaggaatgggtttctgatgagaaacaaacatgctagctttaggttacttttggaaaatgttgtgagattatatgattgcttcatccacgagccaatagtggatccttttttctatcatgattggaagagagagagagaccttaagattcttacatg

SEQ ID NO: 918 - DNA, 2066 bp, Brassica napus
gaatcttcgctctacttaatttctcctctttccgcgagctgcgaattgtcaatttagcttctttccgatctgttctgaagccaccgtaatcctctcggattgattgacaacctatcaccatgtatagactcgtctccagcattgcttccaaagctagagttgccagaaacggtacaacacagattggaagcagactcagtgccactaggaattatgcagcaaaagacataaagttcggtgttgaaggtcgggctttgatgcttagaggtgtcgaggagcttgctgatgctgttcaagtcactatgggacccaagggtcgtaacgtcatcatcgaacaaagctggggtgcgccaaaggtgaccaaggatggtgttactgtcgccaagagcattgagttcaaggacagagtcaagaacgttggtgctagtcttgtcaaacaggttgctaacgccacaaatgatgtagctggtgatggaacaacctgtgctacggttcttactcgagcgatcttcacggagggttgtaaatcagttgctgctggaatgaacgcaatggacctaaggcgtggaatcaagttggctgttgatactgttgtcacgaacttgaagagccgagcacgcatgattagcacttctgaagaaattgctcaggttggaacaatatcagctaatggagatagagaaattggtgaactgattgcaaaggctatggaaagtgttggcaaagagggagtgatcacaattcaagacggcaagaccttgtttaatgagcttgaggttgttgagggtatgaagattgacagggggtacatctccccgtacttcattacaaaccagaagaaccaaaaatgtgaactagaagatcctctcattctcatccacgagaagaaaatctctaatttaaattctattgtgaaggtcttagaactggctctcaagaagcaaaggccattgctgatcgttgcggaggatttggatagcgaggctctcgctgtgctaattctaaacaaacttcgtgctggaatcaaggtctgtgctgtgaaggcccctggttttggagaaaaccgaaaggccaacttacaggacctagctatcctcactggagcccaggtaattacagaagagctaggtatgaatctcgagaaagtggacctcagcatgtttggaaactgcaaaaagataactgtatccaaagacgacactgttttccttgatggtgctggtgacaagaaatcaattagcgaacgatgtgaacagatacgatccatggttgaagcgagcgaatctgactatgacaaggagaagttacaagaaaggttggctaagctttctggtggtgttgctgtactaaagattggaggagcgagtgagtcagaagttggcgaaaagaaagatagagtaactgatgctctaaatgccaccaaagcagcggtagaagagggtattgttccaggtggtggtgttgctcttttgtacgcgtcaaaagagctggagaagctttccacagctaactttgatcagaaaatcggtgtccaaatcatccaaaacgctctcaagacacctgtttacacgattgcatccaacgctggagtagagggtgcagtcgtcgtaggcaagcttttggaatcagatgatcccgacctcggttacgatgctgctaaaggagagtacgttgatatggtgaagtctggtattatcgaccctgtgaaagtgatcagaaccgcattggttgatgctgcaagtgtcgcatctttgttgacaacgacggaagcagttgtgactgatattccaactaaagaggatgcgtctccagctatgggcggtggtggcggcatgggcggtatgggaggtatgggcggtatgggaggaatgggtttctgatgagaaacaaacatgctagctttaggttacttttggaaaatgttgtgagattatatgattgcttcatccacgagccaatagtggatccttttttctatcatgattggaagagagagagagaccttaagattcttacatgatttcttgattcccgattaacaatcaatttataagtaccaataaggg

SEQ ID NO: 919 - DNA, 2101 bp, Arabidopsis lyrata
tccactcttcatctctccttccgcctgttctcattgatctaacttgctcatcagaatcatctcttcctcgccatcttcttcatcgttaatcttcttccttctcagtcaccatgtatcgtttcgcttctaacctcgcctccaaggcaaggattgctcaaaatactagccaggtttccagcagaatgagctggagcaggaactatgcagcgaaagaaattaagtttggtgttgaagctcgagctttgatgcttaagggtgttgaagatcttgccgatgctgttaaagtcaccatgggtccaaagggacgtaatgttgtgattgagcaaagttggggtgctcctaaagtgacaaaagatggtgttactgttgctaaaagcattgagttcaaagacaaaattaagaacgttggtgctagtcttgtgaagcaggttgcaaatgctactaatgatgttgctggtgatggtactacttgtgctactgtactcacccgggctatatttaccgaaggatgcaaatcagttgccgcaggaatgaatgcaatggacttgcgacgaggtatttccatggcagttgatgctgtggtgacaaaccttaaaagcagggctaggatgatcagcacatctgaagagattgcacaggttgggaccatttctgctaatggagagagggaaattggtgaactgattgcaaaggctatggagaaggttggcaaagaaggtgtaatcacaatccaagatgggaagacattgtttaacgagttggaagttgtagaggggatgaaattggacagaggttatacgtccccttactttatcacgaatcaaaaaacccaaaaatgtgaactagatgatcctctcatccttatccatgaaaagaagatctcaagcatcaactctatagtgaaagtgttggagttggctctgaagaggcaaaggccactgttgattgtgtctgaagatgtggaaagtgatgctcttgcaactcttatccttaataagctccgcgccggaatcaaggtctgtgccatcaaggcccctggatttggagagaataggaaggccaatttgcaagaccttgctgcccttactggtggagaggttatcacagatgagcttggcatgaatctggagaaggtggacctgggcatgctaggaacctgcaaaaaggttacagtctccaaggacgacactgttattcttgatggggctggcgacaagaaaggcattgaggaaagatgtgaacagattaggtcagcaattgaactgagcacatcagattatgacaaggaaaaactgcaagaaaggttggctaagctctctggaggtgttgcagttttgaagattggaggagcaagtgaagctgaagttggtgagaagaaagacagagtgacagatgctttgaatgccactaaagctgctgttgaagagggtattttgccaggaggaggtgtggctcttttatacgcagcaagagagttggaaaaacttccaacagccaactttgaccagaagattggtgtccagattattcagaatgcattgaagactcctgtttacacaatcgcttcaaatgctggagttgaaggtgctgttatagttggcaagcttttggaacaagataacccggacctcggttatgatgctgctaaaggtgaatatgtggatatggtgaagtccggtatcatagaccctctgaaagtaatcaggacagctctggttgatgctgcgagtgtgtcatctttgttgacgacaactgaagctgtagtggttgagcttccgaaagacgaaagcgagtcagcaggagccggagcaggcatgggtggaatgggaggcatggactactagatccactaaattctgtctttttttttccaccatatttaacttgagaagagagatacgattcttttaggagtctagtctttttctttgtcgttgttgctcaataacctcaaaagttttacaataaacagagcacacttggcaatgttattagacgattagcatcaacaaagttttcttaaggcatcatctctgttttgcattacttctggttcaggtctggtaacaataaaccgactcttcaaattatagtagttata

SEQ ID NO: 920 - DNA, 2117 bp, Tabernaemontana elegans
tgtgttcatgttttccctctccccagaaagttctgcacctctttctcccttccaacacagtctctctcacacattctccttctctgcaatttagaccatgtatcgttttgcagcaaatcttgcatctaaggccagggttgctaaaagcagcagccaacaggttgctagtagatttggatggaatagaaactatgcagcaaaagacattaaatttggagtggaggctcgggctttgatgcttaagggtgttgaggatcttgctgaggcagttaaagtcaccatgggtccaaagggccgtaatgtggtgattgaacaaagttggggtgctcctaaagtgacaaaagatggtgtaactgttgcaaaaagtattgaatttaaagacaaggttaagaatgttggtgcaagcctagtaaaacaggtggctaacgcaactaatgacgttgctggcgatggtactacttgtgcaacaatccttactcgggcgatattcacagaaggctgcaaatcagttgcagctggtatgaatgctatggaccttagacgtggaattaacatggctgtggacaatgtggtgacaaacttgaaaagcagagcacggatgataagcacatcagaagaaattgcacaggttgggacaatttctgccaatggtgaaagagaaattggagagttgattgcaaaggccatggagaaagtaggaaaagaaggagttatcacaattcaagatgggaaaacattattcaatgagttggaagttgtggagggaatgaagctggacaggggctacatatccccatatttcgttacaaatccaaaaacgcagaaatgtgagttggaagatcccctcattctaatccacgagaagaagatttcgagcattaatgctattgtgaaagtgttagagctggctttgaagagacaaaggccccttctaattattgctgaagatgtggagagcgatgcccttgccactctgatcctcaacaaacttcgtgctggaatcaaggtttgtgccatgaaagctcctgggtttggggaaaataggaaggctattctgcatgatctctctgttttgactggaggccaagtcattactgaagagcttgggctgaaccttgataacttggaattggacatgttaggctcatgcaaaaaggtcacaatatccaaggacgatacagttgttcttgatggtgctggggataagaagtccatagaggaaaggtgtgaacagattcgatcttccattgagctaagcacgtctgactacgacaaggagaagctgcaagaacgactagctaagctttctggtggtgtggctgttttgaagattggaggggctagtgaagttgaagttggtgagaagaaagacagagttacagatgctctgaatgcaacaaaggcagctgtagaggaaggaattcttccaggtggtggtgttgcccttctgtatgcatccaaagaattggaaaagctttcaactgccaactttgatcagaagattggcgtgcagattatccagaatgctctgaagacgccagtgcatacaattgcctgcaatgctggtgttgagggtgccgttgttgttggtaaactgttagaacaggagaatcctgatcttggatatgatgcagctaaaggtgaatacgttgatatggttaaggcaggaattatcgatccattgaaagtactaagaacagccttggttgatgcagcgagtgtgtcttccttgttgacaacaacagaagctgttgtggttgaacttcctaaggaggagaaaccagctccggccatgggtggcggcggcatgggtggcatgggtgacatggactactgatcgtccgactgtttggggatcaattgacaaaaactaaataagctttagggatcttgccattttgttcaattgttggagcgaaggcatccttttgtaattcatcaaaggcatctttgtaatcatagtgagtaaattgggtcataatggttaggaattgggaaatctgaacaggatcattggtttgtaacaggattggcattcaagaattttgaggaaatttcttctccccttcgcatgattgatgccaattggacatttttagtagtcccaattgaaattg

SEQ ID NO: 921 - DNA, 1767 bp, Chrysanthemum coronarium
ccaatcatgtatcgcttcgcagcaaatcttgcttccaaatctagaattgcaactaagacaacccgacagattggaagtaggttgaatataagcagaaactatgctgcaaaagatattagatttggagttgatgctagggcattaatgcttagaggcgtcgaagagcttgctgatgctgttaaagttaccatgggcccaaaggggcgtaatgtggttattgaacaaagttacggagcgccaaaagtaacgaaagacggtgtaacggttgcaaaagccattgaatttaatgataaggtgaagaatgttggcgcgagtcttgtaaaacaggttgctaatgctactaatgacgtggctggtgacggtacaacttgtgctacagtccttacacgcgctatattttcagagggttgcaagtcggttgcagctggtatgaatgcaatggacctcaggcgtggtattacgatggctgttgattcagtagtaacaaacttgaaaagtagagctcgtatgataagcacatctgaggaaatcacacaggtgggtacaatttccgcaaacggagaacgtgaaatcggtgaactaatagctaaggctatggaaagagttgggaaagagggtgtcatcactattcaagacggaaagacgttgtataatgaattagaagttgttgagggaatgaagctggacagaggatatatatctccacattttatcacgaacaccaagaatcagaaatgcgaactggatgaccctattgttctaatctacgagaagaagatttcaaacattaattccgtgatcaaagtgttagagttggcactgaagaaacaaaggccactattaatcgttgctgaagatgtggaaagtgaagcgttggctaccttaattcttaacaagctccgtgccggcattaaggtctgtgccataaaagctcctggttttggcgagaacagaaaggccaacttgcaagatcttgccactctcaccggaggccaggttataacagaagaacttggtatgaaccttgacaacgtggagttggaaatgcttggctcgtgtaaaaaggttactgtatccaaagatgacacagtggtgcttgacggtgccggtgataagaagtcgatagaagaacggtgtgaacagattaggtcagcaattgagtcgagcacatctgattatgatagagagaagttccaagagaggttggctaagctttctggtggtgttgctgtactaaagattggaggagccagtgacactgaagtaagtgaaaagaaagacagagttaccgatgctctaaatgccacaaaggctgctgttgaggaaggaatcgtaccaggtggaggcgttgctcttctgtatgcatctaaagaattggacaaattgcaaacagccaatttcgatcagaaaataggggttcagattattcagaatgcactaaagatgccagttcatacaatagcatctaatgctggagtggaaggttcggttgtggttggtaagcttttagagcaagatgacccagatcttggatatgatgccgctaaaggtgaatatgtggacatggtgaaaaatggtatcattgacccgttgaaggtgataaggacagccttggtcgatgcggcaagcgtctcttctttgatgacgactactgaagcaattgtgacggaactcccaaaaccggctagtgaagcagctccaggaatgggcggtggcatgggtggaatgggcggaatgggtggcatggacttttgatcggccctgtga

SEQ ID NO: 922 - DNA, 1979 bp, Amsonia hubrichtii
ctcgtccccccagaaagttctgtctctctctatcactctctttcactctgtttcaaactcttaacacattctaaatctctgcaatttagatcatgtatcgttttgcagcaaatcttgcctctaaggccagggttgctaaaaatagcagccaacaggttggtagtagattgggatggaatagaaattatgcagcaaaagaaattaaatttggagtggaggctcgggctttaatgctgaagggtgttgaggatctcgcggaggcagttaaagtcaccatgggtccaaaaggccgtaatgtggtgattgaacaaagttggggtgctcctaaggtgacaaaagatggtgtaactgttgcaaaaagcattgaattcaaagacaagataaagaatgttggtgcaagcctggtaaaacaggtggctaatgcaactaatgatgttgctggtgatggtactacttgtgcaacaatccttacacgcgcgatattcacagagggctgcaaatctgttgcagctggtatgaatgctatggaccttagacgtggaatcaacatggctgtggatgctgtggtaacaaacttgaaaagcagagcaaggatgataagcacatcagaagaaattgcacaggttgggacaatttctgccaatggtgaaagagaaatcggtgagctgattgcaaaggccatggagaaagtaggaaaagagggagttatcacaattcaagatggaaaaacattatttaatgagttggaagtagtggagggaatgaagatggacaggggttacatatctccatatttcattacaaatcagaaaactcagaaatgtgagatggaagatcctctcattctaatccatgagaagaagatttcaagcattaatgctgttgtaaaggttttagagtttgctttgaagagacaaaggccccttctaattattgctgaagatgtggagagtgatgcccttgctactctgattctcaacaagcttcgagctggaattaaggtttgtgctgtaaaagctcctgggtttggtgaaaataggaaggctaacctgcatgatcttgcagctttgacaggaggccaagttattactgaggagcttgggctgaaccttgataacatggagttggacatgctaggctcatgcaaaaaggtcacaatatccaaggatgacacagttgttcttgatggtgctggggagaagaaggccatagaggaaagatgtgaacagattcgatcttcaattgagcttagcacctctgactatgacaaagagaagctgcaagaacgactagctaagctttctggtggcgtggctgttttgaagattggaggagctagtgaagctgaagttggtgagaagaaagacagagtaacagatgctctgaatgcaacaaaggcagctgtagaagagggaattcttccaggtggtggcgttgctgttttgtatgcatccaaagaattggagaagctgtcaacagccaacttcgatcagaagattggagtgcagattattcagaatgctctgaagatgcctgcgcatataattgcttccaatgctggagttgagggtgctgttgttgttggcaagctgttggagcaggagaatcctgatcttggatatgatgcagctaaaggtgaatacgtggatatggttaaggcaggaattattgatccattgaaagttataagaacagctttggttgatgccgcgagtgtgtcttccttgttgacaacaacagaagctgttgtggtcgaacttccgaaggaggagaagccagctccaggcatgggtggtggcatgggtgacatggactattgataatccttctgctaagtgcctgacagaaactaattcaaagaagaaataagctttagggactcagccattttgtaattcattcaaggcatctttgtaatcatagggagagtaattgtgtgatgatgatggttaggaagtgggaaatctggatttttttgt

SEQ ID NO: 923 - DNA, 2206 bp, Tripterygium wilfordii
ccttcccactccgttaaaaacgcacgctccccgtactctgtcctgtttcagtcagtctttcatcgccgtctctctcgctttctctctttgcttaatctattgactgtcttcgccatgtaccgtctctcttcaagcctcgcctccaaatctcgggttgtgaggaccagtgctcagcaggttggaagcaggttgaactggagcaggaactatgccgccaaagacattagatatggggtagaggcacgcgccttgatgctaagaggtgttgaagagcttgctgacgccgtcaaagtcacaatgggtcccaaggggcgtaatgtggttattgaacaaagctatggtcccccaaaagtgaccaaggatggtgtaactgttgcaaagagtattgagttcaaagataaggtcaagaacattggtgctagcctggtgaaacaggtggcaaatgcaaccaatgatgttgctggcgatgggactacatgtgctacggtcctcacaaaagcaatatttgccgaagggtgcaagtcagttgctgctgggatgaatgcaatggaccttagacgtggtatcactatggcagttgattctgttgtcacaaacttgaagagcagggcaaggatgatcagcacttcggaagaaatagctcaggttggtactatatcagcaaatggagagagggaaattggtgagttgattgctaaggccatggagaaagttggcaaagagggagttatcacaattcaagatgggaagacattattcaacgagttagaagttgttgaggggatgaagttggacaggggctacatttctccttatttcattaccaaccaaaagaatcaaaaatgtgaattagaagatcctctagttctgatccatgagaagaaaatctcaagcataaatgccgtggtgaaagtactagagttggcattgaagaaacaaaggcccttgttgattgttgctgaagatgttgaaagtgatgccctagcaactctaattctcaacaaactgcgtgctggaatcaaggtctgtgcaatcaaagcccctgggtttggagagaacaggaaggccaatctgcaagatcttgcagttctcactggaggagagcttataactgaggagctcggtatgaatcttgaaaaggtggatctggatatgcttgggtcttgcaaaaaggttacagtttcgaaagatgataccgttattcttgatggtgctggtgataagaaggcaattgaggaaagatgcgagcagatcagggctgccattgaatcaagcaaatctgactatgacaaggagaaattgcaagaaagattggcgaaactctcaggaggtgttgctgttttgaagattggaggagctagtgagactgaagttggtgagaagaaagacagagttacggatgccttaaatgccacaaaggcggcagttgaagagggtattgtaccaggtggtggtgttgctcttctttatgcatcgaaagagttggataagctgtcaaccgccaactttgatcagaagattggcgttcaaattattcagaatgcacttaagacacctgtatacacaattgccgcaaatgctggagtagagggagccgttgttgttggtaagctactggagcaggataaccctgatcttggatatgatgctgctaaagatgaatatgtcgatatggtgaaatcgggtatcatcgacccattgaaagtcattaggacagctttagtcgacgcggctagtgtgtcctcgttgatgacaacaactgaagctgtcgtgtctgaacttccaaaggatgagaaggaagttccagcgatgggtggtggcatgggcggtatgggtggcatggattattgagttccttcctgctgcaacaactgccttcaaggaaatagtcgtttaagtccacagttggcccttaatttctttttgatctttaggcaggccatgtaaatgagttattattcacgtggtaggaaatttagtatcaaaccatctcgaagagaaaaattggcaatgtctacggcaatgaaaactgtcgaaatgagacctgttttttggccctgcatttgagaggttatcgattctgtacttctcctggttagtctgtcctagaaaggcactgttaactaatttatttgactagtgctcagcattggaacacagattgattcttaatatttagtggttatgataaatatgtcgacattca

SEQ ID NO: 924 - DNA, 2115 bp, Daucus carota
ctctgcggagctatatgtttttcttgtatcgaccactaaatattgtataagcttttgaattgaagaagacaaacatttgattattctgcaacaatcccagacaagtcatgtatagatttgcagcaaatcttgcctccaaagcacggattgcttcaaacagtagcaaacagattgggagtagattaagtttgagcagaaactatgccgccaaggatattagatttggggttgaagcccgggccttaatgttaaaaggtgttgaagagctcgcagatgcagttaaagtaactatggggcctaaggggcgtactgtggtcattgagcaaccttatggggcaccaaaagttactaaagatggggtaacggttgctaagagcatcgagttcaaggacagagtgaaaaacataggagcaagcctcgtcaaacaggttgcaaatgccaccaatgatgttgcaggggacggtaccacatgtgccacagtcctcacccgtgcaatatttactgagggttccaaatctgttgcagccggtatgaatgcaatggaccttagacgtggcattaccatggcagtagatgctgtggtgacaaatttgaaaagtagagcacggatgataagcacgtctgaagaaatagcacaggtcggaacaatatctgccaatggagagagggaaattggtgagttaattgcgaaggcaatggaaagggttggcaaggagggagtaataacaattcaagacggaaagacactgtacaatgagttggaagttgttgaaggaatgaagctcgataggggttacatatccccgtatttcattacaaatcaaaagaaccagaaatgcgagttggacgaccctctaatcttgattcatgagaagaaaatctctagcataaatgcagtggtgaaagtactagagctggctttaaagaaacaaaggcctcttttgatagttgccgaagatgttgatagtgaagcacttgcaacgctaattctcaacaaactacgtgcaggaataaaggtctgtgcaattaaagctcctgggttcggtgaaaacagaaaggctaatctccaggatctcgctgttcttactggaggccaggttataacggaagaacttggtatgaaccttgataacgtggagttggatatgtttggctcatgcaaaaagatcacaatatctaaggatgacactgttgttcttgatggggctggtgagaaaaagtcaatagaagagaggtgtgaacagataagatcatcaatcgaattgagtacttctgattatgataaagagaaatttcaagaaagattagctaagctttctggtggtgttgccgtcctgaagattggaggagctagtgaaactgaagtcggtgaaaagaaagatagagttacagatgcgctaaatgccacaaaggctgctgtagaggaaggaattgtgccaggtggtggtgttgctcttctttatgcagccaaagaattagataagttgccaacagccaactttgatcagaaaattggtgtacaaattatccagaatgccctaaagacaccagtacacaccattgcctcaaatgctggagtagagggtgctgtggttgttggcaagctgttggagcaggacgaccctgatcttgggtatgatgctgccaaaggtgcttatgttgatatggtcaaagctgggattattgacccgttgaaagtaataagaacagcattggttgatgcagcaagtgtatcttccttgatgacaactacggaggcaatcgttgtcgaaattcccaaggatgaaaaggatgtacctatgggtggcggcatgggcggtatgggtggcatggactattaatagtcatgctggccaacaagtcaagatctacattacagtgaatacagggggcttaacccattaggttaggatagttatatgttggggcaaaaacgccccacatgtaataatcacaccagcaaagagattgataatttcgggatttgtaggcttctcagctatctgaggatgtgttttttcgagaacttgatggcacttctattgtgttcttgtatgctttaggcaattttaagaactcaattctctgggcttgtttgtatcactgaaaattaat

SEQ ID NO: 925 - DNA, 2158 bp, Euonymus alatus
ggagcaaaaccctaaaccctagagcattccttctagagccttccctctctcttaaaaacgcacgctctccccatatttcagtaattcctcctgtttcagtcagtctctcatcgctgcgcctctcagctctctttgctctctagcttctattgacagtcttcaccatgtaccgtctcgcttcaagcctcgtcaacaaatctcgggttgtaaggactagtgcgcagcaggttggaagcaggttgaactggagccggaactatgccgccaaagaaattagatttggggtagatgcacgtgccttgatgttaagaggtgttgaagagctcgctgatgccgtcaaagtcacaatgggtcctaaggggcgtaatgtggttattgaacaaagctatggtgccccaaaagtgacgaaggatggtgtaactgttgcaaagagtattgagttcaaagataaggtcaagaacattggtgctagtctagtgaaacaggtggcgaatgcaaccaatgatgttgctggcgatgggactacatgtgctacagtcctgacaaaagcaatatttgccgaaggttgcaagtcagttgctgctgggatgaatgcaatggaccttagacgtggtatcactatggcagttgattctgttgtcacaaacttgaagagcagggcgaggatgatcagcacttcagaagaaatagctcaggttggtactatatcggcaaatggagagagggaaattggtgagttgattgctaaggccatggagaaagttggcaaagagggagttatcacaattcaagatggaaagacattatttaatgagttagaagttgttgaggggatgaagttggacaggggctacatttctccttatttcattaccaaccaaaagaatcaaaaatgtgaattagaagatcctctagttctgatccatgagaagaaaatctcaagcataaatgcggtggtgaaagtactagagttggcattgaagaaacaaaggcccttattgattgttgctgaagatgttgagagtgatgccctagcaactctaattctcaacaaactacgtgctggaatcaaggtgtgtgctatcaaagcccctgggtttggagagaacaggaaggccaatcttcaagatcttgcagttctcactggaggagagcttataactgaggagctcggtatgaatcttgataaggtggacctggatatgcttgggtcttgcaaaaaggttacagtttcaaaagatgatactgttgttcttgatggcgctggtgataagaagggcatcgaggagagatgtgagcagatcaggtctgcaattgaattgagcacatctgactatgacaaggagaaattgcaagatagattggcaaaactctcaggaggtgttgctgtattgaagatcggaggagctagtgaaactgaagttaatgaaaagaaagacagagttacagatgccttaaatgccacaaaggcggcagtcgaggagggtattgtaccaggtggaggtgttgctcttctttatgcatcaaaagagttggataagctggcaactgccaactttgatcagaagatcggtgttcaaattattcagaatgcactcaagacacctgtatacacaattgccgcaaatgctggagtagagggggctgttgttgttggtaagctactggagcaggatgaccctgatcttggatatgatgccgccaaaggtgaatatgttgatatggtcaaatcgggcatcatcgacccattgaaagtcattaggacagctttggtcgatgcagctagtgtgtcctctttgatgacgacaactgaagctgtcgtatctgaacttccaaaggatgagaaagaaccagcaatgggcggcggaatgggcggcatgggtggcatggattattgagttccttcctgttgtaatgcttttaaatatcgcctttaagcgtcgtgaagtccagagacagttgccccttaatttatttttggtatttaggcaggccatatactgttcataaatgagttattattcaaatgtggtgtgttatttagggtctaacccatcctgaaactctgaaaaattggcaggtgtagggtaatgagaactgtccaataagtcttttttccctgcaattgaggggttattgattctgtactctgtcaatt

SEQ ID NO: 926 - DNA, 2098 bp, Arachis hypogaea
acaccacttcaaaagcaaccctgcttcaatcttcatcttcaccactagtctctgcaatttctttgctcaattcaatcatcagccgccatgtatcgctttgccacttccctagcctctaaagtcaggattgccaggaacagcagtcaacagattggaagtaggttgagttggagcaggaattatgcggccaaggatattcgatttggtgtggaggctcgggctgcgatgcttaagggtgttgaagagcttgctgatgctgtgaaagttacaatgggtcctaaggggcgtaatgtggtgattgagcaaagttttggtgcccctaaagtgacaaaagatggtgtcactgtagccaagagcattgaattcaaggataaagtaaaaaatgtaggtgctagtcttgtaaagcaggttgcaaatgcaaccaatgatgtcgctggtgatggtactacatgtgcgacagttcttactcgagcaattttcacggaagggtgcaagtcagttgctgctggaatgaatgcaatggacctgaggcgaggtataaatatggctgttgatgctgtggtgacaaacctgaaaagcagagcaaggatgattagtacttctgaagaaatagctcaggttgggacaatatcagctaatggggaaagagaaattggtgagttaattgcaaaggctatggagaaagttggcaaagagggtgtaatcactatctcagatggtaagacactgtataacgagttagaagttgttgaaggaatgaagcttgataggggctacatttctccatatttcataactaaccagaagaaccagaaatgtgaacttgaggatccactcattctaatccatgagaagaaaatctcaagtataaatgctatagtcaaagtattagagttggctttaaagagacaaagacctttgttgattgttgccgaagatgtggaaagtgatgcccttgcaactcttattctaaataaacttcgtgctggaatcaaggtatgtgccatcaaagcccctggttttggtgaaaacaggaaatctggacttcaggatcttgctgttcttacgggaggtgatcttatcactgaagagctaggcttgaatcttgaaaaagtggatttggagatgcttggcacgtgtaaaaaggtaacaatttctaaagatgacactgtcattcttgatggcgctggtgacaagaaagcaattgaggaaagatgtgatcagattaggtcagcaattgaaaatagcacttcagattatgacaaggaaaagttgcaggaacgcctggccaaactttctgggggtgttgcagtgctcaagattggaggagccagtgaggctgaagttggtgagaagaaggacagagtgacagatgccttgaatgcaaccaaggctgctgtagaggagggcatagtacctggtggtggtgttgctcttctttatgcatcaaacgaattagataagcttccaactgccaacttcgatcaaaagataggcgtacaaattatccaaaatgccttgaagacacctgtccacacaattgcatcaaatgctggagttgagggtgctgtcgtcgttggaaaactattggaacaggacaatcctgatcttggatatgatgcagcaaaaggtgaatatgttgatatggttaaatccggaattattgatccattgaaggtgatcagaaccgccttggttgatgcagccagtgtatcctctttgatgacaacgactgaggctgttattgctgaactcccaaaggaagatgaggctcctccaatggctggtggcatgggtggaatggggggaatgggtggcatgggttattagtaattgctatttccctgttaatttgggttccttttggagaacaagaatggtcctggtgctccactaatttatagcttttttgtcttattttgttatcataaggcacccatgtatccatagtgagagatcgaagatgtagttaggaaaacttgtgatgattgttttgaaatggtaaccaactttgggaccatttttacatctacattttgatttacggaacattgtttccctgataattatcaattgaaagatggccttcactggttag

SEQ ID NO: 927 - DNA, 2211 bp, Daucus carota
ccctaaaactctttcttctagactcttctcttcctccccagctcttgaaataaatagcctgcgttgctctcatctcctcacttcaaccatacaacatttgtgcttcttgtacatccacataaatctcaatttgcctacagtaattagcttctgtattgaagcagacattcaatctgatcattcttctgcaacctcagagcagtcatgtatagatttgcagccaatcttgcctctaaagcacggattgctacaagcagcacccaacagattgggagtaggttaagtttgagcagaaattatgcggccaaggatattagatttgggattgaagcccgggctttgatgcttaaaggtgttgaagagctagctgatgcagttagagtaactatgggtcctaaggggcgtactgttgttatcgaacaatcttatggggcgccaaaagttacaaaagatggggtgactgttgctaagagcatcgagttcaaggacaaagttaagaacattggggcaagcctcgtcaaacaggttgcaaatgccaccaatgatgttgctggtgatggaactacttgtgccactgtcctcacccgtgcaatatttacggaaggttgcaagtcagttgcagctggtatgaatgccatggaccttagacgtggcattacaatggctgtagatgccgtggtaaccaatttgaaaagtagagcacggatgataagcacatctgaagaaatagcacaggttggaactatatctgcaaatggagaaagagagattggtgagttgatagctaaggcaatggaaagagttggcaaggagggagtaataacaatccaggatgggaaaacattgtataatgaattggaagtcgttgaaggaatgaagctcgataggggttacatatccccgtatttcattacaaatcaaaagaaccagaaatgcgagttggacgaccctctaatcttgattcatgagaagaaaatctctagcataaatgcagtggtgaaagtactagagctggctttaaagaaacaaaggcctcttttgatagttgccgaagatgttgatagtgaagcacttgcaacgctaattctcaacaaactacgtgcaggaataaaggtctgtgcaattaaagctcctgggttcggtgaaaacagaaaggctaatctccaggatctcgctgttcttactggaggccaggttataacggaagaacttggtatgaaccttgataacgtggagttggatatgtttggctcatgcaaaaagatcacaatatctaaggatgacactgttgttcttgatggggctggtgagaaaaagtcaatagaagagaggtgtgaacagataagatcatcaatcgaattgagtacttctgattatgataaagagaaatttcaagaaagattagctaagctttctggtggtgttgccgtcctgaagattggaggagctagtgaaactgaagtcggtgaaaagaaagatagagttacagatgcgcttaatgccacaaaggctgctgtagaggaaggaattgtgccaggtggtggtgttgctcttctttatgcagccaaagaattagataagttgccaacagccaactttgatcagaaaattggtgtacaaattatccagaatgccctaaagacaccagtacacaccattgcctcaaatgctggggtagagggtgctgtggttgttggcaagctgttggagcaggacgaccctgatcttgggtatgatgctgccaaaggtgcttatgttgatatggtcaaagctgggattattgacccgttgaaagtaataagaacagcattggttgatgcagcaagtgtatcttccttgatgacaactacggaggcaatcgtcgttgaacttcccaaggatgaaaaggacatacctatgggtggtggcatgggcggtatgggtggcatggactattgatagtcatgctggctaacaagtccagacctacattacagtgaatacagggggcttaacccattaggttaggatagttatatgttggggcaaaaacgccccacatgtaataatcacgccagcaaagagattgataatttcgggatttgtaggcttctcagctatctgaggatgtgttttttcgagaacttgatggcacttctgttgtgttcttgtatgctttaggcaattttaagaactcaattctctgggcttgtttgtatcactgagaataat

SEQ ID NO: 928 - DNA, 2023 bp, Arabidopsis thaliana
ctctctctctctctccgcctgttctccattgatctaatctaactcgctcatcagaatcatctcttcatcgttaatcctcttccttctcactcaccatgtatcgtttcgcttctaacctcgcctccaaggcaaggattgctcaaaacgctcgccaggtttccagcagaatgagctggagcaggaactatgcagcgaaagagattaagtttggtgttgaagctcgagctttgatgcttaagggtgttgaagatcttgctgatgctgttaaagtcaccatgggtcccaagggacgtaatgttgtgattgagcaaagttggggtgctcctaaagtgacaaaagatggtgttactgttgccaaaagtattgagttcaaagacaaaattaagaacgttggtgctagtcttgtgaagcaggttgcaaatgctactaatgatgttgctggtgatggtactacttgtgctactgtcctcacccgggctatatttgccgaaggatgcaaatcagttgccgcaggaatgaatgcaatggacttgcgaagaggtatttccatggcagttgatgctgtggtgacaaaccttaaaagcaaggctaggatgatcagcacatctgaagagattgctcaggttggaaccatttctgctaatggagagagggaaattggtgaacttattgccaaggctatggagaaggttggcaaagaaggtgttatcacaatccaagatggaaagacattgtttaacgagttggaagttgtagaggggatgaaattggacagaggttatacttcaccatactttatcactaatcaaaaaacccaaaaatgtgaactagacgatcctctcattcttatccacgagaagaagatctcaagcatcaactctatagtgaaagtgttggagttggctctgaagaggcaaagaccactattgattgtttctgaagatgtggaaagtgatgctcttgcaactcttatccttaacaagctccgtgccggaattaaggtctgtgccatcaaggcccctgggtttggagagaataggaaggccaatttgcaagaccttgctgcccttactggtggagaggttatcacagacgagcttggcatgaatctggagaaggtggacctaagcatgctaggaacctgcaaaaaggttacagtctccaaggacgacactgttattcttgatggggctggcgacaagaaaggaattgaggaaagatgtgaacagattaggtcagcaattgaactgagcacctcagattatgacaaggaaaaactgcaagaaaggttggctaagctctctggaggtgttgcagtgttgaagattggaggagcaagtgaagctgaagttggtgagaagaaagacagagtgacagatgctttgaatgccactaaagcagcagttgaagagggtattttaccaggaggaggtgtggctcttctatacgcagcaagagagttggaaaaacttccaacagccaactttgaccagaagattggtgtccagattattcagaacgcattgaagactcctgtttacacaatcgcttcaaatgctggagttgaaggtgctgttattgttggcaagctcttggagcaagataacccagacctcggttatgatgctgctaaaggtgaatatgtggatatggtgaaagctggaatcatagaccctctgaaagtgatcaggacagctttggttgatgctgcgagtgtgtcatctttgttgacgacaacggaagctgtagtggttgatcttccgaaagacgaaagcgagtcaggagcagcaggagcaggcatgggtggaatgggaggcatggactactagatccactaaattctgtcttttgttttcaccaatcaccatcttaacttgagaagagagatacgattcttttaggagttttagtcttcgtctttgccttattgttgctcaataacctcaaaagttttacaataaacagagcacacttggcaatgttacgagacacactattagcatcaacaaattttcctaaggca

SEQ ID NO: 929 - DNA, 1937 bp, Helianthus annuus
ggaaaacttaaaccctcaccatctcatctctaaaaccctattcgctacttcttcttcttctccaaaaatcttgagcaatcatgtatcgattcgcactcaatcttgcttctaaatccaggattgctagcaacagaactcaacagattggaagtaaattgaattggagcagaaattacgcagctaaagacatcaaatttggagttgatgctagggctttaatgcttagaggtgttgaagagcttgctgatgctgttagagtcactatgggcccaaaggggcgtaatgtggtgattgaacaaagttacggagcaccgaaagtaacaaaagacggtgtaaccgttgcaaaaagcatcgaatttaacgataaagtcaagaacgttggtgcaagtcttgtgaaacaagttgctaatgctacaaacgatgttgccggtgatggtacgacttgtgcaacggtccttacacgtgcgatattcgcggaagggtgcaaatcggttgcggctggtatgaatgcaatggacctcagacgaggtatttccatggcggttgatgcggttgtaacaaacttgaagagtagggcccgtatgataagcacgtctgaggaaatcacacaggtgggtacgatttcggcaaacggagaacgtgaaatcggtgaactgatagctaaagctatggagagagttgggaaagagggtgtcatcacaattcaagatgggaagacgttgtataatgaactagaagttgttgagggaatgaagttggacaggggctacatatctcctcatttcattacaaaccaaaaaaatcagaaatgtgaactagacgaccctcttgttctaatatacgagaagaagatttcaaacattaattcggttatcaaagtgttagagttggcactgaagaaacaaaggcccctgttaatagtcgctgaagatgtggaaagtgatgcattggctaccttagttcttaacaagcttcgtgctggagtcaaggtttgtgctataaaagcacctggttttggtgagaacagaaaggcgaacttgcaagatcttgccactcttactggtggtcagcttataaccgaagaactcggtatgaatctcgacaatctagagccagaaatgcttggctcttgtaaaaaggtgactgtatcgaaagatgacactgtcgtgcttgatggtgctggtgataaaaagtctattgaagaacgatgtgaacagataagatcagcagtcgagtctagcacgtctgattatgataaagagaaattgcaagaaaggttagccaagctttctggtggtgttgctgtacttaagattgggggagctagtgacactgaagtaggtgaaaagaaagatagagttacagacgctttaaatgcaacaaaagcggctgtcgaggaaggaattgttccaggtggtggcgttgctcttctgtatgcatctaaagaattggataagctgcaaacagccaattttgatcagaaaattggcgttcagattattcaaaatgcactaaagatgccagttcatacaattgcttctaatgccggagtggaaggttcggttgtggttggtaagctattagagcaggatgacccggatcttgggtatgatgcagctaaaggtgaatatgtggatatggtgaaaaatggtatcattgacccgttgaaagtgattagaacagccttagttgatgcagcaagtgtgtcctctttgatgaccaccaccgaagctattgtggttgaactccctcaaccggctagtgaagcggctccaggaatgggtggtggaatgggcggcatgggcgggggaatgggtggcatgggcttttgatctgccatgtgatcccgcgactgattgacatacattctactgacaaaataaacacacgaaaggctggctcgtgtgattttaatttgtcagtagaatgtatgtcaa

SEQ ID NO: 930 - DNA, 1938 bp, Chrysanthemum coronarium
aaaacacacacactaaatctccagtcagtaaaaaccaatcatgtatcgcttcgcagcaaatcttgcttccaaatcaagaattgcaactaagacaacccgacagattggaagtaggttgaatataagcagaaactatgctgcaaaagatattagatttggagttgatgctagggcgttaatgcttagaggcgttgaagagcttgctgatgctgttaaagttaccatgggcccgaaggggcgtaatgtggttattgaacaaagttatggagcgccaaaagtaacgaaagacggtgtaacggttgcaaaagccattgaatttaatgataaggtgaagaatgttggcgcgagtcttgtaaaacaggttgctaacgctacaaatgacgtggctggtgatggtacaacttgcgcaacagttcttacacgcgctatattttcagaaggttgcaagtcggttgcagctggtatgaatgcaatggacctcaggcgtggtattacgatggctgttgattcggttgtaacaaacttgaaaagtagagctcgtatgataagcacatctgaggaaatcacacaggtgggtacaatttccgcaaacggagaacgtgaaatcggtgaactaatagctaaggctatggaaagagttgggaaagagggtgtcatcactattcaagacggaaagacgttgtataatgaattagaagttgttgagggaatgaagctggacagaggatatatatctccacattttatcacgaacaccaagaatcagaaatgtgaactagatgaccctattgttctaatctacgagaagaagatttcaaacattaattccgtgatcaaagtgttagagttggcactgaagaaacaaaggcctctattaatcgttgctgaagatgtggaaagtgaagctttggctaccttaattcttaacaagctccgtgccggcattaaggtttgtgccataaaagctcctggttttggcgagaacagaaaggccaaattgcaagatcttgccactctcaccggaggccaggttataacagaagaacttggtatgaacatcgacaacgtggagttggaaatgcttggctcgtgtaaaaaggttactgtatcgaaagatgatacagttgtgcttgacggtgccggtgataagaagtcgatagaagaacgatgtgaacagatcaggtcagcaatcgagtccagcacatctgattacgatagagagaagttccaagagaggttagctaagctttctggtggtgttgctgtactaaagattggaggagccagtgacactgaagtaagtgaaaagaaagacagagttaccgatgctctaaatgccacaaaggctgctgttgaggaaggaatcgtaccaggcggtggtgttgctcttctgtatgcatctaaagaattggacaaattgcaaacagccaatttcgatcagaaaataggggttcagattattcagaatgcactaaagatgccagttcatacaatagcatctaatgctggagtggaaggttcggttgtggttggtaagcttttagagcaagatgaccaagatcttggatatgatgccgccaaaggtgaatatgtggacatggtgaaaaatggtatcattgacccgttgaaggtgataaggacagccttggtcgatgcagcaagtgtgtcttctttgatgacgactactgaagcaattgtgactgaactcccaaaaccggctagtgaagcagctccaggaatgggcggcggcatgggtggaatgggcggaatgggtggcatggacttttgatcagccctgtgatagcaaaaaagattgacatacattttactgacagaataaacacatagagcgtggctcagtatgtgcgacactcggtagtaaaacaaaggcccaagtgtgtttacattttgagaactagtacattattaggatccgga

SEQ ID NO: 931 - DNA, 1938 bp, Chrysanthemum coronarium
aaaacacacacactaaatctccagtcagtaaaagccaatcatgtatcgcttcgcagcaaatcttgcttccaaatcaagaattgcaactaagacaacccgacagattggaagtaggttgaatataagcagaaactatgctgcaaaagatattagatttggagttgatgctagggcgttaatgcttagaggcgttgaagagcttgctgatgctgttaaagttaccatgggcccgaaggggcgtaatgtggtgattgaacaaagttacggagcgccaaaagtaacgaaagacggtgtaacggttgcaaaagccattgaatttaatgataaggtgaagaatgttggcgcgagtcttgtaaaacaggttgctaacgctacaaatgacgtggctggtgatggtacaacttgcgcaacagttcttacacgcgctatattttcagaaggttgcaagtcggttgcagctggtatgaatgcaatggacctcaggcgtggtattaccatggctgttgattcagtagtaacaaacttgaaaagtagagcccgtatgataagcacatctgaggaaatcacacaggtgggtacaatttccgcaaacggagaaagtgaaatcggtaaaataatagctaagactatggaaagagttgggaaagagggtgtcatcaccattcaagacggtaagacgttgtataatgaactagaagttgttgagggaatgaagttggacaggggatatatatctccacattttatcacaaacaccaagaatcagaaatgtgaactggatgaccctactgttctaatctacgagaagaagatttcaaacattaattccgtgatcaaagtgttagagttggcactgaagaaacaaaggccactattaatcgttgctgaagatgtggaaagtgaagcgttggctaccttaattcttaacaagctccgtgccggcattaaggtttgtgccataaaagctcctggttttggtgagaacagaaaggccaacttgcaagatcttgccactctcaccggaggccaggttataacagaagaacttggtatgaaccttgacaacgtggagttagaaatgctgggctcgtgtaaaaaggttactgtatcgaaagatgacacagtcgtgcttgatggtgccggtgataagaagtcgatagaagaacggtgtgaacagattaggtcagcaatcgagtcgagcacatctgattatgatagagagaagttccaagagaggttggctaagctttctggtggcgtcgctgtactaaagattggaggagccagtgacactgaagtaagtgaaaagaaagacagagttactgatgctctaaatgccacaaaggctgctgttgaggaaggaatcgtaccgggtggtggtgttgctcttctgtatgcatctaaagaattggacaaattgcaaacagccaatttcgatcagaaaataggggttcagattattcagaatgcactaaagatgccagtccatacaatagcatctaacgctggagtggaaggttcggttgtggttggtaagcttttagagcaagatgacccagatcttggatatgatgccgctaaaggtgaatatgtggacatggtgaaaaatggtatcattgacccgttgaaggtgataaggacagccttggtcgatgcggcaagcgtctcttctttgatgacgactactgaagctattgtgactgaactcccaaaaccggctagtgaagcagctccaggaatgggcggcggcatgggtggaatgggcggaatgggtggcatggacttttgatcagccctgtgatagcaaaaaagattgacatacattttactgacataataaacacataagagcttggctcattatgtgcgtcacttggtagtaaaacaaaggcctaagtgtgtttacagtgtgagaactagtacattattagcatgcgg

SEQ ID NO: 932 - DNA, 2097 bp, Arachis hypogaea
gagtagtggtagctacttcttctagagccttctcacaccacttcaaaagcaaccctgcttcaatcttcatcttcaccactagtctctgcaatttctttgctcaattcaatcatcagccgccatgtatcgctttgccacttccctagcttctaaagccaggattgccaggaacagcagtcaacagattggaagtaggttgagttggagcaggaattatgcggccaaggatattcgatttggtgtggaggctcgggctgcgatgcttaagggtgttgaagagcttgctgatgctgtgaaagttacaatgggtcctaaggggcgtaatgtggtgattgagcaaagttttggtgcccctaaagtgacaaaagatggtgtcactgtagccaagagcattgaattcaaggataaagtaaaaaatgtaggtgctagtcttgtaaagcaggttgcaaatgcaaccaatgatgtcgctggtgatggtactacatgtgcgacagttcttactcgagcaattttcacggaagggtgcaagtcagttgctgctggaatgaatgcaatggacctgaggcgaggtataaatatggctgttgatgctgtggtgacaaacctgaaaagcagagcaaggatgattagtacttctgaagaaatagctcaggttgggacaatatcagctaatggggaaagagaaattggtgagttaattgcaaaggctatggagaaagttggcaaagagggtgtaatcactatctcagatggtaagacactgtataacgagttagaagttgttgaaggaatgaagcttgataggggctacatttctccatatttcataactaaccagaagaaccagaaatgtgaacttgaggatccactcattctaatccatgagaagaaaatctcaagtataaatgctatagtcaaagtattagagttggctttaaagagacaaagacctttgttgattgttgccgaagatgtggaaagtgatgcccttgcaactcttattctaaataaacttcgtgctggaatcaaggtatgtgccatcaaagcccctggttttggtgaaaacaggaaatctggacttcaggatcttgctgttcttacgggaggtgatcttatcactgaagagctaggcttgaatcttgaaaaagtggatttggagatgcttggcacctgtaaaaaggtaacaattctaaagatgacactgtcattcttgatggcgctggtgacaagaaagcaattgaggaaagatgtgatcagattaggtcagcaattgaaaatagcacttcagattatgacaaggaaaagttgcaggaacgcctggccaaactttctgggggtgttgcagtgctcaagattggaggagccagtgaggctgaagttggtgagaagaaggatagagtgacagatgccttgaatgcaaccaaggccgccgtagaggagggcatagtacctggtggtggtgttgctcttctttatgcatcaaacgaattagataagcttccaactgccaacttcgatcaaaagataggtgtacaaattatccaaaatgccttgaagacacctgtccacacaattgcatcaaatgctggagttgagggtgctgtcgtcgttggaaaactattggaacaggacaatcctgatcttggatatgatgcagcaaaaggtgaatacgttgatatggttaaagctggaattattgatccactgaaggttattagaaccgccttggttgacgcagccagtgtatcatctttgatgacaacaactgaggctgttgtttctgaactctcaaaggatgacgaggctccttcaatggctggtggcatgggtggtatgggtggcatggattattagtttggcttccttttgattattaatacttgaaaaagaatggtgcttcactaatttatagcctgtgtcttatttgttatcacaaagcatccgtgtgtattcatagtgagagatcaaatagatagttaggaagggtttttttgttgttgcaatgataacaaataagatagttgggacattttacagtgtgatctacagaacgttgttccctgtgaaattgtcaattgaaagaggtctctactaatt

SEQ ID NO: 933 - DNA, 2087 bp, Theobroma cacao
ttgtcttgacatcccaacactctctttgttactttctagagctttcttctattcctttgttttctttccccaaagaaaccatgtatcgtttcgcttcaagcctcgcttccaaagctaggattgctaggaatactacacatcagattggcagtagattgagttggaataggaactatgccgcaaaagatataaaatttggggtagaagctcgagctttgatgcttaaaggcgttgaagaacttgctgatgctgttaaagttaccatgggtcctaagggacgaaatgtggttattgaacaaagctatggtgctccaaaagtgactaaagatggtgtgactgttgcaaagagcattgatttcaaggataaaatcaagaatgttggtgctagccttgtgaaacaagttgcgaatgccaccaacgatgtagctggtgatgggactacttgtgcaacattgcttacacgagcaatatttacagaaggatgcaagtcagttgctgctggaatgaatgcaatggatctaagacgtggcataacaatggcagttgatgatgttgtaacaaacttgaaaagccgggcacggatgattagcacatctgaagaaatagctcaggttggaacaatatcagctaatggagagagggaaattggtgagttaattgcaaaagccatggagaaggttggcaaagagggggtgatcacaattcaagatgggaaaacattatttaatgagttggaagttgttgagggcatgaagcttgacaggggctacatatccccatatttcatcaccaacacgaaaaaccaaaaatgtgaattagatgatcctcttattttgatccatgagaagaaaatatctagcttaaatgctgtggtgaaagtactagagttagctttgaagagacaaaggccattgttgattgtagctgaagatgtagagagtgaagcacttgcgaccctcattcttaacaagcttcgtgctggaatcaaggtctgtgccataaaagcccctggttttggagaaaataggaaggcgagtctgcaagatcttgctgtcctcacaggaggagaggttataactgaagaacttggaatgaaccttgaaaaggtggatcttgacatgcttggcacttgcaaaaaggctactgtctcaaaggatgacactgtttttcttgatggggatggtgacaagaaagccattgaagaaagatgcgaacagattagatcagcaattgaattgagcacctctgattatgataaggagaagttgcaagaaagattggcaaagctttctggtggtgttgctgtcctgaagatcggaggagctagtgaagctgaagttggtgagaagaaggatagagttacggatgcattaaatgccacaaaggcagctgtagaagagggtattgtgccaggtggtggtgtcgctcttctgtatgcatccaaagagttggataagctacctacagcgaactttgaccagaagattggtgttcaaattatacagaatgctctaaagacacctgtgtacacaattgcttcgaatgcaggagtggagggagctgttgttgttggtaagctgttggagcaggataacccggatcttgggtatgatgccgccaaaggtgaatatgtcgatatggtaaaggctggtattgttgacccattgaaagtaattagaactgctttggttgatgcggcaagtgtgtcatcattgatgacaacaaccgaagctattgtagttgaacttcccaaggatgagaaggatgtttcagcaatgcctggcggtatgggtggcatggattattgaggttattcctaacaacacactgattgaaattgccttgatctagtaactgtttttcctccttcccaatatctcatgaagaaaagaatatcagctttttttagttgttttagtcttgtttcagttggaaggcaatcgatgtaatcgtaaggagagagcaacttgtaggtagttttggtgatcaaggtcaaaactgtttgattgttgttggtaggaagaattggattgcatggaaccatcgtttttggaaataacgaaaaaaagaaacactatcatccttgc

SEQ ID NO: 934 - DNA, 2209 bp, Citrus clementina
agaagctgctgttggatattgggttctagagtcttctcttctctttaaaagcaaatcactatcatcctctcttcgcttgctctgtgtcgcctctcattcttctctgccactagactcttactcttcgcttcctcttctctgcaattttacgaaactgccactatgtatcgtttcgcttcaagcctcgcttccaaagcaaggatcgctaggaacagtacccagcagattggaaatagattgagttggtccagaaactatgctgccaaagacattagatttggggttgaagctcgagctttgatgctgaagggtgttgaagaactcgccgatgctgtcaaagtcaccatgggacctaaggggcgtaatgtggtcattgaacaaagctggggtgctcccaaggtgacgaaagatggtgttactgttgcaaagagcattgaattcaaagataaagtcaagaacattggtgctagccttgtgaagcaagttgctaatgccaccaatgatgttgctggtgatggaactacctgtgcaacagttcttacccgagcaatatttacagaaggctgcaagtcagttgctgcgggtatgaacgcaatggatcttcgacgtggtatcactatggcagttgatgccgtggtaactaacttgaaaagcagagccagaatgatcagcacatctgaggagatagcacaggtggggacaatatcagcaaatggagagagagaaattggcgagttaattgcaaaggccatggagaaggtcggcaaagaaggagtaatcaccatacaagatgggaagacattatataatgagttggaagttgttgaaggaatgaagcttgacaggggttatatatctccttatttcataaccaaccagaaaaatcaaaaatgtgaattagaagatcctctcattcttgtccacgagaagaaaatctcaaatctaactgctgttgtgagggtattagagctggcattgaagagacaaaggcccttattgattgttgctgaagatgttgaaagtgaagcgctagcgactcttattttgaataagcttcgcgctggaatcaaggtatgtgccatcaaggcccctgggtttggagagaacaggaaggccaatatgcaggatctggctgttctcactggtggtgatctgataactgaagagctcggcatggaccttgagaaagtgaatctggatatgctcggcacttgcaaaaaggttacaatatcgaaggatgacactgtcattctggacggtgctggtgataagaagtccattgaagaaagatgtgaacagattaggtctgcgattgagaacagcacttctgattatgacaaggagaagttgcaagaaagattggcaaagctttctggtggtgttgctgtgttgaagattggaggagctagtgaagctgaagttggtgagaagaaagatagagttactgatgctttgaatgcgacgaaggcagctgtagaagagggtattgtgccgggtggtggtgttgcccttctatatgcggcaaaagagttggaaaagctgtccactgctaactttgaccagaagattggtgttcagattattcagaatgctctaaagacaccagtgcacacaattgctgctaatgcaggagttgagggggctgttgtggttggtaagctattggagcaggacaacactgaccttgggtatgatgccgccaaaggtgagtatgttgatatggtcaagtctggaattatcgatccattgaaagtaatcagaactgctttggttgatgctgcaagtgtatcatctttaatgaccacaactgaagctattgttgttgagctgcctaaggaggagaaggaagctccgggaggcatgggtggcatgggcggaatggggggcatggactattgaaatcccagtagaatgcttaactgattgtcccctttttttttttgggttccataatcaacatacaatctgaatgttaggattttgtggccagcttaatgagtctcaattgtgtcaatcataaggcatccttgtaatcatagtgagaggtaggcatttaggtcgtttggcaatttaggataagacattgctgattgatcctccacttggatgattggttggtttttaattgaactgtattttatttcaaaataaaatatatcttccttgcatatttggtgcttgaaaatgcaatctaatatttattatctta

SEQ ID NO: 935 - DNA, 2558 bp, Gossypium raimondii
agaagaaactgctattcctgcttctagacccttcttctctcccatccctttctggttttcttttcccctgttttaaaacccacccctgaaacccacccattgtcttttgtcaccccacaaacagctttgctgtcaacattttactcaagattttcctctttttctttcctcccaaactaaccatgtatcgttttgcttcaagccttgcttctaaagctagggctgctaggaacactacatatcagattggtagcagattgagttggaataggaactatgctgcaaaagatattaaatttggtgttgaagctcgagcattgatgcttaaaggtgttgaagagctcgctgatgctgttagagtaaccatgggtcctaaggggcggaatgtggttattgaacaaagctacggtgctccaaaagtgactaaagatggtgtcactgttgcaaagagtattgaattcaaagacaaagtgaagaacgttggtgcgagtcttgtgaaacaagttgcaaatgccaccaatgatgtagctggtgatggaaccacctgtgcaacggtgcttacacgagcaatttttaccgaaggatgcaagtctgttgctgcaggaatgaatgcaatggacctaaggcgtggcataacaatggcagttgatgccgttgtaacaaacttgaaaagccgggcaaggatgattagcacatctgaagagattgctcaggttggaacaatatcggctaatggagagagggaaattggtgagttgattgcaaaggccatggagaaggttggcaaagaaggggtgataacaattcaggatggtaaaacattatataatgagttggaagttgttgagggcatgaagctagacaggggctacatatccccatatttcatcaccaacactaaaacccaaaaatgtgaattagatgatcctcttatcctaattcatgagaagaaagtatcaagcttgaatgctgttgtaaaagtattagagttagctttaaagagacaaaggcccttgctgattgtagctgaagatgtagagagcgaagcacttgctacgctcattcttaacaagcttcgtgctggaatcaaggtctgtgccatcaaagcccccggttttggagaaaacaggaagtctagtctgcatgatcttgctgtcctcacaggaggagaggttataacagaagaacttggcatgaaccttgaaaaggtggatctggacatgctcggcacttgcaaaaaggttactgtctcgaaggatgacactgttattcttgatgggaatggtgacaagaaagccattgaggaaagatgcgaacagattagatcagcaattgaattgagcacctctgattatgataaggagaagttgcaagagagattggcaaaactttctggcggtgtggctgttttgaagatcggaggagctagtgaagctgaagttggcgagaagaaggatagagttacagatgcactgaatgcaacaaaagcagctgtagaagagggtattgtgccaggtggtggtgtcgctctgttgtatgcatcgaaagagttggacaagctacctacagctaactttgaccagaagattggtgttcaaattatccagaatgctctaaagacacctgtacacacaattgcttcaaatgctggagtcgagggagctgtcattgttggtaagctgttggagcaggataaccctgatcttggctatgatgcagccaaaggtgaatatgttgatatggtaaaggctggtattattgatccattgaaagtaattagaactgctttggtcgatgctgcaagcgtgtcatcattgatgacaactaccgaagctgttgtagtcgaacttccaaaggatgagaaggatgttccggcaatgcctggcggtatgggtggcatggattattaagcctgaagtgaaaaacctgagtggtaacatgtttaatggaaacgtgggaaaattttacttggggggcaattaagttattatgctaaaatatactgaattttaatttccccatttttgggtttaaatgttcaaatttaacttttaacttttaacattgtttaaagttttataatacaaatattattttcgttttattttatatttcatatataacatccagagaaaaaatacaattctgatatggaacattattaaatttgaatatagaacattcttttcattttttccattttcgctttaagtttcatttaatttttatatcaatttttttataaatctgttatattcaaccacctattgataggtactaattttattttgaaatatcaaaaagatagttttacaaaacaacaaaatcattttgaaagtatttttatctttttatatttttaaataaaattatcaaaatacatgtaagtagttataatttgtactttcttagttacatcatttaattgaagtcgcattcaatttttataattttttttacatatttgttgtataaaatttttcaccaactttaaactctaatgcattttaaaaataaattgtttaaaattatatatgaaatttaatttaatgtgtaat

SEQ ID NO: 936 - DNA, 2132 bp, Vitis vinifera
ccgttctctctaaaaggtgttgcttccctctcctcacgtcgcaaccgagttctcctctctctctctctgaaaccctcattttctctctctaaaacccttcatttcgtgaagttacagcttctgcaactccccagccatgtaccgtttcgccaccagtctcgcttccaaggctcggatcgctaggaacagcacccatcagattggtagtaggctgaactggagcagaaactatgctgctaaagacatcagattcggggttgaggctcgagccttgatgcttaagggcgtggaagagctcgcagatgctgttagagtcaccatgggccccaaggggcgtaacgtggtactagagcaaagttttggtgccccaaaagtgacaaaagatggtgtaactgttgcaaaaagcattgagttcaaggatcgaatcaagaatgttggtgcaagccttgtgaaacaggttgcaaatgccactaatgatgtagcaggagatggtaccacctgtgccacagtccttacccgagcaatatttactgaagggtgcaagtcggttgctgctggaatgaatgcaatggacctaagaaggggtatctcgatggcagtagatgctgtagtgacaaacttgaaaagcagagctaagatgatcagcacatctgaagaaatagcacaggttgggacaatatcagcaaatggtgagagagaaattggtgaattgatcgcaaaggctatggagaaagttggcaaagagggagtaatcacaatttcagatgggaagacattgtataatgaattggaagttgttgaggggatgaagctggatagaggttacatatccccttattttataacaaaccagaaaacccaaaaatgtgaactagaaaatcctcttgttctaatccatgagaagaaaatctcgaatatacatgctgttgtgaaagtgctagagatggcattaaagactcagaggcctttactgattgttgctgaagatgtggaaagcgaagcactggccactcttattctaaataagcttcgtgctggaatcaaggtctgtgccatcaaagcacctgggtttggagagaacaggaaggccgccctgcaggatctggcaactctcacaggaggggagcttataacggaagagcttggtttgaaccttgagaaggcagaactggatatgcttggcacttgcaaaaaggttacaatatctaaggacgatactgttatccttgatggggctggtgacaagaaggccattgaggaacggtgtgagcagattaggtcagccattgaatcgagcacttctgattatgacaaggaaaagttgcaagaaaggttggccaagctttctggtggtgttgctgtcttgaagataggaggagctagtgaagctgaagttagtgagaagaaagatagggttacagatgctctaaatgctactaaggcagctgtagaagaaggaatcgtaccaggtggtggcgtggcacttctttatgcttccaaagagttggacaagctgccaacatcaaattttgatcagaagattggtgttcagattattcagaatgctctgaaaacacctgtgttcacaattgcttctaatgctggagttgagggggctgttgtggtcggcaagctgttggagcaggataaccctgatcttggatatgatgcagccaaaggtgaatatgttgatatggtcaaagctggaattattgatccactgaaagtaattagaacagctttggttgatgctgcaagtgtgtcatcgttgatgacaacaactgaagctgttgtggttgaactgccaaaggatgagaaggaagttcctgcaatgggaggtggcatgggtggcatggactactaacgggcctcgcagctggtagactgatctacctgacataacattatttccacccaaaaaattcacatctgaaatgagcattattagggttttgtcttgaatgaatgagcctttgtttttcctgtcataggtaaggcaaccatgtaatcatagtgagaggtcagtacttaggttctgataatgggggtgaaactgtcactgatagtgcttggaaggatttgagacttcaatttttctcaaataaaaaattctcttccgtgcatgatggatg

(The sequence listing continues in the following parts.)

What is claimed is:

1. A method of selecting a plant having increased leaf blade area and leaf number as compared to a control plant, the method comprising:
   (a) transforming a cell of the plant with a nucleic acid construct comprising a polynucleotide which comprises a nucleic acid sequence encoding a polypeptide comprising an amino acid sequence at least 95% identical to the full-length amino acid sequence set forth by SEQ ID NO: 623, and a promoter for directing transcription of said nucleic acid sequence in said plant cell, wherein said promoter is heterologous to said polynucleotide,
   (b) generating plants from said plant cell, and
   (c) selecting said plants for increased leaf blade area and leaf number as compared to non-transformed plants of the same species under the same growth conditions, thereby selecting the plant having the increased leaf blade area and leaf number.

2. A method of selecting a plant having increased leaf blade area and leaf number under drought stress as compared to a control plant, the method comprising:
   (a) transforming a cell of the plant with a nucleic acid construct comprising a polynucleotide which comprises a nucleic acid sequence encoding a polypeptide comprising the amino acid sequence selected from the group consisting of SEQ ID NOs: 623, and 7276-7293, and a promoter for directing transcription of said nucleic acid sequence in said plant cell, wherein said promoter is heterologous to said polynucleotide,
   (b) generating plants from said plant cell, and
   (c) selecting said plants under drought stress conditions for increased leaf blade area and leaf number as compared to non-transformed plants of the same species under the same growth conditions,
   thereby selecting the plant having increased leaf blade area and leaf number under drought stress.

3. The method of claim 2, wherein said nucleic acid sequence is selected from the group consisting of SEQ ID NO: 377, 72 and 2259-2283.

4. A method of producing a crop, the method comprising growing a crop plant transformed with a nucleic acid construct comprising a polynucleotide which comprises a nucleic acid sequence encoding a polypeptide comprising an amino acid sequence at least 95% identical to the full-length amino acid sequence set forth by SEQ ID NO: 623, and a promoter for directing transcription of said nucleic acid sequence in said plant cell, wherein said promoter is heterologous to said polynucleotide, wherein the crop plant is derived from plants which comprise said nucleic acid construct and which have been selected under drought stress conditions for increased leaf blade area and leaf number as compared to non-transformed plants of the same species under the same growth conditions, and wherein the crop plant has increased leaf blade area and leaf number under the drought stress conditions, thereby producing the crop.

5. The method of claim 4, wherein said amino acid sequence is selected from the group consisting of SEQ ID NOs: 623, and 7276-7277.

6. The method of claim 4, wherein said nucleic acid sequence is selected from the group consisting of SEQ ID NOs: 377, 72 and 2259-2260.

7. The method of claim 1, wherein said amino acid sequence is set forth by SEQ ID NO: 623.

8. The method of claim 1, wherein said nucleic acid sequence is set forth by SEQ ID NO: 377 or 72.

9. The method of claim 4, wherein said amino acid sequence is set forth by SEQ ID NO: 623.

10. The method of claim 4, wherein said nucleic acid sequence is set forth by SEQ ID NO: 377 or 72.

11. A method of increasing leaf blade area and leaf number of a plant, the method comprising:
(a) expressing within the plant a heterologous polynucleotide which comprises a nucleic acid sequence encoding a polypeptide comprising an amino acid sequence at least 95% identical to the full-length amino acid sequence set forth by SEQ ID NO: 623, and a promoter for directing transcription of said nucleic acid sequence in said plant cell, wherein said promoter is heterologous to said polynucleotide,
(b) selecting said plants resultant of step (a) for a statistically significant increase in leaf blade area and leaf number as compared to non-transformed plants of the same species under the same growth conditions, wherein each of said statistically significant increases has a p-value less than 0.1,
thereby increasing the leaf blade area and leaf number of the plant.

12. The method of claim 11, wherein said amino acid sequence is set forth by SEQ ID NO: 623.

13. The method of claim 11, wherein said nucleic acid sequence is set forth by SEQ ID NO: 377 or 72.

14. The method of claim 1, wherein said selecting of step (c) is carried out under drought stress conditions
thereby selecting the plant having increased leaf blade area and leaf number under drought stress.

15. The method of claim 14, wherein said amino acid sequence is set forth by SEQ ID NO: 623.

16. The method of claim 14, wherein said nucleic acid sequence is set forth by SEQ ID NO: 377 or 72.

17. The method of claim 11, wherein said selecting of step (b) is carried out under drought stress conditions, thereby increasing leaf blade area and leaf number of the plant under drought stress conditions.

* * * * *